United States Patent 9,283,287 (MODIFIED POLYNUCLEOTIDES FOR THE PRODUCTION OF NUCLEAR PROTEINS) - sequence listing, part 5

SEQ ID NO: 4715 - protein, 1027 aa, Homo sapiens
MYEGKHIHFSEVDNKPLCSYSPKLCKQRRLNGYAFCIRHVLEDKTAPFKQCEYVAKYNSQRCTNPIPKSEDRRYCNSHLQVLGFIPKKERKKKNDPIDEVKVRHQMDTMAFSLTVPTLALKMPNGLDGMSLSPPGARVPLHYLETELEDPFAFNEEDDDLKKGATVRKKLQSKLAQNRQRQRETEILKVRQEHFSPPPAPSQQQPPQQHSHLSPLSTSLKPPAPPQGSVCKSPQPQNTSLPMQGVAPTTHTIAQARQLSHKRPLPLLPSSRAPTVDPPRTDRILMKATAFSPHFSCISRLQRLVKLCTQKHQLDTDLFPHLGLDWSEESGEEPEDSEQASPYQVAWSIRETLRYQRHASDDDDAESRSSRVTQLCTYFQQKYKHLCRLERAESRQKKCRHTFRKALLQAASKEPECTGQLIQELRRAACSRTSISRTKLREVEPAACSGTVKGEQCANKALPFTRHCFQHILLNHSQQLFSSCTAKFADGQQCSVPVFDITHQTPLCEEHAKKMDNFLRGDNSRKVQHQQQRKPRKKTKPPALTKKHKKKRRRGPRRPQKPIPPAVPQGNLSMPASVSLPVEASHIRSPSTPELSADELPDDIANEITDIPHDLELNQEDFSDVLPRLPDDLQDFDFFEGKNGDLLPTTEEAEELERALQAVTSLECLSTIGVLAQSDGVPVQELSDRGIGVFSTGTGASGIQSLSREVNTDLGELLNGRIVHDNFSSLELDENLLRSATLSNPPTPLAGQIQGQFSAPANVGLTSATLISQSALGERAFPGQFHGLHDGSHASQRPHPAQLLSKADDLITSRQQYSSDHSHSSPHGSHYDSEHVPSPYSDHITSPHTTSYSGDNMAATFSAEMPIMAQHLLPTQLEVPLGGVVNPRTHWGNLPVNLGDPSPFSNLLGADGHLLSTSLSTPPTTSNSETTQPAFATVTPSSSSVLPGLPQTSFSGMGPSAELMASTSPKQQLPQFSAAFGHQLSSHSGIPKDLQPSHSSIAPPTGFTVTGATATSTNNASSPFPSPN

SEQ ID NO: 4716 - protein, 37 aa, Homo sapiens
MYEGKHIHFSEVDNKPLCSYSPKLCKQRRLNGYAFCI

SEQ ID NO: 4717 - protein, 244 aa, Homo sapiens
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSLASSRYPPFPSDYLALQLPEPSPLRPKREKRPRLPRKLKMAVGPPDCPVGGPLTFPGRGSGAGVGTTLTPLPPPKMPPPTILSTVPRQMFSDAGSGDDALDGDDDLVIDIPE

SEQ ID NO: 4718 - protein, 161 aa, Homo sapiens
AGAARQPLLGVAGGQTLGATPGPVMNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSERGQA

SEQ ID NO: 4719 - protein, 137 aa, Homo sapiens
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSERGQA

SEQ ID NO: 4720 - protein, 244 aa, Homo sapiens; identical to SEQ ID NO: 4717

SEQ ID NO: 4721 - protein, 710 aa, Homo sapiens
MSAQGDCEFLVQRARELVPQDLWAAKAWLITARSLYPADFNIQYEMYTIERNAERTATAGRLLYDMFVNFPDQPVVWREISIITSALRNDSQDKQTQFLRSLFETLPGRVQCEMLLKVTEQCFNTLERSEMLLLLLRRFPETVVQHGVGLGEALLEAETIEEQESPVNCFRKLFVCDVLPLIINNHDVRLPANLLYKYLNKAAEFYINYVTRSTQIENQHQGAQDTSDLMSPSKRSSQKYIIEGLTEKSSQIVDPWERLFKILNVVGMRCEWQMDKGRRSYGDILHRMKDLCRYMNNFDSEAHAKYKNQVVYSTMLVFFKNAFQYVNSIQPSLFQGPNAPSQVPLVLLEDVSNVYGDVEIDRNKHIHKKRKLAEGREKTMSSDDEDCSAKGRNRHIVVNKAELANSTEVLESFKLARESWELLYSLEFLDKEFTRICLAWKTDTWLWLRIFLTDMIIYQGQYKKAIASLHHLAALQGSISQPQITGQGTLEHQRALIQLATCHFALGEYRMTCEKVLDLMCYMVLPIQDGGKSQEEPSKVKPKFRKGSDLKLLPCTSKAIMPYCLHLMLACFKLRAFTDNRDDMALGHVIVLLQQEWPRGENLFLKAVNKICQQGNFQYENFFNYVTNIDMLEEFAYLRTQEGGKIHLELLPNQGMLIKHHTVTRGITKGVKEDFRLAMERQVSRCGENLMVVLHRFCINEKILLLQTLT

SEQ ID NO: 4722 - protein, 462 aa, Homo sapiens
MAATVNLELDPIFLKALGFLHSKSKDSAEKLKALLDESLARGIDSSYRPSQKDVEPPKISSTKNISIKQEPKISSSLPSGNNNGKVLTTEKVKKEAEKRPADKMKSDITEGVDIPKKPRLEKPETQSSPITVQSSKDLPMADLSSFEETSADDFAMEMGLACVVCRQMMVASGNQLVECQECHNLYHRDCHKPQVTDKEANDPRLVWYCARCTRQMKRMAQKTQKPPQKPAPAVVSVTPAVKDPLVKKPETKLKQETTFLAFKRTEVKTSTVISGNSSSASVSSSVTSGLTGWAAFAAKTSSAGPSTAKLSSTTQNNTGKPATSSANQKPVGLTGLATSSKGGIGSKIGSNNSTTPTVPLKPPPPLTLGKTGLSRSVSCDNVSKVGLPSPSSLVPGSSSQLSGNGNSGTSGPSGSTTSKTTSESSSSPSASLKGPTSQESQLNAMKRLQMVKKKAAQKKLKK

SEQ ID NO: 4723 - protein, 462 aa, Homo sapiens; identical to SEQ ID NO: 4722

SEQ ID NO: 4724 - protein, 88 aa, Homo sapiens
MAATVNLELDPIFLKALGFLHSKSKDSAEKLKALLDESLARGIDSSYRPSQKDVEPPKISSTKNISIKQEPKISSSLPSGNNNGKVLT

SEQ ID NO: 4725 - protein, 132 aa, Homo sapiens
MAATVNLELDPIFLKALGFLHSKSKDSAEKLKALLDESLARGIDSSYRPSQKDVEPPKISSTKNISIKQEPKISSSLPSGNNNGKVLTTEKVKKEAEKRPADKMKSDITEGVDIPKKPRLEKPETQSSPITV

SEQ ID NO: 4726 - protein, 88 aa, Homo sapiens; identical to SEQ ID NO: 4724

SEQ ID NO: 4727 - protein, 462 aa, Homo sapiens; identical to SEQ ID NO: 4722

SEQ ID NO: 4728 - protein, 159 aa, Homo sapiens
MAATVNLELDPIFLKALGFLHSKSKDSAEKLKALLDESLARGIDSSYRPSQKDVEPPKISSTKNISIKQEPKISSSLPSGNNNGKVLTTEKVKKEAEKRPADKMKSDITEGVDIPKKPRLEKPETQSSPITVQSSKDLPMADLSSFEETSADDFAMEMG

SEQ ID NO: 4729 - protein, 18 aa, Homo sapiens
MAATVNLELDPIFLKALG

SEQ ID NO: 4730 - protein, 1042 aa, Homo sapiens
MELQKGKGAAAAAAASGAAGGGGGGAGAGAPGGGRLLLSTSLDAKDELEERLERCMSIVTSMTAGVSEREANDALNAYVCKGLPQHEEICLGLFTLILTEPAQAQKCYRDLALVSRDGMNIVLNKINQILMEKYLKLQDTCRTQLVWLVRELVKSGVLGADGVCMTFMKQIAGGDVTAKNIWLAESVLDILTEQREWVLKSSILIAMAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 4731 - protein, 1042 aa, Homo sapiens; identical to SEQ ID NO: 4730

SEQ ID NO: 4732 - protein, 902 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNCMPSTLGVQCRRCCPGPDYAWSQAGGRGRTPGATTHTRDKTTCACCLISSQTSDCFSFPALPFLPLVFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 4733 - protein, 902 aa, Homo sapiens; identical to SEQ ID NO: 4732

SEQ ID NO: 4734 - protein, 509 aa, Homo sapiens
PNSICRHLHLTDTSHGVRNKCLQLLGNLGSLEKSVTKDAEGLAARDVQKIIGDYFSDQDPRVRTAAIKAMLQLHERGLKLHQTIYNQACKLLSDDYEQVRSAAVQLIWVVSQLYPESIVPIPSSNEEIRLVDDAFGKICHMVSDGSWVVRVQAAKLLGSMEQVSSHFLEQTLDKKLMSDLRRKRTAHERAKELYSSGEFSSGRKWGDDAPKEEVDTGAVNLIESGACGAFVHGLEDEMYEVRIAAVEALCMLAQSSPSFAEKCLDFLVDMFNDEIEEVRLQSIHTMRKISNNITLREDQLDTVLAVLEDSSRDIREALHELLCCTNVSTKEGIHLALVELLKNLTKYPTDRDSIWKCLKFLGSRHPTLVLPLVPELLSTHPFFDTAEPDMDDPAYIAVLVLIFNAAKTCPTMPALFSDHTFRHYAYLRDSLSHLVPALRLPGRKLVSSAVSPSIIPQEDPSQQFLQQSLERVYSLQHLDPQGAQELLEFTIRVEVSPWWPGWSQTPELK

SEQ ID NO: 4735 - protein, 963 aa, Homo sapiens
MAAHLKKRVYEEFTKVVQPQEEIATKKLRLTKPSKSAALHIDLCKATSPADALQYLLQFARKPVEAESVEGVVRILLEHYYKENDPSVRLKIASLLGLLSKTAGFSPDCIMDDAINILQNEKSHQVLAQLLDTLLAIGTKLPENQAIQMRLVDVACKHLTDTSHGVRNKCLQLLGNLGSLEKSVTKDAEGLAARDVQKIIGDYFSDQDPRVRTAAIKAMLQLHERGLKLHQTIYNQACKLLSDDYEQVRSAAVQLIWVVSQLYPESIVPIPSSNEEIRLVDDAFGKICHMVSDGSWVVRVQAAKLLGSMEQVSSHFLEQTLDKKLMSDLRRKRTAHERAKELYSSGEFSSGRKWGDDAPKEEVDTGAVNLIESGACGAFVHGLEDEMYEVRIAAVEALCMLAQSSPSFAEKCLDFLVDMFNDEIEEVRLQSIHTMRKISNNITLREDQLDTVLAVLEDSSRDIREALHELLCCTNVSTKEGIHLALVELLKNLTKYPTDRDSIWKCLKFLGSRHPTLVLPLVPELLSTHPFFDTAEPDMDDPAYIAVLVLIFNAAKTCPTMPALFSDHTFRHYAYLRDSLSHLVPALRLPGRKLVSSAVSPSIIPQEDPSQQFLQQSLERVYSLQHLDPQGAQELLEFTIRDLQRLGELQSELAGVADFSATYLRCQLLLIKALQEKLWNVAAPLYLKQSDLASAAAKQIMEETYKMEFMYSGVENKQVVIIHHMRLQAKALQLIVTARTTRGLDPLFGMCEKFLQEVDFFQRYFIADLPHLQDSFVDKLLDLMPRLMTSKPAEVVKILQTMLRQSAFLHLPLPEQIHKASATIIEPAGESDNPLRFTSGLVVALDVDATLEHVQDPQNTVKVQVLYPDGQAQMIHPKPADFRNPGPGRHRLITQVYLSHTAWTEACQVEVRLLLAYNSSARIPKCPWMEGGEMSPQVETSIEGTIPFSKPVKVYIMPKPARR

SEQ ID NO: 4736 - protein, 338 aa, Homo sapiens
MPALKQTASQVTQTLRDLQRLGELQSELAGVADFSATYLRCQLLLIKALQEKLWNVAAPLYLKQSDLASAAAKQIMEETYKMEFMYSGVENKQVVIIHHMRLQAKALQLIVTARTTRGLDPLFGMCEKFLQEVDFFQRYFIADLPHLQDSFVDKLLDLMPRLMTSKPAEVVKILQTMLRQSAFLHLPLPEQIHKASATIIEPAGESDNPLRFTSGLVVALDVDATLEHVQDPQNTVKVQVLYPDGQAQMIHPKPADFRNPGPGRHRLITQVYLSHTAWTEACQVEVRLLLAYNSSARIPKCPWMEGGEMSPQVETSIEGTIPFSKPVKVYIMPKPARR

SEQ ID NO: 4737 - protein, 942 aa, Homo sapiens
MASNSTKSFLADAGYGEQELDANSALMELDKGLRSGKLGEQCEAVVRFPRLFQKYPFPILINSAFLKLADVFRVGNNFLRLCVLKVTQQSEKHLEKILNVDEFVKRIFSVIHSNDPVARAITLRMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTAASTPLNPLSFQCEFVKLRIDLLQAFSQLICTCNSLKTSPPPAIATTIAMTLGNDLQRCGRISNQMKQSMEEFRSLASRYGDLYQASFDADSATLRNVELQQQSCLLISHAIEALILDPESASFQEYGSTGTAHADSEYERRMMSVYNHVLEEVESLNRKYTPVSYMRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 4738 - protein, 948 aa, Homo sapiens
MASNSTKSFLADAGYGEQELDANSALMELDKGLRSGKLGEQCEAVVRFPRLFQKYPFPILINSAFLKLADVFRVGNNFLRLCVLKVTQQSEKHLEKILNVDEFVKRIFSVIHSNDPVARAITLRMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTAASTPLNPLSFQCEFVKLRIDLLQAFSQLICTCNSLKTSPPPAIATTIAMTLGNDLQRCGRISNQMKQSMEEFRSLASRYGDLYQASFDADSATLRNVELQQQSCLLISHAIEALILDPESASFQEYGSTGTAHADSEYERRMMSVYNHVLEEHTACLCNAIIALLKVPLSFQRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 4739 - protein, 962 aa, Homo sapiens
MASNSTKSFLADAGYGEQELDANSALMELDKGLRSGKLGEQCEAVVRFPRLFQKYPFPILINSAFLKLADVFRVGNNFLRLCVLKVTQQSEKHLEKILNVDEFVKRIFSVIHSNDPVARAITLRMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTAASTPLNPLSFQCEFVKLRIDLLQAFSQLICTCNSLKTSPPPAIATTIAMTLGNDLQRCGRISNQMKQSMEEFRSLASRYGDLYQASFDADSATLRNVELQQQSCLLISHAIEALILDPESASFQEYGSTGTAHADSEYERRMMSVYNHVLEEVESLNRKYTPVSYMHTACLCNAIIALLKVPLSFQRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 4740 - protein, 913 aa, Homo sapiens
MASNSTKSFLADAGYGEQELDANSALMELDKGLRSGKLGEQCEAVVRFPRLFQKYPFPILINSAFLKLADVFRVGMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTAASTPLNPLSFQCEFVKLRIDLLQAFSQLICTCNSLKTSPPPAIATTIAMTLGNDLQRCGRISNQMKQSMEEFRSLASRYGDLYQASFDADSATLRNVELQQQSCLLISHAIEALILDPESASFQEYGSTGTAHADSEYERRMMSVYNHVLEEVESLNRKYTPVSYMHTACLCNAIIALLKVPLSFQRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 4741 - protein, 978 aa, Homo sapiens
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSILVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKLGQLLAATCKELPGPKESRRTAKDLWEVVVQICSVSSQHKRGNDGRVSLIKQRESTLGIMYRSELLSFIKKLREPLVLTIILSLFVKLHNVREDIVNDITAEHISIWPSSIPNLQSVDFEAVAITVKELVRYTLSINPNNHSWLIIQADIYFATNQYSAALHYYLQAGAVCSDFFNKAVPPDVYTDQVAILCQFLREIDYKTAFKSLQEQNSHDAMDSYYDYIWDVTILEYLTYLHHKRGETDKRQIAIKAIGQTELNASNPEEVLQLAAQRRKKKFLQAMAKLYF

SEQ ID NO: 4742 - protein, 995 aa, Homo sapiens
MSAEAADREAATSSRPCTPPQTCWFEFLLEESLLEKHLRKPCPDPAPVQLIVQFLEQASKPSVNEQNQVQPPPDNKRNRILKLLALKVAAHLKWDLDILEKSLSVPVLNMLLNELLCISKVPPGTKHVDMDLATLPPTTAMAVLLYNRWAIRTIVQSSFPVKQAKPGPPQLSVMNQMQQEKELTENILKVLKEQAADSILVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKLGQLLAATCKELPGPKESRRTAKDLWEVVVQICSVSSQHKRGNDGRVSLIKQRESTLGIMYRSELLSFIKKLREPLVLTIILSLFVKLHNVREDIVNDITAEHISIWPSSIPNLQSVDFEAVAITVKELVRYTLSINPNNHSWLIIQADIYFATNQYSAALHYYLQAGAVCSDFFNKAVPPDVYTDQVIKRMIKCCSLLNCHTQVAILCQFLREIDYKTAFKSLQEQNSHDAMDSYYDYIWDVTILEYLTYLHHKRGETDKRQIAIKAIGQTELNASNPEEVLQLAAQRRKKKFLQAMAKLYF

SEQ ID NO: 4743 - protein, 552 aa, Homo sapiens
MMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 4744 - protein, 658 aa, Homo sapiens
MKLYCLSGHPTLPCNVLKFKSTTIMLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 4745 - protein, 502 aa, Homo sapiens
KIYCLSGHPTLPCNVLKFKSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 4746 - protein, 637 aa, Homo sapiens
MKLYCLSGHPTLPCNVLKFKSTTIMLDCGLDMTSTLNFLPLPLVQSPRLSNLPGWSLKDGNAFLDKTELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 4747 - protein, 634 aa, Homo sapiens
MLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSVPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 4748 - protein, 584 aa, Homo sapiens
MASVQASRRQWCYLCDLPKMPWAMVWDFSEAVCRGCVNFEGADRIELLIDAARQLKRSHVLPEGRSPGPPALKHPATKDLAAAAAQGPQLPPPQAQPQPSGTGGGVSGQDRYDRATSSGRLPLPSPALEYTLGSRLANGLGREEAVAEGARRALLGSMPGLMPPGLLAAAVSGLGSRGLTLAPGLSPARPLFGSDFEKEKQQRNADCLAELNEAMRGRAEEWHGRPKAVREQLLALSACAPFNVRFKKDHGLVGRVFAFDATARPPGYEFELKLFTEYPCGSGNVYAGVLAVARQMFHDALREPGKALASSGFKYLEYERRHGSGEWRQLGELLTDGVRSFREPAPAEALPQQYPEPAPAALCGPPPRAPSRNLAPTPRRRKASPEPEGEAAGKMTTEEQQQRHWVAPGGPYSAETPGVPSPIAALKNVAEALGHSPKDPGGGGGPVRAGGASPAASSTAQPPTQHRLVARNGEAEVSPTAGAEAVSGGGSGTGATPGAPLCCTLCRERLEDTHFVQCPSVPGHKFCFPCSREFIKAQGPAGEVYCPSGDKCPLVGSSVPWAFMQGEIATILAGDIKVKKERDP

SEQ ID NO: 4749 - protein, 587 aa, Homo sapiens
MAAAVAVAAASRRQSCYLCDLPRMPWAMIWDFTEPVCRGCVNYEGADRVEFVIETARQLKRAHGCFPEGRSPPGAAASAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAGRLLGFEANGANGSKAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKKERDS

SEQ ID NO: 4750 - protein, 571 aa, Homo sapiens
MAAAVAVAAASRRQSCYLCDLPRMPWAMIWDFTEPVCRGCVNYEGADRVEFVIETARQLKRAHGCFPEGRSPPGAAASAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKKERDS

SEQ ID NO: 4751 - protein, 796 aa, Homo sapiens
MSAAQVSSSRRQSCYLCDLPRMPWAMIWDFSEPVCRGCVNYEGADRIEFVIETARQLKRAHGCFQDGRSPGPPPPVGVKTVALSAKEAAAAAAAAAAAAAAAQQQQQQQQQQQQQQQQQQQQQQQQQLNHVDGSSKPAVLAAPSGLERYGLSAAAAAAAAAAAAVEQRSRFEYPPPPVSLGSSSHTARLPNGLGGPNGFPKPTPEEGPPELNRQSPNSSSAAASVASRRGTHGGLVTGLPNPGGGGGPQLTVPPNLLPQTLLNGPASAAVLPPPPPHALGSRGPPTPAPPGAPGGPACLGGTPGVSATSSSASSSTSSSVAEVGVGAGGKRPGSVSSTDQERELKEKQRNAEALAELSESLRNRAEEWASKPKMVRDTLLTLAGCTPYEVRFKKDHSLLGRVFAFDAVSKPGMDYELKLFIEYPTGSGNVYSSASGVAKQMYQDCMKDFGRGLSSGFKYLEYEKKHGSGDWRLLGDLLPEAVRFFKEGVPGADMLPQPYLDASCPMLPTALVSLSRAPSAPPGTGALPPAAPSGRGAAASLRKRKASPEPPDSAEGALKLGEEQQRQQWMANQSEALKLTMSAGGFAAPGHAAGGPPPPPPPLGPHSNRTTPPESAPQNGPSPMAALMSVADTLGTAHSPKDGSSVHSTTASARRNSSSPVSPASVPGQRRLASRNGDLNLQVAPPPPSAHPGMDQVHPQNIPDSPMANSGPLCCTICHERLEDTHFVQCPSVPSHKFCFPCSRESIKAQGATGEVYCPSGEKCPLVGSNVPWAFMQGEIATILAGDVKVKKERDP

SEQ ID NO: 4752 - protein, 446 aa, Homo sapiens
MSFPHFGHPYRGASQFLASASSSTTCCESTQRSVSDVASGSTPAPALCCAPYDSRLLGSARPELGAALGIYGAPYAAAAAAQSYPGYLPYSPEPPSLYGALNPQYEFKEAAGSFTSSLAQPGAYYPYERTLGQYQYERYGAVELSGAGRRKNATRETTSTLKAWLNEHRKNPYPTKGEKIMLAIITKMTLTQVSTWFANARRRLKKENKMTWAPKNKGGEERKAEGGEEDSLGCLTADTKEVTASQEARGLRLSDLEDLEEEEEEEEEAEDEEVVATAGDRLTEFRKGAQSLPGPCAAAREGRLERRECGLAAPRFSFNDPSGSEEADFLSAETGSPRLTMHYPCLEKPRIWSLAHTATASAVEGAPPARPRPRSPECRMIPGQPPASARRLSVPRDSACDESSCIPKAFGNPKFALQGLPLNCAPCPRRSEPVVQCQYPSGAEAG

SEQ ID NO: 4753 - protein, 359 aa, Homo sapiens
MVDIIFHYPFLGAMGDHSKKKPGTAMCVGCGSQIHDQFILRVSPDLEWHAACLKCAECSQYLDETCTCFVRDGKTYCKRDYVRLFGIKCAKCQVGFSSSDLVMRARDSVYHIECFRCSVCSRQLLPGDEFSLREHELLCRADHGLLLERAAAGSPRSPGPLPGARGLHLPDAGSGRQPALRPHVHKQTEKTTRVRTVLNEKQLHTLRTCYAANPRPDALMKEQLVEMTGLSPRVIRVWFQNKRCKDKKKSILMKQLQQQQHSDKTSLQGLTGTPLVAGSPIRHENAVQGSAVEVQTYQPPWKALSEFALQSDLDQPAFQQLVSFSESGSLGNSSGSDVTSLSSQLPDTPNSMVPSPVET

SEQ ID NO: 4754 - protein, 819 aa, Homo sapiens
MDSEYYSGDQSDDGGATPVQDERDSGSDGEDDVNEQHSGSDTGSVERHSENETSDREDGLPKGHHVTDSENDEPLNLNASDSESEELHRQKDSDSESEERAEPPASDSENEDVNQHGSDSESEETRKLPGSDSENEELLNGHASDSENEDVGKHPASDSEIEELQKSPASDSETEDALKPQISDSESEEPPRHQASDSENEEPPKPRMSDSESEELPKPQVSDSESEEPPRHQASDSENEELPKPRISDSESEDPPRHQASDSENEELPKPRISDSESEDPPRNQASDSENEELPKPRVSDSESEGPQKGPASDSETEDASRHKQKPESDDDSDRENKGEDTEMQNDSFHSDSHMDRKKFHSSDSEEEEHKKQKMDSDEDEKEGEEEKVAKRKAAVLSDSEDEEKASAKKSRVVSDADDSDSDAVSDKSGKREKTIASDSEEEAGKELSDKKNEEKDLFGSDSESGNEEENLIADIFGESGDEEEEEFTGFNQEDLEEEKGETQVKEAEDSDSDDNIKRGKHMDFLSDFEMMLQRKKSMSGKRRRNRDGGTFISDADDVVSAMIVKMNEAAEEDRQLNNQKKPALKKLTLLPAVVMHLKKQDLKETFIDSGVMSAIKEWLSPLPDRSLPALKIREELLKILQELPSVSQETLKHSGIGRAVMYLYKHPKESRSNKDMAGKLINEWSRPIFGLTSNYKGMTREEREQRDLEQMPQRRRMNSTGGQTPRRDLEKVLTGEEKALRPGDPGFCARARVPMPSNKDYVVRPKWNVEMESSRFQATSKKGISRLDKQMRKFTDIRKKSRSAHAVKISIEGNKMPL

SEQ ID NO: 4755 - protein, 772 aa, Homo sapiens
MDSEYYSGDQSDDGGATPVQDERDSGSDGEDDVNEQHSGSDTGSVERHSENETSDREDGLPKGHHVTDSENDSESEETRKLPGSDSENEELLNGHASDSENEDVGKHPASDSEIEELQKSPASDSETEDALKPQISDSESEEPPRHQASDSENEEPPKPRMSDSESEELPKPQVSDSESEEPPRHQASDSENEELPKPRISDSESEDPPRHQASDSENEELPKPRISDSESEDPPRNQASDSENEELPKPRVSDSESEGPQKGPASDSETEDASRHKQKPESDDDSDRENKGEDTEMQNDSFHSDSHMDRKKFHSSDSEEEEHKKQKMDSDEDEKEGEEEKVAKRKAAVLSDSEDEEKASAKKSRVVSDADDSDSDAVSDKSGKREKTIASDSEEEAGKELSDKKNEEKDLFGSDSESGNEEENLIADIFGESGDEEEEEFTGFNQEDLEEEKGETQVKEAEDSDSDDNIKRGKHMDFLSDFEMMLQRKKSMSGKRRRNRDGGTFISDADDVVSAMIVKMNEAAEEDRQLNNQKKPALKKLTLLPAVVMHLKKQDLKETFIDSGVMSAIKEWLSPLPDRSLPALKIREELLKILQELPSVSQETLKHSGIGRAVMYLYKHPKESRSNKDMAGKLINEWSRPIFGLTSNYKGMTREEREQRDLEQMPQRRRMNSTGGQTPRRDLEKVLTGEEKALRPGDPGFCARARVPMPSNKDYVVRPKWNVEMESSRFQATSKKGISRLDKQMRKFTDIRKKSRSAHAVKISIEGNKMPL

SEQ ID NO: 4756 - protein, 503 aa, Homo sapiens
MPARPPACRVRPFPPGLPDDGGATPVQDERDSGSDGEDDVNEQHSGSDTGSVERHSENETSDREDGLPKGHHVTDSENDEPLNLNASDSESEELHRQKDSDSESEERAEPPASDSENEDVNQHGSDSESEETRKLPGSDSENEELLNGHASDSENEDVGKHPASDSEIEELQKSPASDSETEDALKPQISDSESEEPPRHQASDSENEEPPKPRMSDSESEELPKPQVSDSESEEPPRHQASDSENEELPKPRISDSESEDPPRHQASDSENEELPKPRISDSESEDPPRNQASDSENEELPKPRVSDSESEGPQKGPASDSETEDASRHKQKPESDDDSDRENKGEDTEMQNDSFHSDSHMDRKKFHSSDSEEEEHKKQKMDSDEDEKEGEEEKVAKRKAAVLSDSEDEEKASAKKSRVVSDADDSDSDAVSDKSGKREKTIASDSEEEAGKELSDKKNEEKDLFGSDSESGNEEENLIADIFGESGDEEEEEFTYGLSVRF

SEQ ID NO: 4757 - protein, 809 aa, Homo sapiens
MAGAAAAVAAGAAAGAAAAAVSVAAPGRASAPPPPPPVYCVCRQPYDVNRFMIECDICKDWFHGSCVGVEEHHAVDIDLYHCPNCAVLHGSSLMKKRRNWHRHDYTEIDDGSKPVQAGTRTFIKELRSRVFPSADEIIIKMHGSQLTQRYLEKHGFDVPIMVPKLDDLGLRLPSPTFSVMDVERYVGGDKVIDVIDVARQADSKMTLHNYVKYFMNPNRPKVLNVISLEFSDTKMSELVEVPDIAKKLSWVENYWPDDSVFPKPFVQKYCLMGVQDSYTDFHIDFGGTSVWYHVLWGEKIFYLIKPTDENLARYESWSSSVTQSEVFFGDKVDKCYKCVVKQGHTLFVPTGWIHAVLTSQDCMAFGGNFLHNLNIGMQLRCYEMEKRLKTPDLFKFPFFEAICWFVAKNLLETLKELREDGFQPQTYLVQGVKALHTALKLWMKKELVSEHAFEIPDNVRPGHLIKELSKVIRAIEEENGKPVKSQGIPIVCPVSRSSNEATSPYHSRRKMRKLRDHNVRTPSNLDILELHTREVLKRLEMCPWEEDILSSKLNGKFNKHLQPSSTVPEWRAKDNDLRLLLTNGRIIKDERQPFADQSLYTADSENEEDKRRTKKAKMKIEESSGVEGVEHEESQKPLNGFFTRVKSELRSRSSGYSDISESEDSGPECTALKSIFTTEESESSGDEKKQEITSNFKEESNVMRNFLQKSQKPSRSEIPIKRECPTSTSTEEEAIQGMLSMAGLHYSTCLQRQIQSTDCSGERNSLQDPSSCHGSNHEVRQLYRYDKPVECETRSHLCCPDWSPTPELK

SEQ ID NO: 4758 - protein, 941 aa, Homo sapiens
MAGAAAAVAAGAAAGAAAAAVSVAAPGRASAPPPPPPVYCVCRQPYDVNRFMIECDICKDWFHGSCVGVEEHHAVDIDLYHCPNCAVLHGSSLMKKRRNWHRHDYTEIDDGSKPVQAGTRTFIKELRSRVFPSADEIIIKMHGSQLTQRYLEKHGFDVPIMVPKLDDLGLRLPSPTFSVMDVERYVGGDKVIDVIDVARQADSKMTLHNYVKYFMNPNRPKVLNVISLEFSDTKMSELVEVPDIAKKLSWVENYWPDDSVFPKPFVQKYCLMGVQDSYTDFHIDFGGTSVWYHVLWGEKIFYLIKPTDENLARYESWSSSVTQSEVFFGDKVDKCYKCVVKQGHTLFVPTGWIHAVLTSQDCMAFGGNFLHNLNIGMQLRCYEMEKRLKTPDLFKFPFFEAICWFVAKNLLETLKELREDGFQPQTYLVQGVKALHTALKLWMKKELVSEHAFEIPDNVRPGHLIKELSKVIRAIEEENGKPVKSQGIPIVCPVSRSSNEATSPYHSRRKMRKLRDHNVRTPSNLDILELHTREVLKRLEMCPWEEDILSSKLNGKFNKHLQPSSTVPEWRAKDNDLRLLLTNGRIIKDERQPFADQSLYTADSENEEDKRRTKKAKMKIEESSGVEGVEHEESQKPLNGFFTRVKSELRSRSSGYSDISESEDSGPECTALKSIFTTEESESSGDEKKQEITSNFKEESNVMRNFLQKSQKPSRSEIPIKRECPTSTSTEEEAIQGMLSMAGLHYSTCLQRQIQSTDCSGERNSLQDPSSCHGSNHEVRQLYRYDKPVECGYHVKTEDPDLRTSSWIKQFDTSRFHPQDLSRSQKCIRKEGSSEISQRVQSRNYVDSSGSSLQNGKYMQNSNLTSGACQISNGSLSPERPVGETSFSVPLHPTKRPASNPPPISNQATKGKRPKKGMATAKQRLGKILKLNRNGHARFFV

SEQ ID NO: 4759 - protein, 1480 aa, Homo sapiens
MIVMNDQVLEPQNVDPSMVQMTFLDDVVHSLLKGENIGITSRRRSRANQNVNAVHSHYTRAQANSPRPAMNSQAAVPKQNTHQQQQQRSIRPNKRKGSDSSIPDEEKMKEEKYDYISRGENPKGKNKHLMNKRRKPEEDEKKLNMKRLRTDNVSDFSESSDSENSNKRIIDNSSEQKPENELKNKNTSKINGEEGKPHNNEKAGEETLKNSQPPWDQIQEDKKHEEAEKRKSVDTQLQEDMIIHSSEQSTVSDHNSNDLLPQECNMDKTHTMELLPKEKFVSRPPTPKCVIDITNDTNLEKVAQENSSTFGLQTLQKMDPNVSDSKHSIANAKFLETAKKDSDQSWVSDVVKVDLTQSSVTNASSGNDHLNMEKEKYVSYISPLSAVSVMEDKLHKRSPPPETIKSKLNTSVDTHKIKSSPSPEVVKPKITHSPDSVKSKATYVNSQATGERRLANKIEHELSRCSFHPIPTRSSTLETTKSPLIIDKNEHFTVYRDPALIGSETGANHISPFLSQHPFPLHSSSHRTCLNPGTHHPALTPAPHLLAGSSSQTPLPTINTHPLTSGPHHAVHHPHLLPTVLPGVPTASLLGGHPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLRSVASTSAKNDLDLNRSQTGKDCHLHRHFVDPVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSKSVSQPVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNSCHLVKTE

SEQ ID NO: 4760 - protein, 2540 aa, Homo sapiens
MAVETRAELVGKRFLCVAVGDEARSERWESGRGWRSWRAGVIRAVSHRDSRNPDLAVYVEFDDLEWDKREWVKVYEDFSTFLVEYHLIWAKRNDPSQTQGSKSKQIQWPALTFKPLVERNIPSSVTAVEFLVDKQLDFLTEDSAFQPYQDDIDSLNPVLRDNPQLHEEVKVWVKEQKVQEIFMQGPYSLNGYRVRVYRQDSATQWFTGIITHHDLFTRTMIVMNDQVLEPQNVDPSMVQMTFLDDVVHSLLKGENIGITSRRRSRANQNVNAVHSHYTRAQANSPRPAMNSQAAVPKQNTHQQQQQRSIRPNKRKGSDSSIPDEEKMKEEKYDYISRGENPKGKNKHLMNKRRKPEEDEKKLNMKRLRTDNVSDFSESSDSENSNKRIIDNSSEQKPENELKNKNTSKINGEEGKPHNNEKAGEETLKNSQPPWDQIQEDKKHEEAEKRKSVDTQLQEDMIIHSSEQSTVSDHNSNDLLPQECNMDKTHTMELLPKEKFVSRPPTPKCVIDITNDTNLEKVAQENSSTFGLQTLQKMDPNVSDSKHSIANAKFLETAKKDSDQSWVSDVVKVDLTQSSVTNASSGNDHLNMEKEKYVSYISPLSAVSVMEDKLHKRSPPPETIKSKLNTSVDTHKIKSSPSPEVVKPKITHSPDSVKSKATYVNSQATGERRLANKIEHELSRCSFHPIPTRSSTLETTKSPLIIDKNEHFTVYRDPALIGSETGANHISPFLSQHPFPLHSSSHRTCLNPGTHHPALTPAPHLLAGSSSQTPLPTINTHPLTSGPHHAVHHPHLLPTVLPGVPTASLLGGHPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLRSVASTSAKNDLDLNRSQTGKDCHLHRHFVDPVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSKSVSQPVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKISKEQGLEVLPEHDPIRDQSWYVNKKLRQRLLEEYGVRTCTLIQFLGDAIVLPAGALHQVQNFHSCIQVTEDFVSPEHLVESFHLTQELRLLKEEINYDDKLQVKNILYHAVKEMVRALKIHEDEVEDMEEN

SEQ ID NO: 4761 - protein, 2303 aa, Homo sapiens
MIVMNDQVLEPQNVDPSMVQMTFLDDVVHSLLKGENIGITSRRRSRANQNVNAVHSHYTRAQANSPRPAMNSQAAVPKQNTHQQQQQRSIRPNKRKGSDSSIPDEEKMKEEKYDYISRGENPKGKNKHLMNKRRKPEEDEKKLNMKRLRTDNVSDFSESSDSENSNKRIIDNSSEQKPENELKNKNTSKINGEEGKPHNNEKAGEETLKNSQPPWDQIQEDKKHEEAEKRKSVDTQLQEDMIIHSSEQSTVSDHNSNDLLPQECNMDKTHTMELLPKEKFVSRPPTPKCVIDITNDTNLEKVAQENSSTFGLQTLQKMDPNVSDSKHSIANAKFLETAKKDSDQSWVSDVVKVDLTQSSVTNASSGNDHLNMEKEKYVSYISPLSAVSVMEDKLHKRSPPPETIKSKLNTSVDTHKIKSSPSPEVVKPKITHSPDSVKSKATYVNSQATGERRLANKIEHELSRCSFHPIPTRSSTLETTKSPLIIDKNEHFTVYRDPALIGSETGANHISPFLSQHPFPLHSSSHRTCLNPGTHHPALTPAPHLLAGSSSQTPLPTINTHPLTSGPHHAVHHPHLLPTVLPGVPTASLLGGHPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLRSVASTSAKNDLDLNRSQTGKDCHLHRHFVDPVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSKSVSQPVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQSQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKISKEQGLEVLPEHDPIRDQSWYVNKKLRQRLLEEYGVRTCTLIQFLGDAIVLPAGALHQVQNFHSCIQVTEDFVSPEHLVESFHLTQELRLLKEEINYDDKLQVKNILYHAVKEMVRALKIHEDEVEDMEEN

SEQ ID NO: 4762 - protein, 2358 aa, Homo sapiens
MQGPYSLNGYRVRVYRQDSATQWFTGIITHHDLFTRTMIVMNDQVLEPQNVDPSMVQMTFLDDVVHSLLKGENIGITSRRRSRANQNVNAVHSHYTRAQANSPRPAMNSQAAVPKQNTHQQQQQRSIRPNKRKGSDSSIPDEEKMKEEKYDYISRGENPKGKNKHLMNKRRKPEEDEKKLNMKRLRTDNVSDFSESSDSENSNKRIIDNSSEQKPENELKNKNTSKINGEEGKPHNNEKAGEETLKNSQPPWDQIQEDKKHEEAEKRKSVDTQLQEDMIIHSSEQSTVSDHNSNDLLPQECNMDKTHTMELLPKEKFVSRPPTPKCVIDITNDTNLEKVAQENSSTFGLQTLQKMDPNVSDSKHSIANAKFLETAKKDSDQSWVSDVVKVDLTQSSVTNASSGNDHLNMEKEKYVSYISPLSAVSVMEDKLHKRSPPPETIKSKLNTSVDTHKIKSSPSPEVVKPKITHSPDSVKSKATYVNSQATGERRLANKIEHELSRCSFHPIPTRSSTLETTKSPLIIDKNEHFTVYRDPALIGSETGANHISPFLSQHPFPLHSSSHRTCLNPGTHHPALTPAPHLLAGSSSQTPLPTINTHPLTSGPHHAVHHPHLLPTVLPGVPTASLLGGHPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLRSVASTSAKNDLDLNRSQTGKDCHLHRHFVDPVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSKSVSQPVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKISKEQGLEVLPEHDPIRDQSWYVNKKLRQRLLEEYGVRTCTLIQFLGDAIVLPAGALHQVQNFHSCIQVTEDFVSPEHLVESFHLTQELRLLKEEINYDDKLQVKNILYHAVKEMVRALKIHEDEVEDMEEN

SEQ ID NO: 4763 - protein, 1246 aa, Homo sapiens [sequence omitted]

SEQ ID NO: 4764 - protein, 1074 aa, Homo sapiens
MVYFGSSQDEEEVEEEDDETEDVKTATNNASSSCQSTPRKGKTHKHVHNGHVFNGSSRSTREKEPVQKHKSKEATPAKEKHSDHRADSRREQASANHPAAAPSTGSSAKGLAATHHHPPLHRSAQDLRKQVSKVNGVTRMSSLGAGVTSAKKMREVRPSPSKTVKYTATVTKGAVTYTKAKRELVKDTKPNHHKPSSAVNHTISGKTESSNAKTRKQVLSLGGASKSTGPAVNGLKVSGRLNPKSCTKEVGGRQLREGLQLREGLRNSKRRLEEAHQAEKPQSPPKKMKGAAGPAEGPGKKAPAERGLLNGHVKKEVPERSLERNRPKRATAGKSTPGRQAHGKADSASCENRSTSQPESVHKPQDSGKAEKGGGKAGWAAMDEIPVLRPSAKEFHDPLIYIESVRAQVEKFGMCRVIPPPDWRPECKLNDEMRFVTQIQHIHKLGRRWGPNVQRLACIKKHLKSQGITMDELPLIGGCELDLACFFRLINEMGGMQQVTDLKKWNKLADMLRIPRTAQDRLAKLQEAYCQYLLSYDSLSPEEHRRLEKEVLMEKEILEKRKGPLEGHTENDHHKFHPLPRFEPKNGLIHGVAPRNGFRSKLKEVGQAQLKTGRRRLFAQEKEVVKEEEEDKGVLNDFHKCIYKGRSVSLTTFYRTARNIMSMCFSKEPAPAEIEQEYWRLVEEKDCHVAVHCGKVDTNTHGSGFPVGKSEPFSRHGWNLTVLPNNTGSILRHLGAVPGVTIPWLNIGMVFSTSCWSRDQNHLPYIDYLHTGADCIWYCIPAEEENKLEDVVHTLLQANGTPGLQMLESNVMISPEVLCKEGIKVHRTVQQSGQFVVCFPGSFVSKVCCGYSVSETVHFATTQWTSMGFETAKEMKRRHIAKPFSMEKLLYQIAQAEAKKENGPTLSTISALLDELRDTELRQRRQLFEAGLHSSARYGSHDGSSTVADGKKKPRKWLQLETSERRCQICQHLCYLSMVVQENENVVFCLECALRHVEKQKSCRGLKLMYRYDEEQIISLVNQICGKVSGKNGSIENCLSKPTPKRGPRKRATVDVPPSRLSASSSSKSASSSS

SEQ ID NO: 4765 - protein, 507 aa, Homo sapiens
MKRTMHPKCPPLATMLVLQILKKGRRGKGSPALPNSMVYFGSSQDEEEVEEEDDETEDVKTATNNASSSCQSTPRKGKTHKHVHNGHVFNGSSRSTREKEPVQKHKSKEATPAKEKHSDHRADSRREQASANHPAAAPSTGSSAKGLAATHHHPPLHRSAQDLRKQVSKVNGVTRMSSLGAGVTSAKKMREVRPSPSKTVKYTATVTKGAVTYTKAKRELVKDTKPNHHKPSSAVNHTISGKTESSNAKTRKQVLSLGGASKSTGPAVNGLKVSGRLNPKSCTKEVGGRQLREGLQLREGLRNSKRRLEEAHQAEKPQSPPKKMKGAAGPAEGPGKKAPAERGLLNGHVKKEVPERSLERNRPKRATAGKSTPGRQAHGKADSASCENRSTSQPESVHKPQDSGKAEKGGGKAGWAAMDEIPVLRPSAKEFHDPLIYIESVRAQVEKFGMCRVIPPPDWRPECKLNDEMRFVTQIQHIHKLGRRWGPNVQRLACIKKHLKSLGGCGS

SEQ ID NO: 4766 - protein, 960 aa, Homo sapiens
MAAPRVCQVQFLVAYLEEPGIEGLLGNDQSKGLGPASEQSENEKDDASQVSSTSNDVSSSDFEEGPSRKRPRLQAQRKFAQSQPNSPSTTPVKIVEPLLPPPATQISDLSKRKPKTEDFLTFLCLRGSPALPNSMVYFGSSQDEEEVEEEDDETEDVKTATNNASSSCQSTPRKGKTHKHVHNGHVFNGSSRSTREKEPVQKHKSKEATPAKEKHSDHRADSRREQASANHPAAAPSTGSSAKGLAATHHHPPLHRSAQDLRKQVSKVNGVTRMSSLGAGVTSAKKMREVRPSPSKTVKYTATVTKGAVTYTKAKRELVKDTKPNHHKPSSAVNHTISGKTESSNAKTRKQVLSLGGASKSTGPAVNGLKVSGRLNPKSCTKEVGGRQLREGLQLREGLRNSKRRLEEAHQAEKPQSPPKKMKGAAGPAEGPGKKAPAERGLLNGHVKKEVPERSLERNRPKRATAGKSTPGRQAHGKADSASCENRSTSQPESVHKPQDSGKAEKGGGKAGWAAMDEIPVLRPSAKEFHDPLIYIESVRAQVEKFGMCRVIPPPDWRPECKLNDEMRFVTQIQHIHKLGRRWGPNVQRLACIKKHLKSQGITMDELPLIGGCELDLACFFRLINEMGGMQQVTDLKKWNKLADMLRIPRTAQDRLAKLQEAYCQYLLSYDSLSPEEHRRLEKEVLMEKEILEKRKGPLEGHTENDHHKFHPLPRFEPKNGLIHGVAPRNGFRSKLKEVGQAQLKTGRRRLFAQEKEVVKEEEEDKGVLNDFHKCIYKGRSVSLTTFYRTARNIMSMCFSKEPAPAEIEQEYWRLVEEKDCHVAVHCGKVDTNTHGSGFPVGKSEPFSRHGWNLTVLPNNTGSILRHLGAVPGVTIPWLNIGMVFSTSCWSRDQNHLPYIDYLHTGADCICLSVEPVFPHLSVAVGSRVDLGISFLPCGDTRVMYPVESVAWRGVLGPRL

SEQ ID NO: 4767 - protein, 174 aa, Homo sapiens
MVAGWPATPPAMMPGQIPDPSVTTGSLPGLGPLTGLPSSALTVEELKYADIRNLGAMIAPLHFLEVKLGKRPQPVKSELDEEEERRKRRREKNKVAAARCRNKKKERTEFLQRESERLELMNAELKTQIEELKQERQQLILMLNRHRPTCIVRTDSVKTPESEGNPLLEQLEKK

SEQ ID NO: 4768 - protein, 163 aa, Homo sapiens
MMPGQIPDPSVTTGSLPGLGPLTGLPSSALTVEELKYADIRNLGAMIAPLHFLEVKLGKRPQPVKSELDEEEERRKRRREKNKVAAARCRNKKKERTEFLQRESERLELMNAELKTQIEELKQERQQLILMLNRHRPTCIVRTDSVKTPESEGNPLLEQLEKK

SEQ ID NO: 4769 - protein, 163 aa, Homo sapiens; identical to SEQ ID NO: 4768

SEQ ID NO: 4770 - protein, 163 aa, Homo sapiens; identical to SEQ ID NO: 4768

SEQ ID NO: 4771 - protein, 134 aa, Homo sapiens
MMPGQIPDPSVTTGSLPGLGPLTGLPSSALTVEELKYADIRNLGAMIAPLHFLEVKLGKRPQPVKSELDEEEERRKRRREKNKVAAARCRNKKKERTEFLQRESERLELMNAELKTQIEELKQERQQLILMLNR

SEQ ID NO: 4772 - protein, 2004 aa, Homo sapiens
MVKLANPLYTEWILEAIKKVKKQKQRPSEERICNAVSSSHGLDRKTVLEQLELSVKDGTILKVSNKGLNSYKDPDNPGRIALPKPRNHGKLDNKQNVDWNKLIKRAVEGLAESGGSTLKSIERFLKGQKDVSALFGGSAASGFHQQLRLAIKRAIGHGRLLKDGPLYRLNTKATNVDGKESCESLSCLPPVSLLPHEKDKPVAEPIPICSFCLGTKEQNREKKPEELISCADCGNSGHPSCLKFSPELTVRVKALRWQCIECKTCSSCRDQGKNADNMLFCDSCDRGFHMECCDPPLTRMPKGMWICQICRPRKKGRKLLQKKAAQIKRRYTNPIGRPKNRLKKQNTVSKGPFSKVRTGPGRGRKRKITLSSQSASSSSEEGYLERIDGLDFCRDSNVSLKFNKKTKGLIDGLTKFFTPSPDGRKARGEVVDYSEQYRIRKRGNRKSSTSDWPTDNQDGWDGKQENEERLFGSQEIMTEKDMELFRDIQEQALQKVGVTGPPDPQVRCPSVIEFGKYEIHTWYSSPYPQEYSRLPKLYLCEFCLKYMKSRTILQQHMKKCGWFHPPANEIYRKNNISVFEVDGNVSTIYCQNLCLLAKLFLDHKTLYYDVEPFLFYVLTQNDVKGCHLVGYFSKEKHCQQKYNVSCIMILPQYQRKGYGRFLIDFSYLLSKREGQAGSPEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVGKSVSHENKEQDSYSVESEKKPEVMAPVSSTRLSKQVLPHDSLPANSQPSRRGRWGRKNRKTQERFGDKDSKLLLEETSSAPQEQYGECGEKSEATQEQYTESEEQLVASEEQPSQDGKPDLPKRRLSEGVEPWRGQLKKSPEALKCRLTEGSERLPRRYSEGDRAVLRGFSESSEEEEEPESPRSSSPPILTKPTLKRKKPFLHRRRRVRKRKHHNSSVVTETISETTEVLDEPFEDSDSERPMPRLEPTFEIDEEEEEEDENELFPREYFRRLSSQDVLRCQSSSKRKSKDEEEDEESDDADDTPILKPVSLLRKRDVKNSPLEPDTSTPLKKKKGWPKGKSRKPIHWKKRPGRKPGFKLSREIMPVSTQACVIEPIVSIPKAGRKPKIQESEETVEPKEDMPLPEERKEEEEMQAEAEEAEEGEEEDAASSEVPAASPADSSNSPETETKEPEVEEEEEKPRVSEEQRQSEEEQQELEEPEPEEEEDAAAETAQNDDHDADDEDDGHLESTKKKELEEQPTREDVKEEPGVQESFLDANMQKSREKIKDKEETELDSEEEQPSHDTSVVSEQMAGSEDDHEEDSHTKEELIELKEEEEIPHSELDLETVQAVQSLTQEESSEHEGAYQDCEETLAACQTLQSYTQADEDPQMSMVEDCHASEHNSPISSVQSHPSQSVRSVSSPNVPALESGYTQISPEQGSLSAPSMQNMETSPMMDVPSVSDHSQQVVDSGFSDLGSIESTTENYENPSSYDSTMGGSICGNSSSQSSCSYGGLSSSSSLTQSSCVVTQQMASMGSSCSMMQQSSVQPAANCSIKSPQSCVVERPPSNQQQQPPPPPPQQPQPPPPQPQPAPQPPPPQQQPQQQPQPQPQQPPPPPPPQQQPPLSQCSMNNSFTPAPMIMEIPESGSTGNISIYERIPGDFGAGSYSQPSATFSLAKLQQLTNTIMDPHAMPYSHSPAVTSYATSVSLSNTGLAQLAPSHPLAGTPQAQATMTPPPNLASTTMNLTSPLLQCNMSATNIGIPHTQRLQGQMPVKGHISIRSKSAPLPSAAAHQQQLYGRSPSAVAMQAGPRALAVQRGMNMGVNLMPTPAYNVNSMNMNTLNAMNSYRMTQPMMNSSYHSNPAYMNQTAQYPMQMQMGMMGSQAYTQQPMQPNPHGNMMYTGPSHHSYMNAAGVPKQSLNGPYMRR

SEQ ID NO: 4773 - protein, 2004 aa, Homo sapiens; identical to SEQ ID NO: 4772

SEQ ID NO: 4774 - protein, 2004 aa, Homo sapiens; identical to SEQ ID NO: 4772

SEQ ID NO: 4775 - protein, 13 aa, Homo sapiens
MVKLANPLYTEWI

SEQ ID NO: 4776 - protein, 815 aa, Homo sapiens
MVKLANPLYTEWILEAIKKVKKQKQRPSEERICNAVSSSHGLDRKTVLEQLELSVKDGTILKVSNKGLNSYKDPDNPGRIALPKPRNHGKLDNKQNVDWNKLIKRAVEGLAESGGSTLKSIERFLKGQKDVSALFGGSAASGFHQQLRLAIKRAIGHGRLLKDGPLYRLNTKATNVDGKESCESLSCLPPVSLLPHEKDKPVAEPIPICSFCLGTKEQNREKKPEELISCADCGNSGHPSCLKFSPELTVRVKALRWQCIECKTCSSCRDQGKNADNMLFCDSCDRGFHMECCDPPLTRMPKGMWICQICRPRKKGRKLLQKKAAQIKRRYTNPIGRPKNRLKKQNTVSKGPFSKVRTGPGRGRKRKITLSSQSASSSSEEGYLERIDGLDFCRDSNVSLKFNKKTKGLIDGLTKFFTPSPDGRKARGEVVDYSEQYRIRKRGNRKSSTSDWPTDNQDGWDGKQENEERLFGSQEIMTEKDMELFRDIQEQALQKVGVTGPPDPQVRCPSVIEFGKYEIHTWYSSPYPQEYSRLPKLYLCEFCLKYMKSRTILQQHMKKCGWFHPPANEIYRKNNISVFEVDGNVSTIYCQNLCLLAKLFLDHKTLYYDVEPFLFYVLTQNDVKGCHLVGYFSKEKHCQQKYNVSCIMILPQYQRKGYGRFLIDFSYLLSKREGQAGSPEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVRA

SEQ ID NO: 4777 - protein, 611 aa, Homo sapiens
MPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKVRAQSRDKQIEERMLSHRQDDNNRHATRHQAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 4778 - protein, 581 aa, Homo sapiens
MPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 4779 - protein, 425 aa, Homo sapiens
MSLKDSGSDLSHRPKRRRFHESYNFNMKCPTPGCNSLGHLTGKHERHFSISGCPLYHNLSADECKAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 4780 - protein, 472 aa, Homo sapiens
MPRRKRNAGSSSDGTEDSDFSTDLEHTDSSESDGTSRRSARVTRSSARLSQSSQGHLTGKHERHFSISGCPLYHNLSADECKVRAQSRDKQIEERMLSHRQDDNNRHATRHQAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 4781 - protein, 455 aa, Homo sapiens
MSLKDSGSDLSHRPKRRRFHESYNFNMKCPTPGCNSLGHLTGKHERHFSISGCPLYHNLSADECKVRAQSRDKQIEERMLSHRQDDNNRHATRHQAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 4782 - protein, 501 aa, Homo sapiens
MPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRGHLTGKHERHFSISGCPLYHNLSADECKAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 4783 - protein, 442 aa, Homo sapiens
MPRRKRNAGSSSDGTEDSDFSTDLEHTDSSESDGTSRRSARVTRSSARLSQSSQGHLTGKHERHFSISGCPLYHNLSADECKAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 4784 - protein, 458 aa, Homo sapiens
MAAQGAAAAVAAGTSGVAGEGEPGPGENAAAEGTAPSPGRVSPPTPARGEPEVTVEIGETYLCRRPDSTWHSAEVIQSRVNDQEGREEFYVHYVGFNRRLDEWVDKNRLALTKTVKDAVQKNSEKYLSELAEQPERKITRNQKRKHDEINHVQKTYAEMDPTTAALEKEHEAITKVKYVDKIHIGNYEIDAWYFSPFPEDYGKQPKLWLCEYCLKYMKYEKSYRFHLGQCQWRQPPGKEIYRKSNISVYEVDGKDHKIYCQNLCLLAKLFLDHKTLYFDVEPFVFYILTEVDRQGAHIVGYFSKEKESPDGNNVACILTLPPYQRRGYGKFLIAFSYELSKLESTVGSPEKPLSDLGKLSYRSYWSWVLLEILRDFRGTLSIKDLSQMTSITQNDIISTLQSLNMVKYWKGQHVICVTPKLVEEHLKSAQYKKPPITVDSVCLKWAPPKHKQVKLSKK

SEQ ID NO: 4785 - protein, 467 aa, Homo sapiens
MAAQGAAAAVAAGTSGVAGEGEPGPGENAAAEGTAPSPGRVSPPTPARGEPEVTVEIGETYLCRRPDSTWHSAEVIQSRVNDQEGREEFYVHYVGFNRRLDEWVDKNRLALTKTVKDAVQKNSEKYLSELAEQPERKITRNQKRKHDEINHVQKTYAEMDPTTAALEKEHEAITKVKYVDKIHIGNYEIDAWYFSPFPEDYGKQPKLWLCEYCLKYMKYEKSYRFHLGQCQWRQPPGKEIYRKSNISVYEVDGKDHKIYCQNLCLLAKLFLDHKTLYFDVEPFVFYILTEVDRQGAHIVGYFSKEKESPDGNNVACILTLPPYQRRGYGKFLIAFSYELSKLESTVGSPEKPLSDLGKLSYRSYWSWVLLEILRDFRGTLSIKDLSQMTSITQNDIISTLQSLNMVKYWKGQHVICVTPKLVEEHLKSAQYKKPPITGGWGAAVCRGRWGSVSIWTGRSQGLLIAVT

SEQ ID NO: 4786 - protein, 406 aa, Homo sapiens
MADGNEDLRADDLPGPAFESYESMELACPAERSGHVAVSDGRHMFVWGGYKSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSDAWTYCISKNEWIQFNHPYTEKPRLWHTACASDEGEVIVFGGCANNLLVHHRAAHSNEILIFSVQPKSLVRLSLEAVICFKEMLANSWNCLPKHLLHSVNQRFGSNNTSGS

SEQ ID NO: 4787 - protein, 136 aa, Homo sapiens
MVNSCCGSVCSDQGCGLENCCRPSCCQTTCCRTTCCRPSCCVSSCCRPQCCQSVCCQPTCCSPSCCQTTCCRTTCCRPSCCVSSCFRPQCCQSVYCQPTCCRPSCGQTTCCRTTCYRPSCCVSTCCRPTCSSGSCC

SEQ ID NO: 4788 - protein, 253 aa, Homo sapiens
CCHPSCCQTTCCKTACCCRSFLTTAPQTTCCCPSCVVSSCCRPSCSQTTCCQTTCCRPSCCHPVCCQTTCRPSCGVSSCCRPLCCQTTCHPSCGMSSCCRPLCCQTTCRPSCGVSSCCRPLCCQTTCCRATCCRPNCCRPSCCQTTCCRTTCCRPSCCVSSCCRPQCCQSVCCQPTCCSPSCCQTTCCRTTCCRPSCCVSSCFRPQCCQSVYCQPTCCRPSCGQTTCCRTTCYRPSCCVSTCCRPTCSSGSCC

SEQ ID NO: 4789 - protein, 443 aa, Homo sapiens
MQRRDDPAARMSRSSGRSGSMDPSGAHPSVRQTPSRQPPLPHRSRGGGGGSRGGARASPATQPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKFNFVGKILGPQGNTIKRLQEETGAKISVLGKGSMRDKAKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYGYDDTYAEQSYEGYEGYYSQSQGDSEYYDYGHGEVQDSYEAYGQDDWNGTRPSLKAPPARPVKGAYREHPYGRY

SEQ ID NO: 4790 - protein, 419 aa, Homo sapiens
MQRRDDPAARMSRSSGRSGSMDPSGAHPSVRQTPSRQPPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKFNFVGKILGPQGNTIKRLQEETGAKISVLGKGSMRDKAKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYGYDDTYAEQSYEGYEGYYSQSQGDSEYYDYGHGEVQDSYEAYGQDDWNGTRPSLKAPPARPVKGAYREHPYGRY

SEQ ID NO: 4791 - protein, 404 aa, Homo sapiens
MQRRDDPAARMSRSSGRSGSMDPSGAHPSVRQTPSRQPPLPHRSRGGGGGSRGGARASPATQPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYGYDDTYAEQSYEGYEGYYSQSQGDSEYYDYGHGEVQDSYEAYGQDDWNGTRPSLKAPPARPVKGAYREHPYGRY

SEQ ID NO: 4792 - protein, 349 aa, Homo sapiens
MEEEKYLPELMAEKDSLDPSFVHASRLLAEEIEKFQGSDGKKEDEEKKYLDVISNKNIKLSERVLIPVKQYPKFNFVGKLLGPRGNSLKRLQEETGAKMSILGKGSMRDKAKEEELRKSGEAKYAHLSDELHVLIEVFAPPGEAYSRMSHALEEIKKFLVPDYNDEIRQEQLRELSYLNGSEDSGRGRGIRGRGIRIAPTAPSRGRGGAIPPPPPPGRGVLTPRGSTVTRGALPVPPVARGVPTPRARGAPTVPGYRAPPPPAHEAYEEYGYDDGYGGEYDDQTYETYDNSYATQTQSVPEYYDYGHGVSEDAYDSYAPEEWATTRSSLKAPPQRSARGGYREHPYGRY

SEQ ID NO: 4793 - protein, 316 aa, Homo sapiens
MEEEKYLPELMAEKDSLDPSFVHASRLLAEEIEKFQGSDGKKEDEEKKYLDVISNKNIKLSERVLIPVKQYPKFNFVGKLLGPRGNSLKRLQEETGAKMSILGKGSMRDKAKEEELRKSGEAKYAHLSDELHVLIEVFAPPGEAYSRMSHALEEIKKFLVPDYNDEIRQEQLRELSYLNGSEDSGRGRGIRGRGIRIAPTAPSRGRGGAIPPPPPPGRGVLTPRGSTVTRGALPVPPVARGVPTPRARGAPTVPGYRAPPPPAHEAYEEYPSLPLSLFFDTVAKSHQHCDNEVPQTGSTRLNPGRSFFLAWRWEWD

SEQ ID NO: 4794 - protein, 634 aa, Homo sapiens
MASARIGDEYAEDSSDEEDIRNTVGNVPLEWYDDFPHVGYDLDGRRIYKPLRTRDELDQFLDKMDDPDYWRTVQDPMTGRDLRLTDEQVALVRRLQSGQFGDVGFNPYEPAVDFFSGDVMIHPVTNRPADKRSFIPSLVEKEKVSRMVHAIKMGWIQPRRPRDPTPSFYDLWAQEDPNAVLGRHKMHVPAPKLALPGHAESYNPPPEYLLSEEERLAWEQQEPGERKLSFLPRKFPSLRAVPAYGRFIQERFERCLDLYLCPRQRKMRVNVDPEDLIPKLPRPRDLQPFPTCQALVYRGHSDLVRCLSVSPGGQWLVSGSDDGSLRLWEVATARCVRTVPVGGVVKSVAWNPSPAVCLVAAAVEDSVLLLNPALGDRLVAGSTDQLLSAFVPPEEPPLQPARWLEASEEERQVGLRLRICHGKPVTQVTWHGRGDYLAVVLATQGHTQVLIHQLSRRRSQSPFRRSHGQVQRVAFHPARPFLLVASQRSVRLYHLLRQELTKKLMPNCKWVSSLAVHPAGDNVICGSYDSKLVWFDLDLSTKPYRMLRHHKKALRAVAFHPRYPLFASGSDDGSVIVCHGMVYNDLLQNPLLVPVKVLKGHVLTRDLGVLDVIFHPTQPWVFSSGADGTVRLFT

SEQ ID NO: 4795 - protein, 480 aa, Homo sapiens
MLNFGASLQQTAEERMEMISERPKESMYSWNKTAEKSDFEAVEALMSMSCSWKSDFKKYVENRPVTPVSDLSEEENLLPGTPDFHTIPAFCLTPPYSPSDFEPSQVSNLMAPAPSTVHFKSLSDTAKPHIAAPFKEEEKSPVSAPKLPKAQATSVIRHTADAQLCNHQTCPMKAASILNYQNNSFRRRTHLNVEAARKNIPCAAVSPNRSKCERNTVADVDEKASAALYDFSVPSSETVICRSQPAPVSPQQKSVLVSPPAVSAGGVPPMPVICQMVPLPANNPVVTTVVPSTPPSQPPAVCPPVVFMGTQVPKGAVMFVVPQPVVQSSKPPVVSPNGTRLSPIAPAPGFSPSAAKVTPQIDSSRIRSHICSHPGCGKTYFKSSHLKAHTRTHTGEKPFSCSWKGCERRFARSDELSRHRRTHTGEKKFACPMCDRRFMRSDHLTKHARRHLSAKKLPNWQMEVSKLNDIALPPTPAPTQ

SEQ ID NO: 4796 - protein, 469 aa, Homo sapiens
MEERMEMISERPKESMYSWNKTAEKSDFEAVEALMSMSCSWKSDFKKYVENRPVTPVSDLSEEENLLPGTPDFHTIPAFCLTPPYSPSDFEPSQVSNLMAPAPSTVHFKSLSDTAKPHIAAPFKEEEKSPVSAPKLPKAQATSVIRHTADAQLCNHQTCPMKAASILNYQNNSFRRRTHLNVEAARKNIPCAAVSPNRSKCERNTVADVDEKASAALYDFSVPSSETVICRSQPAPVSPQQKSVLVSPPAVSAGGVPPMPVICQMVPLPANNPVVTTVVPSTPPSQPPAVCPPVVFMGTQVPKGAVMFVVPQPVVQSSKPPVVSPNGTRLSPIAPAPGFSPSAAKVTPQIDSSRIRSHICSHPGCGKTYFKSSHLKAHTRTHTGEKPFSCSWKGCERRFARSDELSRHRRTHTGEKKFACPMCDRRFMRSDHLTKHARRHLSAKKLPNWQMEVSKLNDIALPPTPAPTQ

SEQ ID NO: 4797 - protein, 323 aa, Homo sapiens
MSAAVACLDYFAAECLVSMSAGAVVHRRPPDPEGAGGAAGSEVGAAHPESALPGPGPSGPASVPQLPQVPAPSPGAGGAAPHLLAASVWADLRGSSGEGSWENSGEAPRASSGFSDPIPCSVQTPCSELAPASGAAAVCAPESSSDAPAVPSAPAAPGAPAASGGFSGGALGAGPAPAADQAPRRRSVTPAAKRHQCPFPGCTKAYYKSSHLKSHQRTHTGERPFSCDWLDCDKKFTRSDELARHYRTHTGEKRFSCPLCPKQFSRSDHLTKHARRHPTYHPDMIEYRGRRRTPRIDPPLTSEVESSASGSGPGPAPSFTTCL

SEQ ID NO: 4798 - protein, 252 aa, Homo sapiens
MSAAVACVDYFAADVLMAISSGAVVHRGRPGPEGAGPAAGLDVRAARREAASPGTPGPPPPPPAASGPGPGAAAAPHLLAASILADLRGGPGAAPGGASPASSSSAASSPSSGRAPGAAPSAAAKSHRCPFPDCAKAYYKSSHLKSHLRTHTGERPFACDWQGCDKKFARSDELARHHRTHTGEKRFSCPLCSKRFTRSDHLAKHARRHPGFHPDLLRRPGARSTSPSDSLPCSLAGSPAPSPAPSPAPAGL

SEQ ID NO: 4799 - protein, 252 aa, Homo sapiens; identical to SEQ ID NO: 4798

SEQ ID NO: 4800 - protein, 389 aa, Homo sapiens
MYGRPQAEMEQEAGELSRWQAAHQAAQDNENSAPILNMSSSSGSSGVHTSWNQGLPSIQHFPHSAEMLGSPLVSVEAPGQNVNEGGPQFSMPLPERGMSYCPQATLTPSRMIYCQRMSPPQQEMTIFSGPQLMPVGEPNIPRVARPFGGNLRMPPNGLPVSASTGIPIMSHTGNPPVPYPGLSTVPSDETLLGPTVPSTEAQAVLPSMAQMLPPQDAHDLGMPPAESQSLLVLGSQDSLVSQPDSQEGPFLPEQPGPAPQTVEKNSRPQEGTGRRGSSEARPYCCNYENCGKAYTKRSHLVSHQRKHTGERPYSCNWESCSWSFFRSDELRRHMRVHTRYRPYKCDQCSREFMRSDHLKQHQKTHRPGPSDPQANNNNGEQDSPPAAGP

SEQ ID NO: 4801 - protein, 345 aa, Homo sapiens
MLMFDPVPVKQEAMDPVSVSYPSNYMESMKPNKYGVIYSTPLPEKFFQTPEGLSHGIQMEPVDLTVNKRSSPPSAGNSPSSLKFPSSHRRASPGLSMPSSSPPIKKYSPPSPGVQPFGVPLSMPPVMAAALSRHGIRSPGILPVIQPVVVQPVPFMYTSHLQQPLMVSLSEEMENSSSSMQVPVIESYEKPISQKKIKIEPGIEPQRTDYYPEEMSPPLMNSVSPPQALLQENHPSVIVQPGKRPLPVESPDTQRKRRIHRCDYDGCNKVYTKSSHLKAHRRTHTGEKPYKCTWEGCTWKFARSDELTRHFRKHTGIKPFQCPDCDRSFSRSDHLALHRKRHMLV

SEQ ID NO: 4802 - protein, 457 aa, Homo sapiens
MATRVLSMSARLGPVPQPPAPQDEPVFAQLKPVLGAANPARDAALFPGEELKHAHHRPQAQPAPAQAPQPAQPPATGPRLPPEDLVQTRCEMEKYLTPQLPPVPIIPEHKKYRRDSASVVDQFFTDTEGLPYSINMNVFLPDITHLRTGLYKSQRPCVTHIKTEPVAIFSHQSETTAPPPAPTQALPEFTSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYNRRSNPDLEKRRIHYCDYPGCTKVYTKSSHLKAHLRTHTGEKPYKCTWEGCDWRFARSDELTRHYRKHTGAKPFQCGVCNRSFSRSDHLALHMKRHQN

SEQ ID NO: 4803 - protein, 366 aa, Homo sapiens
MEKYLTPQLPPVPIIPEHKKYRRDSASVVDQFFTDTEGLPYSINMNVFLPDITHLRTGLYKSQRPCVTHIKTEPVAIFSHQSETTAPPPAPTQALPEFTSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYNRRSNPDLEKRRIHYCDYPGCTKVYTKSSHLKAHLRTHTGEKPYKCTWEGCDWRFARSDELTRHYRKHTGAKPFQCGVCNRSFSRSDHLALHMKRHQN

SEQ ID NO: 4804 - protein, 437 aa, Homo sapiens
MATRVLSMSARLGPVPQPPAPQDEPVFAQLKPVLGAANPARDAALFPGEELKHAHHRPRLPPEDLVQTRCEMEKYLTPQLPPVPIIPEHKKYRRDSASVVDQFFTDTEGLPYSINMNVFLPDITHLRTGLYKSQRPCVTHIKTEPVAIFSHQSETTAPPPAPTQALPEFTSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYNRRSNPDLEKRRIHYCDYPGCTKVYTKSSHLKAHLRTHTGEKPYKCTWEGCDWRFARSDELTRHYRKHTGAKPFQCGVCNRSFSRSDHLALHMKRHQN

SEQ ID NO: 4805 - protein, 244 aa, Homo sapiens
MSAAAYMDFVAAQCLVSISNRAAVPEHGVAPDAERLRLPEREVTKEHGDPGDTWKDYCTLVTIAKSLLDLNKYRPIQTPSVCSDSLESPDEDMGSDSDVTTESGSSPSHSPEERQDPGSAPSPLSLLHPGVAAKGKHASEKRHKCPYSGCGKVYGKSSHLKAHYRVHTGERPFPCTWPDCLKKFSRSDELTRHYRTHTGEKQFRCPLCEKRFMRSDHLTKHARRHTEFHPSMIKRSKKALANAL

SEQ ID NO: 4806 - protein, 780 aa, Homo sapiens
MTESASSTSGQEFDVFSVMDWKDGVGTLPGSDLKFRVNEFGALEVITDENEMENVKKATATTTWMVPTAQEAPTSPPSSRPVFPPAYWTSPPGCPTVFSEKTGMPFRLKDPVKVEGLQFCENCCQYGNVDECLSGGNYCSQNCARHIKDKDQKEERDVEEDNEEEDPKCSRKKKPKLSLKADTKEDGEERDDEMENKQDVRILRGSQRARRKRRGDSAVLKQGLPPKGKKAWCWASYLEEEKAVAVPAKLFKEHQSFPYNKNGFKVGMKLEGVDPEHQSVYCVLTVAEVCGYRIKLHFDGYSDCYDFWVNADALDIHPVGWCEKTGHKLHPPKGYKEEEFNWQTYLKTCKAQAAPKSLFENQNITVIPSGFRVGMKLEAVDKKNPSFICVATVTDMVDNRFLVHFDNWDESYDYWCEASSPHIHPVGWCKEHRRTLITPPGYPNVKHFSWDKYLEETNSLPAPARAFKVKPPHGFQKKMKLEVVDKRNPMFIRVATVADTDDHRVKVHFDGWNNCYDYWIDADSPDIHPVGWCSKTGHPLQPPLSPLELMEASEHGGCSTPGCKGIGHFKRARHLGPHSAANCPYSEINLNKDRIFPDRLSGEMPPASPSFPRNKRTDANESSSSPEIRDQHADDVKEDFEERTESEMRTSHEARGAREEPTVQQAQRRSAVFLSFKSPIPCLPLRWEQQSKLLPTVAGIPASKVSKWSTDEVSEFIQSLPGCEEHGKVFKDEQIDGEAFLLMTQTDIVKIMSIKLGPALKIFNSILMFKAAEKNSHNEL

SEQ ID NO: 4807 - protein, 780 aa, Homo sapiens; identical to SEQ ID NO: 4806

SEQ ID NO: 4808 - protein, 755 aa, Homo sapiens
MTESASSTSGQEFDVFSVMDWKDGVGTLPGSDLKFRVNEFGALEVITDENEMENVKKATATTTWMVPTAQEVFSEKTGMPFRLKDPVKVEGLQFCENCCQYGNVDECLSGGNYCSQNCARHIKDKDQKEERDVEEDNEEEDPKCSRKKKPKLSLKADTKEDGEERDDEMENKQDVRILRGSQRARRKRRGDSAVLKQGLPPKGKKAWCWASYLEEEKAVAVPAKLFKEHQSFPYNKNGFKVGMKLEGVDPEHQSVYCVLTVAEVCGYRIKLHFDGYSDCYDFWVNADALDIHPVGWCEKTGHKLHPPKGYKEEEFNWQTYLKTCKAQAAPKSLFENQNITVIPSGFRVGMKLEAVDKKNPSFICVATVTDMVDNRFLVHFDNWDESYDYWCEASSPHIHPVGWCKEHRRTLITPPGYPNVKHFSWDKYLEETNSLPAPARAFKVKPPHGFQKKMKLEVVDKRNPMFIRVATVADTDDHRVKVHFDGWNNCYDYWIDADSPDIHPVGWCSKTGHPLQPPLSPLELMEASEHGGCSTPGCKGIGHFKRARHLGPHSAANCPYSEINLNKDRIFPDRLSGEMPPASPSFPRNKRTDANESSSSPEIRDQHADDVKEDFEERTESEMRTSHEARGAREEPTVQQAQRRSAVFLSFKSPIPCLPLRWEQQSKLLPTVAGIPASKVSKWSTDEVSEFIQSLPGCEEHGKVFKDEQIDGEAFLLMTQTDIVKIMSIKLGPALKIFNSILMFKAAEKNSHNEL

SEQ ID NO: 4809 - protein, 755 aa, Homo sapiens; identical to SEQ ID NO: 4808

SEQ ID NO: 4810 - protein, 190 aa, Homo sapiens
MTESASSTSGQEFDVFSVMDWKDGVGTLPGSDLKFRVNEFGALEVITDENEMENVKKATATTTWMVPTAQEAPTSPPSSRPVFPPAYWTSPPGCPTVFSEKTGMPFRLKDPVKVEGLQFCENCCQYGNVDECLSGGNYCSQNCARHIKDKDQKEERDVEEDNEEEDPKCSRKKKPKLSLKADTKEDGEER

SEQ ID NO: 4811 - protein, 780 aa, Homo sapiens; identical to SEQ ID NO: 4806

SEQ ID NO: 4812 - protein, 755 aa, Homo sapiens; identical to SEQ ID NO: 4808

SEQ ID NO: 4813 - protein, 623 aa, Homo sapiens
MKQPNRKRKLNMDSKERLDQDGRLEQAEEEKKPKDSTTPLSHVPSAAAQGAWSWEWYLKEQKAVAAPVELFSKDQSFPEHENGFQIGMRLEGIDPRHPSVFCVLSVAEVCGYRLRLHFDGYLSCYDFWTNAGSPDIHPVGWCEKTKHELHIPKGYRKDKFVWMDYLKACKLQNAPKKLFRNRSPNGPMSKEFQVGMKLEAVDRKNPSLVCVATIADIVEDRLLVHFDNWDDSYDYWCDVNSPYVQPVGWCQENGRTLIAPQGYPNPENFSWTEYLEATQTNAVPAKVFKMRLPHGFLPNMKLEVVDKRNPRLIRVATIVDVDDQRVKVHFDGWDHKYDYWVEADSPDIHPIGWCDVTGHPLEVPQRTNDLKILPGQAVCPTPGCRGIGHIRGPRYSGHHSAFGCPYSDMNLKKEATLHDRLREQTQANLESDSSHSKSKSLCSLNFNGKHEKVNSQPRLVQQAKCLKIKGKEDIDLDNLFRVLVLHPRGLEYSVEQAQQVLHQSVSMSTVSAHPFRDLPLGREQHCKLLPGVADIRASQVARWTVDEVAEFVQSLLGCEEHAKCFKKEQIDGKAFLLLTQTDIVKVMKIKLGPALKIYNSILMFRHSQELPEEDIASGQEVRG

SEQ ID NO: 4814 - protein, 623 aa, Homo sapiens; identical to SEQ ID NO: 4813

SEQ ID NO: 4815 - protein, 427 aa, Homo sapiens
MSKEFQVGMKLEAVDRKNPSLVCVATIADIVEDRLLVHFDNWDDSYDYWCDVNSPYVQPVGWCQENGRTLIAPQGYPNPENFSWTEYLEATQTNAVPAKVFKMRLPHGFLPNMKLEVVDKRNPRLIRVATIVDVDDQRVKVHFDGWDHKYDYWVEADSPDIHPIGWCDVTGHPLEVPQRTNDLKILPGQAVCPTPGCRGIGHIRGPRYSGHHSAFGCPYSDMNLKKEATLHDRLREQTQANLESDSSHSKSKSLCSLNFNGKHEKVNSQPRLVQQAKCLKIKGKEDIDLDNLFREYSVEQAQQVLHQSVSMSTVSAHPFRDLPLGREQHCKLLPGVADIRASQVARWTVDEVAEFVQSLLGCEEHAKCFKKEQIDGKAFLLLTQTDIVKVMKIKLGPALKIYNSILMFRHSQELPEEDIASGQEVRG

SEQ ID NO: 4816 - protein, 291 aa, Homo sapiens
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTGGCAGCFSG

SEQ ID NO: 4817 - protein, 675 aa, Homo sapiens
MSWESGAGPGLGSQGMDLVWSAWYGKCVKGKGSLPLSAHGIVVAWLSRAEWDQVTVYLFCDDHKLQRYALNRITVWRSRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEENVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 4818 - protein, 717 aa, Homo sapiens
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEENVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 4819 - protein, 734 aa, Homo sapiens
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEDGQTEVQRGEGTDPKSHKNVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 4820 - protein, 168 aa, Homo sapiens
MSLTHRLHLCKYWGCAVSNVCRFWEGRPLPLMIVVPYTLPVSLPVGSCVIITGTPILTFVKDPQLEVNFYTGMDEDSDIAFQFRLHFGHPAIMNSCVFGIWRYEEKCYYLPFEDGKPFELCIYVRHKEYKVMVNGQRIYNFAHRFPPASVKMLQVFRDISLTRVLISD

SEQ ID NO: 4821 - protein, 139 aa, Homo sapiens
MSSLPVPYTLPVSLPVGSCVIITGTPILTFVKDPQLEVNFYTGMDEDSDIAFQFRLHFGHPAIMNSCVFGIWRYEEKCYYLPFEDGKPFELCIYVRHKEYKVMVNGQRIYNFAHRFPPASVKMLQVFRDISLTRVLISD

SEQ ID NO: 4822 - protein, 437 aa, Homo sapiens
MARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFKANRLEKAVAAAYTFLQRNPKHELTAKYLNYYQGMLDVADESLTDLEAQPYEAVFLRAVKLYNSGDFRSSTEDMERALSEYLAVFARCLAGCEGAHEQVDFKDFYPAIADLFAESLQCKVDCEANLTPNVGGYFVDKFVATMYHYLQFAYYKLNDVRQAARSAASYMLFDPKDSVMQQNLVYYRFHRARWGLEEEDFQPREEAMLYHNQTAELRELLEFTHMYLQSDDEMELEETEPPLEPEDALSDAEFEGEGDYEEGMYADWWQEPDAKGDEAEAEPEPELA

SEQ ID NO: 4823 - protein, 437 aa, Homo sapiens; identical to SEQ ID NO: 4822

SEQ ID NO: 4824 - protein, 426 aa, Homo sapiens
MARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAAFQVPYPPRQLLRDFQSRLPYQYLHYALFKANRLEKAVAAAYTFLQRNPKHELTAKYLNYYQGMLDVADESLTDLEAQPYEAVFLRAVKLYNSGDFRSSTEDMERALSEYLAVFARCLAGCEGAHEQVDFKDFYPAIADLFAESLQCKVDCEANLTPNVGGYFVDKFVATMYHYLQFAYYKLNDVRQAARSAASYMLFDPKDSVMQQNLVYYRFHRARWGLEEEDFQPREEAMLYHNQTAELRELLEFTHMYLQSDDEMELEETEPPLEPEDALSDAEFEGEGDYEEGMYADWWQEPDAKGDEAEAEPEPELA

SEQ ID NO: 4825 - protein, 313 aa, Homo sapiens
MASFRKLTLSEKVPPNHPSRKKVNFLDMSLDDIIIYKELEGTNAEEEKNKRQNHSKKESPSRQQSKAHRHRHRRGYSRCRSNSEEGNHDKKPSQKPSGFKSGQHPLNGQPLIEQEKCSDNYEAQAEKNQGQSEGNQHQSEGNPDKSEESQGQPEENHHSERSRNHLERSLSQSDRSQGQLKRHHPQYERSHGQYKRSHGQSERSHGHSERSHGHSERSHGHSERSHGHSKRSRSQGDLVDTQSDLIATQRDLIATQKDLIATQRDLIATQRDLIVTQRDLVATERDLINQSGRSHGQSERHQRYSTGKNTITT

SEQ ID NO: 4826 - protein, 78 aa, Homo sapiens
MASFRKLTLSEKVPPNHPSRKKVNFLDMSLDDIIIYKELEGTNAEEEKNKRQNHSKKESPSRQQSKAHRHRHRRGEVQ

SEQ ID NO: 4827 - protein, 231 aa, Homo sapiens
MLKKKRIKDRTIVKRNRLQDSNQKLIDIAIGEEKCSDNYEAQAEKNQGQSEGNQHQSEGNPDKSEESQGQPEENHHSERSRNHLERSLSQSDRSQGQLKRHHPQYERSHGQYKRSHGQSERSHGHSERSHGHSERSHGHSERSHGHSKRSRSQGDLVDTQSDLIATQRDLIATQKDLIATQRDLIATQRDLIVTQRDLVATERDLINQSGRSHGQSERHQRYSTGKNTITT

SEQ ID NO: 4828 - protein, 647 aa, Homo sapiens
MGPLSARLLMQRGRPKSDRLGKIRSLDLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEKFMATLGPEEEAEKAQADFVKSAVRDVRYGPESLSEFTQWRVRMISEELVAASRTQVQKANSPEKPPEAGAAHKPRARLAALKRPDDVPLSLSPSKRACASPSAQVEGSPVAGSDGSQPAVKLEPLHFLQCHSKNNSPQDLETQLWACAFEPAWEEGATSQTVATCGGEAVCVIDCQTGIVLHKYKAPGEEFFSVAWTALMVVTQAGHKKRWSVLAAAGLRGLVRLLHVRAGFCCGVIRAHKKAIATLCFSPAHETHLFTASYDKRIILWDIGVPNQDYEFQASQLLTLDTTSIPLRLCPVASCPDARLLAGCEGGCCCWDVRLDQPQKRRVCEVEFVFSEGSEASGRRVDGLAFVNEDIVASKGSGLGTICLWSWRQTWGGRGSQSTVAVVVLARLQWSSTELAYFSLSACPDKGIVLCGDEEGNVWLYDVSNILKQPPLLPAALQAPTQILKWPQPWALGQVVTKTMVNTVVANASFTYLTALTDSNIVAIWGRM

SEQ ID NO: 4829 - protein, 769 aa, Homo sapiens
MSNNLRRVFLKPAEENSGNASRCVSGCMYQVVQTIGSDGKNLLQLLPIPKSSGNLIPLVQSSVMSDALKGNTGKPVQVTFQTQISSSSTSASVQLPIFQPASSSNYFLTRTVDTSEKGRVTSVGTGNFSSSVSKVQSHGVKIDGLTMQTFAVPPSTQKDSSFIVVNTQSLPVTVKSPVLPSGHHLQIPAHAEVKSVPASSLPPSVQQKILATATTSTSGMVEASQMPTVIYVSPVNTVKNVVTKNFQNIYPKPVTEIAKPVILNTTQIPKNVATETQLKGGQHSQAAPVKWIFQDNLQPFTPSLVPVKSSNNVASKILKTFVDRKNLGDNTINMPPLSTIDPSGTRSKNMPIKDNALVMFNGKVYLLAKKGTDVLPSQIDQQNSVSPDTPVRKDTLQTVSSSPVTEISREVVNIVLAKSKSSQMETKSLSNTQLASMANLRAEKNKVEKPSPSTTNPHMNQSSNYLKQSKTLFTNPIFPVGFSTGHNAPRKVTAVIYARKGSVLQSIEKISSSVDATTVTSQQCVFRDQEPKIHNEMASTSDKGAQGRNDKKDSQGRSNKALHLKSDAEFKKIFGLTKDLRVCLTRIPDHLTSGEGFDSFSSLVKSGTYKETEFMVKEGERKQQNFDKKRKAKTNKKMDHIKKRKTENAYNAIINGEANVTGSQLLSSILPTSDVSQHNILTSHSKTRQEKRTEMEYYTHEKQEKGTLNSNAAYEQSHFFNKNYTEDIFPVTPPELEETIRDEKIRRLKQVLREKEAALEEMRKKMHQK

SEQ ID NO: 4830 - protein, 233 aa, Homo sapiens
MASTSDKGAQGRNDKKDSQGRSNKALHLKSDAEFKKIFGLTKDLRVCLTRIPDHLTSGEGFDSFSSLVKSGTYKETEFMVKEGERKQQNFDKKRKAKTNKKMDHIKKRKTENAYNAIINGEANVTGSQLLSSILPTSDVSQHNILTSHSKTRQEKRTEMEYYTHEKQEKGTLNSNAAYEQSHFFNKNYTEDIFPVTPPELEETIRDEKIRRLKQVLREKEAALEEMRKKMHQK

SEQ ID NO: 4831 - protein, 233 aa, Homo sapiens; identical to SEQ ID NO: 4830

SEQ ID NO: 4832 - protein, 377 aa, Homo sapiens
MYWKHENAAPALPEGCRLPAEGGPATDQVMAQPGSGCKATTRCLEGTAPPAMAQSDAEALAGALDKDEGQASPCTPSTPSVCSPPSAASSVPSAGKNICSSCGLEILDRYLLKVNNLIWHVRCLECSVCRTSLRQQNSCYIKNKEIFCKMDYFSRFGTKCARCGRQIYASDWVRRARGNAYHLACFACFSCKRQLSTGEEFGLVEEKVLCRIHYDTMIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESHPFSVLTLPALPHLPVGAPQLPLSR

SEQ ID NO: 4833 - protein, 363 aa, Homo sapiens
MAQPGSGCKATTRCLEGTAPPAMAQSDAEALAGALDKDEGQASPCTPSTPSVCSPPSAASSVPSAGKNICSSCGLEILDRYLLKVNNLIWHVRCLECSVCRTSLRQQNSCYIKNKEIFCKMDYFSRFGTKCARCGRQIYASDWVRRARGNAYHLACFACFSCKRQLSTGEEFGLVEEKVLCRIHYDTMIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESQVQCGQVHCRLPYTAPPVHLKADMDGPLSNRGEKVILFQY

SEQ ID NO: 4834 - protein, 392 aa, Homo sapiens
MYWKHENAAPALPEGCRLPAEGGPATDQVMAQPGSGCKATTRCLEGTAPPAMAQSDAEALAGALDKDEGQASPCTPSTPSVCSPPSAASSVPSAGKNICSSCGLEILDRYLLKVNNLIWHVRCLECSVCRTSLRQQNSCYIKNKEIFCKMDYFSRFGTKCARCGRQIYASDWVRRARGNAYHLACFACFSCKRQLSTGEEFGLVEEKVLCRIHYDTMIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESQVQCGQVHCRLPYTAPPVHLKADMDGPLSNRGEKVILFQY

SEQ ID NO: 4835 - protein, 366 aa, Homo sapiens
MRRGLCRRSAENPDAGPVMAQPGSGCKATTRCLEGTAPPAMAQSDAEALAGALDKDEGQASPCTPSTPSVCSPPSAASSVPSAGKNICSSCGLEILDRYLLKVNNLIWHVRCLECSVCRTSLRQQNSCYIKNKEIFCKMDYFSRFGTKCARCGRQIYASDWVRRARGNAYHLACFACFSCKRQLSTGEEFGLVEEKVLCRIHYDTMIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESHPFSVLTLPALPHLPVGAPQLPLSR

SEQ ID NO: 4836 - protein, 21 aa, Homo sapiens
MAQPGSGCKATTRCLEGTAPP

SEQ ID NO: 4837 - protein, 34 aa, Homo sapiens
MAQPGSGCKATTRCLEGTAPPAMAQSDAEALAGA

SEQ ID NO: 4838 - protein, 176 aa, Homo sapiens
MIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESQVQCGQVHCRLPYTAPPVHLKADMDGPLSNRGEKVILFQY

SEQ ID NO: 4839 - protein, 123 aa, Homo sapiens
MAVSHSVKERTISENSLIILLQGLQGRVTTVDLRDESVAHGRIDNVDAFMNIRLAKVTYTDRWGHQVKLDDLFVTGRNVRYVHIPDDVNITSTIEQQLQIIHRVRNFGGKGQGRWEFPPKNCK

SEQ ID NO: 4840 - protein, 360 aa, Homo sapiens
MEERERGARSAGAGSPARPPSPRLDVSSDSFDPLLALYAPRLPPIPYPNAPCFNNVAEYESFLRTGVRGGGRGRGRARGAAAGSGVPAAPGPSGRTRRRPDAPAPDPERIQRLRRLMVAKEEGDGAAGAGRRGPGRSRKAPRNVLTRMPLHEGSPLGELHRCIREGVKVNVHIRTFKGLRGVCTGFLVAFDKFWNMALTDVDETYRKPVLGKAYERDSSLTLTRLFDRLKLQDSSKKEADSKSAVEDSTLSRYSQTSTWKLASVWGRADTGRGSHKRSRSVPSSLQASAREESRSELSGRTTRTDGSSVGGTFSRATTLSRGQSRKKKRKPKVDYQQVFTRHINQIFIRGENVLLVHLAQ

SEQ ID NO: 4841 - protein, 379 aa, Homo sapiens
MVFFTCNACGESVKKIQVEKHVSVCRNCECLSCIDCGKDFWGDDYKNHVKCISEDQKYGGKGYEGKTHKGDIKQQAWIQKISELIKRPNVSPKVRELLEQISAFDNVPRKKAKFQNWMKNSLKVHNESILDQVWNIFSEASNSEPVNKEQDQRPLHPVANPHAEISTKVPASKVKDAVEQQGEVKKNKRERKEERQKKRKREKKELKLENHQENSRNQKPKKRKKGQEADLEAGGEEVPEANGSAGKRSKKKKQRKDSASEEEAHVGAGKRKRRHSEVETDSKKKKMKLPEHPEGGEPEDDEAPAKGKFNWKGTIKAILKQAPDNEITIKKLRKKVLAQYYTVTDEHHRSEEELLVIFNKKISKNPTFKLLKDKVKLVK

SEQ ID NO: 4842 - protein, 379 aa, Homo sapiens; identical to SEQ ID NO: 4841

SEQ ID NO: 4843 - protein, 79 aa, Homo sapiens
MVFFTCNACGESVKKIQVEKHVSVCRNCECLSCIDCGKDFWGDDYKNHVKCISEDQKYGGKGYEGKTHKGDIKQQAWIQ

SEQ ID NO: 4844 - protein, 620 aa, Homo sapiens
MKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 4845 - protein, 782 aa, Homo sapiens
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVLRQETLDKN

SEQ ID NO: 4846 - protein, 420 aa, Homo sapiens
MCSGRFQNIQVNPDFPRGRISNSFRRTSSTENKTKTLGKLHQEPRQLQSDGKRKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLHGQVLVVSSARLSSITLSRLAQEGPAAPGVPDPCRSHWCC

SEQ ID NO: 4847 - protein, 1162 aa, Homo sapiens
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 4848 - protein, 723 aa, Homo sapiens
MCSGRFQNIQVNPDFPRGRISNSFRRTSSTENKTKTLGKLHQEPRQLQSDGKRKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 4849 - protein, 1306 aa, Homo sapiens
MAGPQMGGSAEDHPPRKRHAAEKQKKKTVIYTKCFEFESATQRPIDRQRYDENEDLSDVEEIVSVRGFSLEEKLRSQLYQGDFVHAMEGKDFNYEYVQREALRVPLIFREKDGLGIKMPDPDFTVRDVKLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHLTEFELKGLKALVEKLESLPENKKCVPEGIEDPQALLEGVKNVLKEHADDDPSLAITGVPVVTWPKKTPKNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKAYKQKRGPGFKYASNLPGSLLKEQKMNRDNKEGQEPAKRRSECEEAPRRRSDEHSKKVPPDGLLRRKSDDVHLRKKRKYEKPQELSGRKRASSLQTSPGSSSHLSPRPPLGSSLSPWWRSSLTYFQQQLKPGKEDKLFRKKRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGQMDNRSKLRNIVELRLAGLDITDASLRLIIRHMPLLSKLHLSYCNHVTDQSINLLTAVGTTTRDSLTEINLSGFFVGRVFGLQFWGICEPQARKNAGWA

SEQ ID NO: 4850 - protein, 1265 aa, Homo sapiens
MEAEKDSGRRLRPIDRQRYDENEDLSDVEEIVSVRGFSLEEKLRSQLYQGDFVHAMEGKDFNYEYVQREALRVPLIFREKDGLGIKMPDPDFTVRDVKLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHLTEFELKGLKALVEKLESLPENKKCVPEGIEDPQALLEGVKNVLKEHADDDPSLAITGVPVVTWPKKTPKNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKQKRGPGFKYASNLPGSLLKEQKMNRDNKEGQEPAKRRSECEEAPRRRSDEHSKKVPPDGLLRRKSDDVHLRKKRKYEKPQELSGRKRLKPGKEDKLFRKKRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGQMDNRSKLRNIVELRLAGLDITDASLRLIIRHMPLLSKLHLSYCNHVTDQSINLLTAVGTTTRDSLTEINLSDCNKVTDQCLSFFKRCGNICHIDLRYCKQVTKEGCEQFIAEMSSFQGRSCSTTRLGDE

SEQ ID NO: 4851 - protein, 1336 aa, Homo sapiens
MAGPQMGGSAEDHPPRKRHAAEKQKKKTVIYTKCFEFESATQRPIDRQRYDENEDLSDVEEIVSVRGFSLEEKLRSQLYQGDFVHAMEGKDFNYEYVQREALRVPLIFREKDGLGIKMPDPDFTVRDVKLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHLTEFELKGLKALVEKLESLPENKKCVPEGIEDPQALLEGVKNVLKEHADDDPSLAITGVPVVTWPKKTPKNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKQKRGPGFKYASNLPGSLLKEQKMNRDNKEGQEPAKRRSECEEAPRRRSDEHSKKVPPDGLLRRKSDDVHLRKKRKYEKPQELSGRKRASSLQTSPGSSSHLSPRPPLGSSLSPWWRSSLTYFQQQLKPGKEDKLFRKKRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGQMDNRSKLRNIVELRLAGLDITDASLRLIIRHMPLLSKLHLSYCNHVTDQSINLLTAVGTTTRDSLTEINLSDCNKVTDQCLSFFKRCGNICHIDLRYCKQVTKEGCEQFIAEMSVSVQFGQVEEKLLQKLS

SEQ ID NO: 4852 - protein, 706 aa, Homo sapiens [sequence omitted]

SEQ ID NO: 4853 - protein, 1326 aa, Homo sapiens
MAGPQMGGSAEDHPPRKRHAAEKQKKKTVIYTKCFEFESATQRPIDRQRYDENEDLSDVEEIVSVRGFSLEEKLRSQLYQGDFVHAMEGKDFNYEYVQREALRVPLIFREKDGLGIKMPDPDFTVRDVKLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHLTEFELKGLKALVEKLESLPENKKCVPEGIEDPQALLEGVKNVLKEHADDDPSLAITGVPVVTWPKKTPKNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKQKRGPGFKYASNLPGSLLKEQKMNRDNKEGQEPAKRRSECEEAPRRRSDEHSKKVPPDGLLRRKSDDVHLRKKRKYEKPQELSGRKRASSLQTSPGSSSHLSPRPPLGSSLSPWWRSSLTYFQQQQRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPAPGQMDNRSKLRNIVELRLAGLDITDASLRLIIRHMPLLSKLHLSYCNHVTDQSINLLTAVGTTTRDSLTEINLSDCNKVTDQCLSFFKRCGNICHIDLRYCKQVTKEGCEQFIAEMSVSVQFGQVEEKLLQKLS

SEQ ID NO: 4854 - protein, 559 aa, Homo sapiens
MPDPDFTVRDVKLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHLTEFELKGLKALVEKLESLPENKKCVPEGIEDPQALLEGVKNVLKEHADDDPSLAITGVPVVTWPKKTPKNRAVGRPKGKLGPASAVKLAANRTTAGARRRRTRCRKCEACLRTECGECHFCKDMKKFGGPGRMKQSCIMRQCIATAIRSLISACPSSNAVETSVILT

SEQ ID NO: 4855 - protein, 779 aa, Homo sapiens
MAMSVSAEDDDYESEPDQNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKAYKQKRGPGFKYASNLPGSLLKEQKMNRDNKEGQEPAKRRSECEEAPRRRSDEHSKKVPPDGLLRRKSDDVHLRKKRKYEKPQELSGRKRASSLQTSPGSSSHLSPRPPLGSSLSPWWRSSLTYFQQQLKPGKEDKLFRKKRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGQMDNRSKLRNIVELRLAGLDITDASLRLIIRHMPLLSKLHLSYCNHVTDQSINLLTAVGTTTRDSLTEINLSDCNKVTDQCLSFFKRCGNICHIDLRYCKQVTKEGCEQFIAEMSVSVQFGQVEEKLLQKLS

SEQ ID NO: 4856 - protein, 1096 aa, Homo sapiens
MGSEDHGAQNPSCKIMTFRPTMEEFKDFNKYVAYIESQGAHRAGLAKIIPPKEWKPRQTYDDIDDVVIPAPIQQVVTGQSGLFTQYNIQKKAMTVGEYRRLANSEKYCTPRHQDFDDLERKYWKNLTFVSPIYGADISGSLYDDDVAQWNIGSLRTILDMVERECGTIIEGVNTPYLYFGMWKTTFAWHTEDMDLYSINYLHFGEPKSWYAIPPEHGKRLERLAIGFFPGSSQGCDAFLRHKMTLISPIILKKYGIPFSRITQEAGEFMITFPYGYHAGFNHGFNCAESTNFATLRWIDYGKVATQCTCRKDMVKISMDVFVRILQPERYELWKQGKDLTVLDHTRPTALTSPELSSWSASRASLKAKLLRRSHRKRSQPKKPKPEDPKFPGEGTAGAALLEEAGGSVKEEAGPEVDPEEEEEEPQPLPHGREAEGAEEDGRGKLRPTKAKSERKKKSFGLLPPQLPPPPAHFPSEEALWLPSPLEPPVLGPGPAAMEESPLPAPLNVVPPEVPSEELEAKPRPIIPMLYVVPRPGKAAFNQEHVSCQQAFEHFAQKGPTWKEPVSPMELTGPEDGAASSGAGRMETKARAGEGQAPSTFSKLKMEIKKSRRHPLGRPPTRSPLSVVKQEASSDEEASPFSGEEDVSDPDALRPLLSLQWKNRAASFQAERKFNAAAARTEPYCAICTLFYPYCQALQTEKEAPIASLGKGCPATLPSKSRQKTRPLIPEMCFTSGGENTEPLPANSYIGDDGTSPLIACGKCCLQVHASCYGIRPELVNEGWTCSRCAAHAWTAECCLCNLRGGALQMTTDRRWIHVICAIAVPEARFLNVIERHPVDISAIPEQRWKLKCVYCRKRMKKVSGACIQCSYEHCSTSFHVTCAHAAGVLMEPDDWPYVVSITCLKHKSGGHAVQLLRAVSLGQVVITKNRNGLYYRCRVIGAASQTCYEVNFDDGSYSDNLYPESITSRDCVQLGPPSEGELVELRWTDGNLYKAKFISSVTSHIYQVEFEDGSQLTVKRGDIFTLEEELPKRVRSRLSLSTGAPQEPAFSGEEAKAAKRPRVGTPLATEDSGRSQDYVAFVESLLQVQGRPGAPF

SEQ ID NO: 4857 - protein, 448 aa, Homo sapiens
MGSEDHGAQNPSCKIMTFRPTMEEFKDFNKYVAYIESQGAHRAGLAKIIPPKEWKPRQTYDDIDDVVIPAPIQQVVTGQSGLFTQYNIQKKAMTVGEYRRLANSEKYCTPRHQDFDDLERKYWKNLTFVSPIYGADISGSLYDDDVAQWNIGSLRTILDMVERECGTIIEGVNTPYLYFGMWKTTFAWHTEDMDLYSINYLHFGEPKSWYAIPPEHGKRLERLAIGFFPGSSQGCDAFLRHKMTLISPIILKKYGIPFSRITQEAGEFMITFPYGYHAGFNHGFNCAESTNFATLRWIDYGKVATQCTCRKDMVKISMDVFVRILQPERYELWKQGKDLTVLDHTRPTALTSPELSSWSASRASLKAKLLRRTPPCVSPHRPSQPGIWCPPGGEAKASAASWLLTTRGHGDTEAGPGLGGDPLHAQSEGQASCVSTSRLRMATQDPCR

SEQ ID NO: 4858 - protein, 1130 aa, Homo sapiens
MGSEDHGAQNPSCKIMTFRPTMEEFKDFNKYVAYIESQGAHRAGLAKIIPPKEWKPRQTYDDIDDVVIPAPIQQVVTGQSGLFTQYNIQKKAMTVGEYRRLANSEKYCTPRHQDFDDLERKYWKNLTFVSPIYGADISGSLYDDDVAQWNIGSLRTILDMVERECGTIIEGVNTPYLYFGMWKTTFAWHTEDMDLYSINYLHFGEPKSWYAIPPEHGKRLERLAIGFFPGSSQGCDAFLRHKMTLISPIILKKYGIPFSRITQEAGEFMITFPYGYHAGFNHGFNCAESTNFATLRWIDYGKVATQCTCRKDMVKISMDVFVRILQPERYELWKQGKDLTVLDHTRPTALTSPELSSWSASRASLKAKLLRRQISLKENRHWRKTEEERKPSLERKKEQTKRPGLSSHRKRSQPKKPKPEDPKFPGEGTAGAALLEEAGGSVKEEAGPEVDPEEEEEEPQPLPHGREAEGAEEDGRGKLRPTKAKSERKKKSFGLLPPQLPPPPAHFPSEEALWLPSPLEPPVLGPGPAAMEESPLPAPLNVVPPEVPSEELEAKPRPIIPMLYVVPRPGKAAFNQEHVSCQQAFEHFAQKGPTWKEPVSPMELTGPEDGAASSGAGRMETKARAGEGQAPSTFSKLKMEIKKSRRHPLGRPPTRSPLSVVKQEASSDEEASPFSGEEDVSDPDALRPLLSLQWKNRAASFQAERKFNAAAARTEPYCAICTLFYPYCQALQTEKEAPIASLGKGCPATLPSKSRQKTRPLIPEMCFTSGGENTEPLPANSYIGDDGTSPLIACGKCCLQVHASCYGIRPELVNEGWTCSRCAAHAWTAECCLCNLRGGALQMTTDRRWIHVICAIAVPEARFLNVIERHPVDISAIPEQRWKLKCVYCRKRMKKVSGACIQCSYEHCSTSFHVTCAHAAGVLMEPDDWPYVVSITCLKHKSGGHAVQLLRAVSLGQVVITKNRNGLYYRCRVIGAASQTCYEVNFDDGSYSDNLYPESITSRDCVQLGPPSEGELVELRWTDGNLYKAKFISSVTSHIYQVEFEDGSQLTVKRGDIFTLEEELPKRVRSRLSLSTGAPQEPAFSGEEAKAAKRPRVGTPLATEDSGRSQDYVAFVESLLQVQGRPGAPF

SEQ ID NO: 4859 - protein, 1047 aa, Homo sapiens
MEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAMKREDIYTLDEELPKRVKARFVSAGRCHLGTCQVNSLSSPHVSQAQQETYLGFWINSKKSQCNIFLSGTY

SEQ ID NO: 4860 - protein, 1056 aa, Homo sapiens
MEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAMKREDIYTLDEELPKRVKARFSTASDMRFEDTFYGADIIQGERKRQRVLSSRFKNEYVADPVYRTFLKSSFQKKCQKRQ

SEQ ID NO: 4861 - protein, 354 aa, Homo sapiens
PDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIA

SEQ ID NO: 4862 - protein, 743 aa, Homo sapiens
MVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAMKREDIYTLDEELPKRVKARFSTASDMRFEDTFYGADIIQGERKRQRVLSSRFKNEYVADPVYRTFLKSSFQKKCQKRQ

SEQ ID NO: 4863 - protein, 801 aa, Homo sapiens
MWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAMKREDIYTLDEELPKRVKARFSTASDMRFEDTFYGADIIQGERKRQRVLSSRFKNEYVADPVYRTFLKSSFQKKCQKRQ

SEQ ID NO: 4864 - protein, 835 aa, Homo sapiens
MKHYGLPWKRTEEAAADTALTIMEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKWAHVMCAVAVPEVRFTNVPERTQIDVGRIPLQRLKLGRLGI

SEQ ID NO: 4865 - protein, 629 aa, Homo sapiens
MWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKNASSADTGLRGSLEPASSVPTVAARPPSMSLVPMLLGY

SEQ ID NO: 4866 - protein, 813 aa, Homo sapiens
MEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNKWAHVMCAVAVPEVRFTNVPERTQIDVGRIPLQRLKLGRLGI

SEQ ID NO: 4867 - protein, 523 aa, Homo sapiens
METMKSKANCAQNPNCNIMIFHPTKEEFNDFDKYIAYMESQGAHRAGLAKIIPPKEWKARETYDNISEILIATPLQQVASGRAGVFTQYHKKKKAMTVGEYRHLANSKKYQTPPHQNFEDLERKYWKNRIYNSPIYGADISGSLFDENTKQWNLGHLGTIQDLLEKECGVVIEGVNTPYLYFGMWKTTFAWHTEDMDLYSINYLHLGEPKTWYVVPPEHGQRLERLARELFPGSSRGCGAFLRHKVALISPTVLKENGIPFNRITQEAGEFMVTFPYGYHAGFNHGFNCAEAINFATPRWIDYGKMASQCSCGEARVTFSMDAFVRILQPERYDLWKRGQDRAVVDHMEPRVPASQELSTQKEVQLPRRAALGLRQLPSHWARHSPWPMAARSGTRCHTLVCSSLPRRSAVSGTATQPRAAAVHSSKKPSSTPSSTPGPSAQIIHPSNGRRGRGRPPQKLRAQELTLQTPAKRPLLAGTTCTASGPEPEPLPEDGALMDKPVPLSPGLQHPVKASGCSWAPVP

SEQ ID NO: 4868 - protein, 506 aa, Homo sapiens
MKSVHSSPQNTSHTIMTFYPTMEEFADFNTYVAYMESQGAHQAGLAKVIPPKEWKARQMYDDIEDILIATPLQQVTSGQGGVFTQYHKKKKAMRVGQYRRLANSKKYQTPPHQNFADLEQRYWKSHPGNPPIYGADISGSLFEESTKQWNLGHLGTILDLLEQECGVVIEGVNTPYLYFGMWKTTFAWHTEDMDLYSINYLHFGEPKTWYVVPPEHGQHLERLARELFPDISRGCEAFLRHKVALISPTVLKENGIPFNCMTQEAGEFMVTFPYGYHAGFNHGFNCAEAINFATPRWIDYGKMASQCSCGESTVTFSMDPFVRIVQPESYELWKHRQDLAIVEHTEPRVAESQELSNWRDDIVLRRAALGLRLLPNLTAQCPTQPVSSGHCYNPKGCGTDAVPGSAFQSSAYHTQTQSLTLGMSARVLLPSTGSWGSGRGRGRGQGQGRGCSRGRGHGCCTRELGTEEPTVQPASKRRLLMGTRSRAQGHRPQLPLANDLMTNLSL

SEQ ID NO: 4869 - protein, 359 aa, Homo sapiens
MIAAQAKLVYQLNKYYTERCQARKAAIAKTIREVCKVVSDVLKEVEVQEPRFISSLSEIDARYEGLEVISPTEFEVVLYLNQMGVFNFVDDGSLPGCAVLKLSDGRKRSMSLWVEFITASGYLSARKIRSRFQTLVAQAVDKCSYRDVVKMIADTSEVKLRIRERYVVQITPAFKCTGIWPRSAAQWPMPHIPWPGPNRVAEVKAEGFNLLSKECYSLTGKQSSAESDAWVLQFGEAENRLLMGGCRNKCLSVLKTLRDRHLELPGQPLNNYHMKTLLLYECEKHPRETDWDESCLGDRLNGILLQLISCLQCRRCPHYFLPNLDLFQGKPHSALESAAKQTWRLAREILTNPKSLDKL

SEQ ID NO: 4870 - protein, 148 aa, Homo sapiens
MAVASDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSKIGSLIDVNQSKDPEGLRVFYYLVQDLKCLVFSLIGLHFKIKPI

SEQ ID NO: 4871 - protein, 111 aa, Homo sapiens
MAVASDFYLRYYVGHKGKFGHEFLEFEFRPDGKLRYANNSNYKNDVMIRKEELEIVIGDEHISFTTSKIGSLIDVNQSKDPEGLRVFYYLVQDLKCLVFSLIGLHFKIKPI

SEQ ID NO: 4872 - protein, 346 aa, Homo sapiens
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAV

SEQ ID NO: 4873 - protein, 300 aa, Homo sapiens
MQSDDVIWDTLGNKQFCSFKIRTKTQSFCRNEYSLTGLCNRSSCPLANSQYATIKEEKGQCYLYMKVIERAAFPRRLWERVRLSKNYEKALEQIDENLIYWPRFIRHKCKQRFTKITQYLIRIRKLTLKRQRKLVPLSKKVERREKRREEKALIAAQLDNAIEKELLERLKQDTYGDIYNFPIHAFDKALEQQEAESDSSDTEEKDDDDDDEEDVGKREFVEDGEVDESDISDFEDMDKLDASSDEDQDGKSSSEEEEEKALSAKHKGKMPLRGPLQRKRAYVEIEYEQETEPVAKAKTT

SEQ ID NO: 4874 - protein, 351 aa, Homo sapiens
MERRMQLVKKDNEKERHKLFQGYETEEREETELSEKIKLECQPELSETSQTLPPKPFSCGRSGKGHKRKSPFGSTERKTPVKKLAPEFSKVKTKTPKHSPIKEEPCGSLSETVCKRELRSQETPEKPRSSVDTPPRLSTPQKGPSTHPKEKAFSSEIEDLPYLSTTEMYLCRWHQPPPSPLPLRESSPKKEETVARCLMPSSVAGETSVLAVPSWRDHSVEPLRDPNPSDLLENLDDSVFSKRHAKLELDEKRRKRWDIQRIREQRILQRLQLRMYKKKGIQESEPEVTSFFPEPDDVESLMITPFLPVVAFGRPLPKLTPQNFELPWLDERSRCRLEIQKKQTPHRTCRK

SEQ ID NO: 4875 - protein, 614 aa, Homo sapiens
MTMRSAVFKAAAAPAGGNPEQRLDYERAAALGGPEDEPGAAEAHFLPRHRKLKEPGPPLASSQGGSPAPSPAGCGGKGRGLLLPAGAAPGQQEESWGGSVPLPCPPPATKQAGIGGEPAAAGAGCSPRPKYQAVLPIQTGSLVAAAKEPTPWAGDKGGAASPAATASDPAGPPPLPLPGPPPLAPTATAGTLAASEGRWKSMRKSPLGGGGGSGASSQAACLKQILLLQLDLIEQQQQQLQAKEKEIEELKSERDTLLARIERMERRMQLVKKDNEKERHKLFQGYETEEREETELSEKIKLECQPELSETSQTLPPKPFSCGRSGKGHKRKSPFGSTERKTPVKKLAPEFSKVKTKTPKHSPIKEEPCGSLSETVCKRELRSQETPEKPRSSVDTPPRLSTPQKGPSTHPKEKAFSSEIEDLPYLSTTEMYLCRWHQPPPSPLPLRESSPKKEETVARCLMPSSVAGETSVLAVPSWRDHSVEPLRDPNPSDLLENLDDSVFSKRHAKLELDEKRRKRWDIQRIREQRILQRLQLRMYKKKGIQESEPEVTSFFPEPDDVESLMITPFLPVVAFGRPLPKLTPQNFELPWLDERSRCRLEIQKKQTPHRTCRK

SEQ ID NO: 4876 - protein, 351 aa, Homo sapiens; identical to SEQ ID NO: 4874

SEQ ID NO: 4877 - protein, 577 aa, Homo sapiens
MNPVNATALYISASRLVLNYDPGDPKAFTEINRLLPYFRQSLSCCVCGHLLQDPIAPTNSTCQHYVCKTCKGKKMMMKPSCSWCKDYEQFEENKQLSILVNCYKKLCEYITQTTLARDIIEAVDCSSDILALLNDGSLFCEETEKPSDSSFTLCLTHSPLPSTSEPTTDPQASLSPMSESTLSIAIGSSVINGLPTYNGLSIDRFGINIPSPEHSNTIDVCNTVDIKTEDLSDSLPPVCDTVATDLCSTGIDICSFSEDIKPGDSLLLSVEEVLRSLETVSNTEVCCPNLQPNLEATVSNGPFLQLSSQSLSHNVFMSTSPALHGLSCTAATPKIAKLNRKRSRSESDSEKVQPLPISTIIRGPTLGASAPVTVKRESKISLQPIATVPNGGTTPKISKTVLLSTKSMKKSHEHGSKKSHSKTKPGILKKDKAVKEKIPSHHFMPGSPTKTVYKKPQEKKGCKCGRATQNPSVLTCRGQRCPCYSNRKACLDCICRGCQNSYMANGEKKLEAFAVPEKALEQTRLTLGINVTSIAVRNASTSTSVINVTGSPVTTFLAASTHDDKSLDEAIDMRFDC

SEQ ID NO: 4878 - protein, 503 aa, Homo sapiens
MMMKPSCSWCKDYEQFEENKQLSILVNCYKKLCEYITQTTLARDIIEAVDCSSDILALLNDGSLFCEETEKPSDSSFTLCLTHSPLPSTSEPTTDPQASLSPMSESTLSIAIGSSVINGLPTYNGLSIDRFGINIPSPEHSNTIDVCNTVDIKTEDLSDSLPPVCDTVATDLCSTGIDICSFSEDIKPGDSLLLSVEEVLRSLETVSNTEVCCPNLQPNLEATVSNGPFLQLSSQSLSHNVFMSTSPALHGLSCTAATPKIAKLNRKRSRSESDSEKVQPLPISTIIRGPTLGASAPVTVKRESKISLQPIATVPNGGTTPKISKTVLLSTKSMKKSHEHGSKKSHSKTKPGILKKDKAVKEKIPSHHFMPGSPTKTVYKKPQEKKGCKCGRATQNPSVLTCRGQRCPCYSNRKACLDCICRGCQNSYMANGEKKLEAFAVPEKALEQTRLTLGINVTSIAVRNASTSTSVINVTGSPVTTFLAASTHDDKSLDEAIDMRFDC

SEQ ID NO: 4879 - protein, 521 aa, Homo sapiens
MSASEGMKFKFHSGEKVLCFEPDPTKARVLYDAKIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 4880 - protein, 416 aa, Homo sapiens
MSASEGMKFKFHSGEKVLCFEPDPTKARVLYDAKIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKSRFILGCPRPGRASVYFVFSQCQAWC

SEQ ID NO: 4881 - protein, 372 aa, Homo sapiens
MKMMKTKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 4882 - protein, 196 aa, Homo sapiens
MEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLS

SEQ ID NO: 4883 - protein, 355 aa, Homo sapiens
MEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 4884 - protein, 509 aa, Homo sapiens
MSPSVRPGAGWAPVGRPGRPIQIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 4885 - protein, 19 aa, Homo sapiens
MEERTITIEIPEVLKKQLE

SEQ ID NO: 4886 - protein, 613 aa, Homo sapiens
MAAQAAAAAQAAAAQAAQAEAADSWYLALLGFAEHFRTSSPPKIRLCVHCLQAVFPFKPPQRIEARTHLQLGSVLYHHTKNSEQARSHLEKAGSLSQQIPQFEDVKFEAASLLSELYCQENSVDAAKPLLRKAIQISQQTPYWHCRLLFQLAQLHTLEKDLVSACDLLGVGAEYARVVGSEYTRALFLLSKGMLLLMERKLQEVHPLLTLCGQIVENWQGNPIQKESLRVFFLVLQVTHYLDAGQVKSVKPCLKQLQQCIQTISTLHDDEILPSNPADLFHWLPKEHMCVLVYLVTVMHSMQAGYLEKAQKYTDKALMQLEKLKMLDCSPILSSFQVILLEHIIMCRLVTGHKATALQEISQVCQLCQQSPRLFSNHAAQLHTLLGLYCVSVNCMDNAEAQFTTALRLTNHQELWAFIVTNLASVYIREGNRHQEVLYSLLERINPDHSFPVSSHCLRAAAFYVRGLFSFFQGRYNEAKRFLRETLKMSNAEDLNRLTACSLVLLGHIFYVLGNHRESNNMVVPAMQLASKIPDMSVQLWSSALLRDLNKACGNAMDAHEAAQMHQNFSQQLLQDHIEACSLPEHNLITWTDGPPPVQFQAQNGPNTSLASLL

SEQ ID NO: 4887 - protein, 167 aa, Homo sapiens
MPMKPPRCTRTSRSSCSRTTLRPAASPNTTSSRGQTVHPPCSSKLRMDPTPAWPASCEALMGPSSSAGPARLRLPPRRHSSLPPRRASFLIVSRASKSWECAGPVPALPGGVVAVPTSQQDPQCRGSQVAHRRCLSRAILQSGPQCQSCLSIWVTSARSRVQASSRS

SEQ ID NO: 4888 - protein, 613 aa, Homo sapiens
MAAQAAAAAQAAAAQAAQAEAADSWYLALLGFAEHFRTSSPPKIRLCVHCLQAVFPFKPPQRIEARTHLQLGSVLYHHTKNSEQARSHLEKAWLISQQIPQFEDVKFEAASLLSELYCQENSVDAAKPLLRKAIQISQQTPYWHCRLLFQLAQLHTLEKDLVSACDLLGVGAEYARVVGSEYTRALFLLSKGMLLLMERKLQEVHPLLTLCGQIVENWQGNPIQKESLRVFFLVLQVTHYLDAGQVKSVKPCLKQLQQCIQTISTLHDDEILPSNPADLFHWLPKEHMCVLVYLVTVMHSMQAGYLEKAQKYTDKALMQLEKLKMLDCSPILSSFQVILLEHIIMCRLVTGHKATALQEISQVCQLCQQSPRLFSNHAAQLHTLLGLYCVSVNCMDNAEAQFTTALRLTNHQELWAFIVTNLASVYIREGNRHQEVLYSLLERINPDHSFPVSSHCLRAAAFYVRGLFSFFQGRYNEAKRFLRETLKMSNAEDLNRLTACSLVLLGHIFYVLGNHRESNNMVVPAMQLASKIPDMSVQLWSSALLRDLNKACGNAMDAHEAAQMHQNFSQQLLQDHIEACSLPEHNLITWTDGPPPVQFQAQNGPNTSLASLL

SEQ ID NO: 4889 - protein, 167 aa, Homo sapiens; identical to SEQ ID NO: 4887

SEQ ID NO: 4890 - protein, 141 aa, Homo sapiens [sequence omitted]

SEQ ID NO: 4891 - protein, 221 aa, Homo sapiens
MAAAVRMNIQMLLEAADYLERREREAEHGYASMLPYNNKDRDALKRRNKSKKNNSSSRSTHNEMEKNRRAHLRLCLEKLKGLVPLGPESSRHTTLSLLTKAKLHIKKLEDCDRKAVHQIDQLQREQRHLKRQLEKLGIERIRMDSIGSTVSSERSDSDREEIDVDVESTDYLTGDLDWSSSSVSDSDERGSMQSLGSDEGYSSTSIKRIKLQDSHKACLGL

SEQ ID NO: 4892 - protein, 211 aa, Homo sapiens
MAAAVRMNIQMLLEAADYLERREREAEHGYASMLPYNNKDRDALKRRNKSKKNNSSSRRAHLRLCLEKLKGLVPLGPESSRHTTLSLLTKAKLHIKKLEDCDRKAVHQIDQLQREQRHLKRQLEKLGIERIRMDSIGSTVSSERSDSDREEIDVDVESTDYLTGDLDWSSSSVSDSDERGSMQSLGSDEGYSSTSIKRIKLQDSHKACLGL

SEQ ID NO: 4893 - protein, 209 aa, Homo sapiens
MELNSLLILLEAAEYLERRDREAEHGYASVLPFDGDFAREKTKAAGLVRKAPNNRSSHNELEKHRRAKLRLYLEQLKQLVPLGPDSTRHTTLSLLKRAKVHIKKLEEQDRRALSIKEQLQQEHRFLKRRLEQLSVQSVERVRTDSTGSAVSTDDSEQEVDIEGMEFGPGELDSVGSSSDADDHYSLQSGTGGDSGFGPHCRRLGRPALS

SEQ ID NO: 4894 - protein, 58 aa, Homo sapiens
MELNSLLILLEAAEYLERRDREAEHGYASVLPFDGDFAREKTKAAGLVRKAPNNRPPQ

SEQ ID NO: 4895 - protein, 430 aa, Homo sapiens
MFDGYDSCSEDTSSSSSSEESEEEVAPLPSNLPIIKNNGQVYTYPDGKSGMATCEMCGMVGVRDAFYSKTKRFCSVSCSRSYSSNSKKASILARLQGKPPTKKAKVLQKQPLVAKLAAYAQYQATLQNQAKTKAAVSMEGFSWGNYINSNSFIAAPVTCFKHAPMGTCWGDISENVRVEVPNTDCSLPTKVFWIAGIVKLAGYNALLRYEGFENDSGLDFWCNICGSDIHPVGWCAASGKPLVPPRTIQHKYTNWKAFLVKRLTGAKTLPPDFSQKVSESMQYPFKPCMRVEVVDKRHLCRTRVAVVESVIGGRLRLVYEESEDRTDDFWCHMHSPLIHHIGWSRSIGHRFKRSDITKKQDGHFDTPPHLFAKVKEVDQSGEWFKEGMKLEAIDPLNLSTICVATIRKVTQNFLLNGLTTSGKLAPLQHQ

SEQ ID NO: 4896 - protein, 628 aa, Homo sapiens
MFDGYDSCSEDTSSSSSSEESEEEVAPLPSNLPIIKNNGQVYTYPDGKSGMATCEMCGMVGVRDAFYSKTKRFCSVSCSRSYSSNSKKASILARLQGKPPTKKAKVLQKQPLVAKLAAYAQYQATLQNQAKTKAAVSMEGFSWGNYINSNSFIAAPVTCFKHAPMGTCWGDISENVRVEVPNTDCSLPTKVFWIAGIVKLAGYNALLRYEGFENDSGLDFWCNICGSDIHPVGWCAASGKPLVPPRTIQHKYTNWKAFLVKRLTGAKTLPPDFSQKVSESMQYPFKPCMRVEVVDKRHLCRTRVAVVESVIGGRLRLVYEESEDRTDDFWCHMHSPLIHHIGWSRSIGHRFKRSDITKKQDGHFDTPPHLFAKVKEVDQSGEWFKEGMKLEAIDPLNLSTICVATIRKVLADGFLMIGIDGSEAADGSDWFCYHATSPSIFPVGFCEINMIELTPPRGYTKLPFKWFDYLRETGSIAAPVKLFNKDVPNHGFRVGMKLEAVDLMEPRLICVATVTRIIHRLLRIHFDGWEEEYDQWVDCESPDLYPVGWCQLTGYQLQPPASQSSRENQSASSKQKKKAKSQQYKGHKKMTTLQLKEELLDGEDYNFLQGASDQESNGSANFYIKQEP

SEQ ID NO: 4897 - protein, 628 aa, Homo sapiens; identical to SEQ ID NO: 4896

SEQ ID NO: 4898 - protein, 628 aa, Homo sapiens; identical to SEQ ID NO: 4896

SEQ ID NO: 4899 - protein, 5596 aa, Homo sapiens
MEHFLLEVAAAPLRLIAAKNEKSRSELGRFLAKQVWTPQDRQCVLSTLAQLLLDKDCTVLVGRQLRPLLLDLLERNAEAIKAGGQINHDLHERLCVSMSKLIGNHPDVLPFALRYFKDTSPVFQRLFLESSDANPVRYGRRRMKLRDLMEAAFKFLQQEQSVFRELWDWSVCVPLLRSHDTLVRWYTANCLALVTCMNEEHKLSFLKKIFNSDELIHFRLRLLEEAQLQDLEKALVLANPEVSLWRKQKELQYLQGHLVSSDLSPRVTAVCGVVLPGQLPAPGELGGNRSSSREQELALRSYVLVESVCKSLQTLAMAVASQNAVLLEGPIGCGKTSLVEYLAAVTGRTKPPQLLKVQLGDQTDSKMLLGMYRCTDVPGEFVWQPGTLTQAATMGHWILLEDIDYAPLDVVSVLIPLLENGELLIPGRGDCLKVAPGFQFFATRRLLSCGGNWYRPLNSHATLLDKYWTKIHLDNLDKRELNEVLQSRYPSLLAVVDHLLDIYIQLTGEKHHSWSDSSVGCEQAPEEVSEARRENKRPTLEGRELSLRDLLNWCNRIAHSFDSSSLSASLNIFQEALDCFTAMLSEHTSKLKMAEVIGSKLNISRKKAEFFCQLYKPEIVINELDLQVGRVRLLRKQSEAVHLQREKFTFAATRPSSVLIEQLAVCVSKGEPVLLVGETGTGKTSTIQYLAHITGHRLRVVNMNQQSDTADLLGGYKPVDHKLIWLPLREAFEELFAQTFSKKQNFTFLGHIQTCYRQKRWHDLLRLMQHVHKSAVNKDGKDSETGLLIKEKWEAFGLRLNHAQQQMKMTENTLLFAFVEGTLAQAVKKGEWILLDEINLAAPEILECLSGLLEGSSGSLVLLDRGDTEPLVRHPDFRLFACMNPATDVGKRNLPPGIRNRFTELYVEELESKEDLQVLIVDYLKGLSVNKNTVQGIINFYTALRKESGTKLVDGTGHRPHYSLRTLCRALRFAASNPCGNIQRSLYEGFCLGFLTQLDRASHPIVQKLICQHIVPGNVKSLLKQPIPEPKGGRLIQVEGYWIAVGDKEPTIDETYILTSSVKLNLRDIVRVVSAGTYPVLIQGETSVGKTSLIQWLAAATGNHCVRINNHEHTDIQEYIGCYTSDSSGKLVFKEGVLIDAMRKGYWIILDELNLAPTDVLEALNRLLDDNRELLVTETQEVVKAHPRFMLFATQNPPGLYGGRKVLSRAFRNRFVELHFDELPSSELETILHKRCSLPPSYCSKLVKVMLDLQSYRRSSSVFAGKQGFITLRDLFRWAERYRLAEPTEKEYDWLQHLANDGYMLLAGRVRKQEEIDVIQEVLEKHFKKKLCPQSLFSKENVLKLLGKLSTQISTLECNFGHIVWTEGMRRLAMLVGRALEFGEPVLLVGDTGCGKTTICQVFAALANQKLYSVSCHLHMETSDFLGGLRPVRQKPNDKEEIDTSRLFEWHDGPLVQAMKEDGFFLLDEISLADDSVLERLNSVLEVEKSLVLAEKGSPEDKDSEIELLTAGKKFRILATMNPGGDFGKKELSPALRNRFTEIWCPQSTSREDLIQIISHNLRPGLCLGRIDPKGSDIPEVMLDFIDWLTHQEFGRKCVVSIRDILSWVNFMNKMGEEAALKRPEIISTVTSFVHAACLVYIDGIGSGVTSSGFGTALLARKECLKFLIKRLAKIVRLTEYQKNELKIYDRMKAKEFTGIDNLWGIHPFFIPRGPVLHRNNIADYALSAGTTAMNAQRLLRATKLKKPILLEGSPGVGKTSLVGALAKASGNTLVRINLSEQTDITDLFGADLPVEGGKGGEFAWRDGPLLAALKAGHWVVLDELNLASQSVLEGLNACFDHRGEIYVPELGMSFQVQHEKTKIFGCQNPFRQGGGRKGLPRSFLNRFTQVFVDPLTVIDMEFIASTLFPAIEKNIVKKMVAFNNQIDHEVTVEKKWGQKGGPWEFNLRDLFRWCQLMLVDQSPGCYDPGQHVFLVYGERMRTEEDKKKVIAVFKDVFGSNSNPYMGTRLFRITPYDVQLGYSVLSRGSCVPHPSRHPLLLLHQSFQPLESIMKCVQMSWMVILVGPASVGKTSLVQLLAHLTGHTLKIMAMNSAMDTTELLGGFEQVDLIRPWRRLLEKVEGTVRALLRDSLLISADDAEVVLRAWSHFLLTYKPKCLGEGGKAITMEIVNKLEAVLLLMQRLNNKINSYCKAEFAKLVEEFRSFGVKLTQLASGHSHGTFEWVDSMLVQALKSGDWLLMDNVNFCNPSVLDRLNALLEPGGVLTISERGMIDGSTPTITPNPNFRLFLSMDPVHGDISRAMRNRGLEIYISGEGDASTPDNLDLKVLLHSLGLVGNSVCDILLALHTETRSTVVGSPTSSVSTLIQTAILIVQYLQRGLSLDRAFSEACWEVYVCSQHSPANRKLVQALLEKHVSSLRAHETWGDSILGMGLWPDSVPSALFATEDSHLSTVRRDGQILVYCLNRMSMKTSSWTRSQPFTLQDLEKIMQSPSPENLKFNAVEVNTYWIDEPDVLVMAVKLLIERATNQDWMLRVKWLYHLAKNIPQGLESIQIHLEASAASLRNFYSHSLSGAVSNVFKILQPNTTDEFVIPLDPRWNMQALDMIRNLMDFDPQTDQPDQLFALLESAANKTIIYLDREKRVFTEANLVSVGSKKLRESVLRMSFEFHQDPESYHTLPHEIVVNLAAFFELCDALVLLWVQSSQGMVSDASANEILGSLRWRDRFWTVADTVKVDAPGLALLALHWHWVLKHLVHQIPRLLMNYEDKYYKEVQTVSEHIQNCLGSQTGGFAGIKKLQKFLGRPFPFKDKLVVECFSQLKVLNKVLAIREQMSALGESGWQEDINRLQVVASQWTLKKSLLQAWGLILRANILEDVSLDELKNFVHAQCLELKAKGLSLGFLEKKHDEASSLSHPDLTSVIHLTRSVQLWPAMEYLAMLWRYKVTADFMAQACLRRCSKNQQPQINEEISHLISFCLYHTPVTPQELRDLWSLLHHQKVSPEEITSLWSELFNSMFMSFWSSTVTTNPEYWLMWNPLPGMQQREAPKSVLDSTLKGPGNLNRPIFSKCCFEVLTSSWRASPWDVSGLPILSSSHVTLGEWVERTQQLQDISSMLWTNMAISSVAEFRRTDSQLQGQVLFRHLAGLAELLPESRRQEYMQNCEQLLLGSSQAFQHVGQTLGDMAGQEVLPKELLCQLLTSLHHFVGEGESKRSLPEPAQRGSLWVSLGLLQIQTWLPQARFDPAVKREYKLNYVKEELHQLQCEWKTRNLSSQLQTGRDLEDEVVVSYSHPHVRLLRQRMDRLDNLTCHLLKKQAFRPQLPAYESLVQEIHHYVTSIAKAPAVQDLLTRLLQALHIDGPRSAQVAQSLLKEEASWQQSHHQFRKRLSEEYTFYPDAVSPLQASILQLQHGMRLVASELHTSLHSSMVGADRLGTLATALLAFPSVGPTFPTYYAHADTLCSVKSEEVLRGLGKLILKRSGGKELEGKGQKACPTREQLLMNALLYLRSHVLCKGELDQRALQLFRHVCQEIISEWDEQERIAQEKAEQESGLYRYRSRNSRTALSEEEEEEREFRKQFPLHEKDFADILVQPTLEENKGTSDGQEEEAGTNPALLSQNSMQAVMLIHQQLCLNFARSLWYQQTLPPHEAKHYLSLFLSCYQTGASLVTHFYPLMGVELNDRLLGSQLLACTLSHNTLFGEAPSDLMVKPDGPYDFYQHPNVPEARQCQPVLQGFSEAVSHLLQDWPEHPALEQLLVVMDRIRSFPLSSPISKFLNGLEILLAKAQDWEENASRALSLRKHLDLISQMIIRWRKLELNCWSMSLDNTMKRHTEKSTKHWFSIYQMLEKHMQEQTEEQEDDKQMTLMLLVSTLQAFIEGSSLGEFHVRLQMLLVFHCHVLLMPQVEGKDSLCSVLWNLYHYYKQFFDRVQAKIVELRSPLEKELKEFVKISKWNDVSFWSIKQSVEKTHRTLFKFMKKFEAVLSEPCRSSLVESDKEEQPDFLPRPTDGAASELSSIQNLNRALRETLLAQPAAGQATIPEWCQGAAPSGLEGELLRRLPKLRKRMRKMCLTFMKESPLPRLVEGLDQFTGEVISSVSELQSLKVEPSAEKEKQRSEAKHILMQKQRALSDLFKHLAKIGLSYRKGLAWARSKNPQEMLHLHPLDLQSALSIVSSTQEADSRLLTEISSSWDGCQKYFYRSLARHARLNAALATPAKEMGMGNVERCRGFSAHLMKMLVRQRRSLTTLSEQWIILRNLLSCVQEIHSRLMGPQAYPVAFPPQDGVQQWTERLQHLAMQCQILLEQLSWLLQCCPSVGPAPGHGNVQVLGQPPGPCLEGPELSKGQLCGVVLDLIPSNLSYPSPIPGSQLPSGCRMRKQDHLWQQSTTRLTEMLKTIKTVKADVDKIRQQSCETLFHSWKDFEVCSSALSCLSQVSVHLQGLESLFILPGMEVEQRDSQMALVESLEYVRGEISKAMADFTTWKTHLLTSDSQGGNQMLDEGFVEDFSEQMEIAIRAILCAIQNLEERKNEKAEENTDQASPQEDYAGFERLQSGHLTKLLEDDFWADVSTLHVQKIISAISELLERLKSYGEDGTAAKHLFFSQSCSLLVRLVPVLSSYSDLVLFFLTMSLATHRSTAKLLSVLAQVFTELAQKGFCLPKEFMEDSAGEGATEFHDYEGGGIGEGEGMKDVSDQIGNEEQVEDTFQKGQEKDKEDPDSKSDIKGEDNAIEMSEDFDGKMHDGELEEQEEDDEKSDSEGGDLDKHMGDLNGEEADKLDERLWGDDDEEEDEEEEDNKTEETGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQSFKRKPGQADNERSMGDHNERVHKRLRTVDTDSHAEQGPAQQPQAQVEDADAFEHIKQGSDAYDAQTYDVASKEQQQSAKDSGKDQEEEEIEDTLMDTEEQEEFKAADVEQLKPEEIKSGTTAPLGFDEMEVEIQTVKTEEDQDPRTDKAHKETENEKPERSRESTIHTAHQFLMDTIFQPFLKDVNELRQELERQLEMWQPRESGNPEEEKVAAEMWQSYLILTAPLSQRLCEELRLILEPTQAAKLKGDYRTGKRLNIRKVIPYIASQFRKDKIWLRRTKPSKRQYQICLAIDDSSSMVDNHTKQLAFESLAVIGNALTLLEVGQIAVCSFGESVKLLHPFHEQFSDYSGSQILRLCKFQQKKTKIAQFLESVANMFAAAQQLSQNISSETAQLLLVVSDGRGLFLEGKERVLAAVQAARNANIFVIFVVLDNPSSRDSILDIKVPIFKGPGEMPEIRSYMEEFPFPYYIILRDVNALPETLSDALRQWFELVTASDHP

SEQ ID NO: 4900 - protein, 5596 aa, Homo sapiens; identical to SEQ ID NO: 4899

SEQ ID NO: 4901 - protein, 1181 aa, Homo sapiens
MEHFLLEVAAAPLRLIAAKNEKSRSELGRFLAKQVWTPQDRQCVLSTLAQLLLDKDCTVLVGRQLRPLLLDLLERNAEAIKAGGQINHDLHERLCVSMSKLIGNHPDVLPFALRYFKDTSPVFQRLFLESSDANPVRYGRRRMKLRDLMEAAFKFLQQEQSVFRELWDWSVCVPLLRSHDTLVRWYTANCLALVTCMNEEHKLSFLKKIFNSDELIHFRLRLLEEAQLQDLEKALVLANPEVSLWRKQKELQYLQGHLVSSDLSPRVTAVCGVVLPGQLPAPGELGGNRSSSREQELALRSYVLVESVCKSLQTLAMAVASQNAVLLEGPIGCGKTSLVEYLAAVTGRTKPPQLLKVQLGDQTDSKMLLGMYRCTDVPGEFVWQPGTLTQAATMGHWILLEDIDYAPLDVVLQSRYPSLLAVVDHLLDIYIQLTGEKHHSWSDSSVGCEQAPEEVSEARRENKRPTLEGRELSLRDLLNWCNRIAHSFDSSSLSASLNIFQEALDCFTAMLSEHTSKLKMAEVIGSKLNISRKKAEFFCQLYKPEIVINELDLQVGRVRLLRKQSEAVHLQREKFTFAATRPSSVLIEQLAVCVSKGEPVLLVGETGTGKTSTIQYLAHITGHRLRVVNMNQQSDTADLLGGYKPVDHKLIWLPLREAFEELFAQTFSKKQNFTFLGHIQTCYRQKRWHDLLRLMQHVHKSAVNKDGKDSETGLLIKEKWEAFGLRLNHAQQQMKMTENTLLFAFVEGTLAQAVKKGEWILLDEINLAAPEILECLSGLLEGSSGSLVLLDRGDTEPLVRHPDFRLFACMNPATDVGKRNLPPGIRNRFTELYVEELESKEDLQVLIVDYLKGLSVNKNTVQGIINFYTALRKESGTKLVDGTGHRPHYSLRTLCRALRFAASNPCGNIQRSLYEGFCLGFLTQLDRASHPIVQKLICQHIVPGNVKSLLKQPIPEPKGGRLIQVEGYWIAVGDKEPTIDETYILTSSVKLNLRDIVRVVSAGTYPVLIQGETSVGKTSLIQWLAAATGNHCVRINNHEHTDIQEYIGCYTSDSSGKLVFKEGVLIDAMRKGYWIILDELNLAPTDVLEALNRLLDDNRELLVTETQEVVKAHPRFMLFATQNPPGLYGGRKVLSRAFRNRFVELHFDELPSSELETILHKRCSLPPSYCSKLVKVMLDLQ

SEQ ID NO: 4902 - protein, 1116 aa, Homo sapiens
MILDEFYNVKFCIDASQPDVGSWLKYIRFAGCYDQHNLVACQINDQIFYRVVADIAPGEELLLFMKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKQVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQFQLPDQRTWMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 4903 - protein, 1051 aa, Homo sapiens
MKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQFQLPDQRTWMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 4904 - protein, 1052 aa, Homo sapiens
MKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKQVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQFQLPDQRTWMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 4905 - protein, 1003 aa, Homo sapiens
MKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQEESKA

SEQ ID NO: 4906 - protein, 103 aa, Homo sapiens
MKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREY

SEQ ID NO: 4907 - protein, 1042 aa, Homo sapiens
MKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 4908 - protein, 22 aa, Homo sapiens
MKSEDYPHETMAPDIHEERQYR

SEQ ID NO: 4909 - protein, 1051 aa, Homo sapiens; identical to SEQ ID NO: 4903

SEQ ID NO: 4910 - protein, 1052 aa, Homo sapiens; identical to SEQ ID NO: 4904

SEQ ID NO: 4911 - protein, 68 aa, Homo sapiens
MKSEDYPHETMAPDIHEERQYRCEDCDQLFESKAELADHQKFPCSTPHSAFSMVEEDFQQKLESENDL

SEQ ID NO: 4912 - protein, 29 aa, Homo sapiens
MKSEDYPHETMAPDIHEERQYRCEDCDQL

SEQ ID NO: 4913 - protein, 125 aa, Homo sapiens
MKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSH

SEQ ID NO: 4914 - protein, 103 aa, Homo sapiens; identical to SEQ ID NO: 4906

SEQ ID NO: 4915 - protein, 1230 aa, Homo sapiens
MRSKGRARKLATNNECVYGNYPEIPLEEMPDADGVASTPSLNIQEPCSPATSSEAFTPKEGSPYKAPIYIPDDIPIPAEFELRESNMPGAGLGIWTKRKIEVGEKFGPYVGEQRSNLKDPSYGWEILDEFYNVKFCIDASQPDVGSWLKYIRFAGCYDQHNLVACQINDQIFYRVVADIAPGEELLLFMKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 4916 - protein, 103 aa, Homo sapiens; identical to SEQ ID NO: 4906

SEQ ID NO: 4917 - protein, 751 aa, Homo sapiens
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQVAMRAQRASRTRRWWMNAACCPASCLSPAWTGCQPATAWLAACSPSSPFVCSLAGRPRCLAVLPPCSSTASPGPQASPRSTTCGGCTLALAPRRNARPAPGAAVSPCSSRPTEPRR

SEQ ID NO: 4918 - protein, 860 aa, Homo sapiens
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICFPSTGPCSVWVLLGWQPLPGRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLCGGLWWRVPLSYP

SEQ ID NO: 4919 - protein, 877 aa, Homo sapiens
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICCRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLAVEGRGPDACVTSRASEEAPAFVQLGPQSTHHSPRTPRSLDHLHPEDRP

SEQ ID NO: 4920 - protein, 841 aa, Homo sapiens
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQGSLLRPGHSFLRDGTSLGMLRELMVVIRIWGLLKPSCLPVYTATSDTQDSMSLLFRLLTKLWICCRDEGPASEPDEALVDECCLLPSQLLIPSLDWLPASDGLVSRLQPKQPLRLQFGRAPTLPGSAATLQLDGLARAPGQPKIDHLRRLHLGACPTEECKACTRCGCVTMLKSPNRTTAVKQWEQRWIKNCLCGGLWWRVPLSYP

SEQ ID NO: 4921 - protein, 663 aa, Homo sapiens
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVLDMNTLQALQQLLQWVGDFVLYLLASLPNQPCPTSEPCPTSEPCPTSEPSPTSEPSPT

SEQ ID NO: 4922 - protein, 537 aa, Homo sapiens
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLKPSGQVLTSTESLCRLRGRVALADIAFTGGGNIVVATADGSSASPVQFYKVCVSVVSEKCRIDTEILPSLFMRCTTDLNRKDKFPAITHLKFLARDMSEQVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKVLSTRILAMKASLCKLSPCTVTRVCDYHTKLFLIAISSTLKSLLRPHFLNTPDKSPGDRLTEICTKITDVDIDKVMINLKTEEFVL

SEQ ID NO: 4923 - protein, 462 aa, Homo sapiens
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKVLLCASSQTSSIVECWSLRKEGLPVNNIFQQISPVVGDKQPTILKWRILSATNDLDRVSAVALPKLPISLTNTDLKVASDTQFYPGLGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVL

SEQ ID NO: 4924 - protein, 365 aa, Homo sapiens
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVL

SEQ ID NO: 4925 - protein, 367 aa, Homo sapiens
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVRLALAFHDGSVHIVHRLSLQTMAVFYSSAAPRPVDEPAMKRPRTAGPAVHLKAMQLSWTSLALVGIDSHGKLSVLRLSPSMGHPLEVGLALRHLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVL

SEQ ID NO: 4926 - protein, 324 aa, Homo sapiens
MCDLRRPAAGGMMDLAYVCEWEKWSKSTHCPSVPLACAWSCRNLIAFTMDLRSDDQDLTRMIHILDTEHPWDLHSIPSEHHEAITCLEWDQSGSRLLSADADGQIKCWSMADHLANSWESSVGSLVEGDPIVALSWLHNGVKLALHVEKSGASSFGEKFSRVKFSPSLTLFGGKPMEGWIAVTVSGLVTVSLLFLLEYCMVTGYDWWDILLHVQPSMVQSLVEKLHEEYTRQTAALQQVLSTRILAMKASLCKLSPCTVTRVCDYHTKLFLIAISSTLKSLLRPHFLNTPDKSPGDRLTEICTKITDVDIDKVMINLKTEEFVL

SEQ ID NO: 4927 - protein, 200 aa, Homo sapiens
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYYSSSSSLCEANDLPLCEAYGRLDLDTDSADGLSAPLLASPEPSAGPLQVAAPAHSHAGGPGPTEHA

SEQ ID NO: 4928 - protein, 140 aa, Homo sapiens
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYYSSRYK

SEQ ID NO: 4929 - protein, 134 aa, Homo sapiens
MAQQRALPQSKETLLQSYNKRLKDDIKSIMDNFTEIIKTAKIEDETQVSRATQGEQDNYEMHVRAGESLMKLVSDLKQFLILNDFPSVNEAIDQRNQQLRTLQEECDRKLITLRDEISIDLYELEEEYYSSRYK

SEQ ID NO: 4930 - protein, 137 aa, Homo sapiens
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYYSS

SEQ ID NO: 4931 - protein, 111 aa, Homo sapiens
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEE

SEQ ID NO: 4932 - protein, 140 aa, Homo sapiens; identical to SEQ ID NO: 4928

SEQ ID NO: 4933 - protein, 140 aa, Homo sapiens; identical to SEQ ID NO: 4928

SEQ ID NO: 4934 - protein, 200 aa, Homo sapiens; identical to SEQ ID NO: 4927

SEQ ID NO: 4935 - protein, 135 aa, Homo sapiens
MAQQRALPQSKETLLQSYNKRLKDDIKSIMDNFTEIIKTAKIEDETQVSRATQGEQDNYEMHVRAANIVRAGESLMKLVSDLKQFLILNDFPSVNEAIDQRNQQLRTLQEECDRKLITLRDEISIDLYELEEEYY

SEQ ID NO: 4936 - protein, 131 aa, Homo sapiens
MAAAVAMETDDAGNRLRFQLELEFVQCLANPNYLNFLAQRGYFKDKAFVNYLKYLLYWKDPEYAKYLKYPQCLHMLELLQYEHFRKELVNAQCAKFIDEQQILHWQHYSRKRMRLQQALAEQQQQNNTSGK

SEQ ID NO: 4937 - protein, 246 aa, Homo sapiens
MAAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQDKVRPKAKRKEEPSSIFQRQRVDALLLDLRQKFPPKFVQLKPGEKPVPVDQTKKEAEPIPETVKPEEKETTKNVQQTVSAKGPPEKRMRLQ

SEQ ID NO: 4938 - protein, 253 aa, Homo sapiens
MAAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVSLFSFYKLTAVHGIQSAFDEAMSYCRYHPSKGYWWHFKDHEEQDKVRPKAKRKEEPSSIFQRQRVDALLLDLRQKFPPKFVQLKPGEKPVPVDQTKKEAEPIPETVKPEEKETTKNVQQTVSAKGPPEKRMRLQ

SEQ ID NO: 4939 - protein, 181 aa, Homo sapiens
MAAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQAKAWRKACSSGSNKERGRTYTRNCKT

SEQ ID NO: 4940 - protein, 249 aa, Homo sapiens
MAAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQDKVRPKAKRKEEPSSIFQRQRVDALLLDLRQKFPPKFVQLKPGEKPVPVDQTKKEAEPIPETVKPEEKETTKNVQQTVSAKGPPEKRMRLQKAV

SEQ ID NO: 4941 - protein, 301 aa, Homo sapiens
MQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQRPSCLGFILAIPLRRKVKKLLGQEGKKNAHLQLW

SEQ ID NO: 4942 - protein, 268 aa, Homo sapiens
MQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQR

SEQ ID NO: 4943 - protein, 415 aa, Homo sapiens
MTLAASSQRSQIIRSKFRSVLQLRIHRRNQEQISDPDPWISASDPPLAPALPSGTAPFLFSPGVLLPEPEYCPPWRSPKKESPKISQRWRESKPRGNLTYHQYMPPEPRQGSRADPQAEGSALGPPGPSLWEGTDSQQPHPRMKPSPLTPCPPGVPSPSPPPHKLELQTLKLEELTVSELRQQLRLRGLPVSGTKSMLLERMRGGAPPRERPKPRREDSPAGAPWPRLKPKALAAARRQGSVKPSAASHRPPLPRAADTPGTAPAPTPTPAPAAAPALTPSSGPGSAALTLEEELQEAIRRAQLLPNRGIDDILEDQVEPDDPLPPIPLDFPGSFDVLSPSPDSEGLSSVFSSSLPSPTNSSSPSPRDPTDSLDWLEALSGGPPLGSGPPPPSIFSADLSDSSSSRLWDLLEDPW

SEQ ID NO: 4944 - protein, 312 aa, Homo sapiens
MPPEPRQGSRADPQAEGSALGPPGPSLWEGTDSQQPHPRMKPSPLTPCPPGVPSPSPPPHKLELQTLKLEELTVSELRQQLRLRGLPVSGTKSMLLERMRGGAPPRERPKPRREDSPAGAPWPRLKPKALAAARRQGSVKPSAASHRPPLPRAADTPGTAPAPTPTPAPAAAPALTPSSGPGSAALTLEEELQEAIRRAQLLPNRGIDDILEDQVEPDDPLPPIPLDFPGSFDVLSPSPDSEGLSSVFSSSLPSPTNSSSPSPRDPTDSLDWLEALSGGPPLGSGPPPPSIFSADLSDSSSSRLWDLLEDPW

SEQ ID NO: 4945 - protein, 247 aa, Homo sapiens
MPPEPRQGSRADPQAEGSALGPPGPSLWEGTDSQQPHPRMKPSPLTPCPPGVPSPSPPPHKLELQTLKLEELTVKPSAASHRPPLPRAADTPGTAPAPTPTPAPAAAPALTPSSGPGSAALTLEEELQEAIRRAQLLPNRGIDDILEDQVEPDDPLPPIPLDFPGSFDVLSPSPDSEGLSSVFSSSLPSPTNSSSPSPRDPTDSLDWLEALSGGPPLGSGPPPPSIFSADLSDSSSSRLWDLLEDPW

SEQ ID NO: 4946 - protein, 312 aa, Homo sapiens; identical to SEQ ID NO: 4944

SEQ ID NO: 4947 - protein, 205 aa, Homo sapiens
MSKKKGLSAEEKRTRMMEIFSETKDVFQLKDLEKIAPKEKGITAMSVKEVLQSLVDDGMVDCERIGTSNYYWAFPSKALHARKHKLEVLESQLSEGSQKHASLQKSIEKAKIGRCETEERTRLAKELSSLRDQREQLKAEVEKYKDCDPQVVEEIRQANKVAKEAANRWTDNIFAIKSWAKRKFGFEENKIDRTFGIPEDFDYID

SEQ ID NO: 4948 - protein, 52 aa, Homo sapiens
MIDQSNRTGQGAAFSPEGQPIGGYTETQPHVAVRPPGSVGMSLNLEGEWHYL

SEQ ID NO: 4949 - protein, 358 aa, Homo sapiens
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 4950 - protein, 375 aa, Homo sapiens
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 4951 - protein, 421 aa, Homo sapiens
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSRRSEAPVLPDVCLGLGSPSPGPRWARPWGSDCGRPGRQSDSCWWLQHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 4952 - protein, 421 aa, Homo sapiens; identical to SEQ ID NO: 4951

SEQ ID NO: 4953 - protein, 421 aa, Homo sapiens; identical to SEQ ID NO: 4951

SEQ ID NO: 4954 - protein, 642 aa, Homo sapiens
MVSASQNEVPAAPLEELAYRRSLRVALDVLSEGSIWSQESSAGTGRADRSLRGKPMEHVSSPCDSNSSSLPRGDVLGSSRPHRRRPCVQQSLSSSFTCEKDPECKVDHKKGLRKSENPRGPLVLPAGGGAQDESGSRIHHKNWTLASKRGGNSAQKASLCLNGSSLSEDDTERDMGSKGGSWAAPSLPSGVREDDPCANAEGHDPGLPLGSLTAPPAPEPSACSEPGECPAKKRPRLDGSQRPPAVQLEPMAAGAAPSPGPGPGPRESVTPRSTARLGPPPSHASADATRCLPCPDSQKLEKECQSSEESMGSNSMRSILEEDEEDEEPPRVLLYHEPRSFEVGMLVWHKHKKYPFWPAVVKSVRQRDKKASVLYIEGHMNPKMKGFTVSLKSLKHFDCKEKQTLLNQAREDFNQDIGWCVSLITDYRVRLGCGSFAGSFLEYYAADISYPVRKSIQQDVLGTKLPQLSKGSPEEPVVGCPLGQRQPCRKMLPDRSRAARDRANQKLVEYIVKAKGAESHLRAILKSRKPSRWLQTFLSSSQYVTCVETYLEDEGQLDLVVKYLQGVYQEVGAKVLQRTNGDRIRFILDVLLPEAIICAISAVDEVDYKTAEEKYIKGPSLSYREKEIFDNQLLEERNRRRR

SEQ ID NO: 4955 - protein, 711 aa, Homo sapiens
MMADAKYVLCRWEKRLWPAKVLARTATSTKNKRRKEYFLAVQILSLEEKIKVKSTEVEILEKSQIEAIASSLASQNEVPAAPLEELAYRRSLRVALDVLSEGSIWSQESSAGTGRADRSLRGKPMEHVSSPCDSNSSSLPRGDVLGSSRPHRRRPCVQQSLSSSFTCEKDPECKVDHKKGLRKSENPRGPLVLPAGGGAQDESGSRIHHKNWTLASKRGGNSAQKASLCLNGSSLSEDDTERDMGSKGGSWAAPSLPSGVREDDPCANAEGHDPGLPLGSLTAPPAPEPSACSEPGECPAKKRPRLDGSQRPPAVQLEPMAAGAAPSPGPGPGPRESVTPRSTARLGPPPSHASADATRCLPCPDSQKLEKECQSSEESMGSNSMRSILEEDEEDEEPPRVLLYHEPRSFEVGMLVWHKHKKYPFWPAVVKSVRQRDKKASVLYIEGHMNPKMKGFTVSLKSLKHFDCKEKQTLLNQAREDFNQDIGWCVSLITDYRVRLGCGSFAGSFLEYYAADISYPVRKSIQQDVLGTKLPQLSKGSPEEPVVGCPLGQRQPCRKMLPDRSRAARDRANQKLVEYIVKAKGAESHLRAILKSRKPSRWLQTFLSSSQYVTCVETYLEDEGQLDLVVKYLQGVYQEVGAKVLQRTNGDRIRFILDVLLPEAIICAISAVDEVDYKTAEEKYIKGPSLSYREKEIFDNQLLEERNRRRR

SEQ ID NO: 4956 - protein, 74 aa, Homo sapiens
GGGGGGHIGVRPGSTLCQIIATCHMSVNDGGCYVLCRWEKRLWPAKVLARTATSTKNKRRKEYFLAVQILSLEE

SEQ ID NO: 4957 - protein, 732 aa, Homo sapiens
MMADAKYVLCRWEKRLWPAKVLARTATSTKNKRRKEYFLAVQILSLEEKIKVKSTEVEILEKSQIEAIASSLASQNEVPAAPLEELAYRRSLRVALDVLSEGSIWSQESSAGTGRADRSLRGKPMEHVSSPCDSNSSSLPRGDVLGSSRPHRRRPCVQQSLSSSFTCEKDPECKVDHKKGLRKSENPRGPLVLPAGGGAQDESGSRIHHKNWTLASKRGGNSAQKASLCLNGSSLSEDDTERDMGSKGGSWAAPSLPSGVREDDPCANAEGHDPGLPLGSLTAPPAPEPSACSEPGECPAKKRPRLDGSQRPPAVQLEPMAAGAAPSPGPGPGPRESVTPRSTARLGPPPSHASADATRCLPCPDSQKLEKECQSSEESMGSNSMRSILEEDEEDEEPPRVLLYHEPRSFEVGMLVWHKHKKYPFWPAVVKSVRQRDKKASVLYIEGHMNPKMKGFTVSLKSLKHFDCKEKQTLLNQAREDFNQDIGWCVSLITDYRVRLGCGSFAGSFLEYYAADISYPVRKSIQQDVLGTKLPQLSKGSPEEPVVGCPLGQRQPCRKMLPDRSRAARDRANQKLVEYIVKAKGAESHLRAILKSRKPSRWLQTFLSSSQYVTCVETYLEDEGQLDLVVKYLQGVYQEVGAKVLQRTNGDRIRFILDVLLPECWEMRVRALDPVRRRSRLLDPCAEMELLRSCQHQGVRTPSLLRAHRCFPASVGHHLCDLCGGRGGLQDG

SEQ ID NO: 4958 - protein, 166 aa, Homo sapiens
VLAASQNEVPAHPWKNWPTDGRVALDVLSEGSIWSQESSAGTGRADRSLRGKPMEHVSSPCDSNSSSLPRGDVLGSSRPHRRRPCVQQSLSSSFTCEKDPECKVDHKKGLRKSENPRGPLVLPAGGGAQDESGSRIHHKNWTLASKRGGNSAQKASLCLNGSSLSE

SEQ ID NO: 4959 - protein, 512 aa, Homo sapiens
MAEPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 4960 - protein, 370 aa, Homo sapiens
MPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGILQMLLPVHFSAISSRANAFLK

SEQ ID NO: 4961 - protein, 529 aa, Homo sapiens
MFMFNWFTDCLWTLFLSNYQPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 4962 - protein, 486 aa, Homo sapiens
MDGASSGGGGSSEGGGGSSGSGYGVVARFSQCLAEFRTWLRTNWLRFNADKTDVMLPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGILQMLLPVHFSAISSRANAFLK

SEQ ID NO: 4963 - protein, 450 aa, Homo sapiens
MFMFNWFTDCLWTLFLSNYQPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGILQMLLPVHFSAISSRANAFLK

SEQ ID NO: 4964 - protein, 533 aa, Homo sapiens
MCIRCLCLIGLQTVCGLFSCQITRPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 4965 - protein, 470 aa, Homo sapiens
MFMFNWFTDCLWTLFLSNYQPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGILQMLLPVHFSAISSRANAFLK

SEQ ID NO: 4966 - protein, 565 aa, Homo sapiens
MDGASSGGGGSSEGGGGSSGSGYGVVARFSQCLAEFRTWLRTNWLRFNADKTDVMLPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 4967 - protein, 433 aa, Homo sapiens
MAEPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGILQMLLPVHFSAISSRANAFLK

SEQ ID NO: 4968 - protein, 545 aa, Homo sapiens
MAEASSLGRQSPRVVSCLEHSLCPGEPGLQTTAVVSMGSGDHQFNLAEILSQNYSVRGECEEASRCPDKPKEELEKDFISQSNDMPFDELLALYGYEASDPISDRESEGGDVAPNLPDMTLDKEQIAKDLLSGEEEEETQSSADDLTPSVTSHEASDLFPNRSGSRFLADEDREPGSSASSDTEEDSLPANKCKKEIMVGPQFQADLSNLHLNRHCEKIYENEDQLLWDPSVLPEREVEEFLYRAVKRRWHEMAGPQLPEGEAVKDSEQALYELVKCNFNVEEALRRLRFNVKVIRDGLCAWSEEECRNFEHGFRVHGKNFHLIQANKVRTRSVGECVEYYYLWKKSERYDYFAQQTRLGRRKYVPSGTTDADQDLDGSDPDGPGRPRPEQDTLTGMRTDPLSVDGTAGGLDEPGVASDGLPSSEPGPCSFQQLDESPAVPLSHRPPALADPASYQPAVTAPEPDASPRLAVDFALPKELPLISSHVDLSGDPEETVAPAQVALSVTEFGLIGIGDVNPFLAAHPTCPAPGLHSEPLSHCNVMTC

SEQ ID NO: 4969 - protein, 550 aa, Homo sapiens
MAEASFGSSSPVGSLSSEDHDFDPTAEMLVHDYDDERTLEEEEMMDEGKNFSSEIEDLEKEGTMPLEDLLAFYGYEPTIPAVANSSANSSPSELADELPDMTLDKEEIAKDLLSGDDEETQSSADDLTPSVTSHETSDFFPRPLRSNTACDGDKESEVEDVETDSGNSPEDLRKEIMIGLQYQAEIPPYLGEYDGNEKVYENEDQLLWCPDVVLESKVKEYLVETSLRTGSEKIMDRISAGTHTRDNEQALYELLKCNHNIKEAIERYCCNGKASQEGMTAWTEEECRSFEHALMLFGKDFHLIQKNKVRTRTVAECVAFYYMWKKSERYDYFAQQTRFGKKRYNHHPGVTDYMDRLVDETEALGGTVNASALTSNRPEPIPDQQLNILNSFTASDLTALTNSVATVCDPTDVNCLDDSFPPLGNTPRGQVNHVPVVTEELLTLPSNGESDCFNLFETGFYHSELNPMNMCSEESERPAKRLKMGIAVPESFMNEVSVNNLGVDFENHTHHITSAKMAVSVADFGSLSANETNGFISAHALHQHAALHSE

SEQ ID NO: 4970 - protein, 549 aa, Homo sapiens
MAEASFGSSSPVGSLSSEDHDFDPTAEMLVHDYDDERTLEEEEMMDEGKNFSSEIEDLEKEGTMPLEDLLAFYGYEPTIPAVANSSANSSPSELADELPDMTLDKEEIAKDLLSGDDEETQSSADDLTPSVTSHETSDFFPRPLRSNTACDGDKESEVEDVETDSGNSPEDLRKEIMIGLQYQAEIPPYLGEYDGNEKVYENEDQLLWCPDVVLESKVKEYLVETSLRTGSEKIMDRISAGTHTRDNEQALYELLKCNHNIKEAIERYCCNGKASQGMTAWTEEECRSFEHALMLFGKDFHLIQKNKVRTRTVAECVAFYYMWKKSERYDYFAQQTRFGKKRYNHHPGVTDYMDRLVDETEALGGTVNASALTSNRPEPIPDQQLNILNSFTASDLTALTNSVATVCDPTDVNCLDDSFPPLGNTPRGQVNHVPVVTEELLTLPSNGESDCFNLFETGFYHSELNPMNMCSEESERPAKRLKMGIAVPESFMNEVSVNNLGVDFENHTHHITSAKMAVSVADFGSLSANETNGFISAHALHQHAALHSE

SEQ ID NO: 4971 - protein, 268 aa, Homo sapiens
MAQPLCPPLSESWMLSAAWGPTRRPPPSDKDCGRSLVSSPDSWGSTPADSPVASPARPGTLRDPRAPSVGRRGARSSRLGSGQRQSASEREKLRMRTLARALHELRRFLPPSVAPAGQSLTKIETLRLAIRYIGHLSAVLGLSEESLQRRCRQRGDAGSPRGCPLCPDDCPAQMQTRTQAEGQGQGRGLGLVSAVRAGASWGSPPACPGARAAPEPRDPPALFAEAACPEGQAMEPSPPSPLLPGDVLALLETWMPLSPLEWLPEEPK

SEQ ID NO: 4972 - protein, 668 aa, Homo sapiens
MAANMYRVGDYVYFENSSSNPYLVRRIEELNKTANGNVEAKVVCLFRRRDISSSLNSLADSNAREFEEESKQPGVSEQQRHQLKHRELFLSRQFESLPATHIRGKCSVTLLNETDILSQYLEKEDCFFYSLVFDPVQKTLLADQGEIRVGCKYQAEIPDRLVEGESDNRNQQKMEMKVWDPDNPLTDRQIDQFLVVARAVGTFARALDCSSSIRQPSLHMSAAAASRDITLFHAMDTLQRNGYDLAKAMSTLVPQGGPVLCRDEMEEWSASEAMLFEEALEKYGKDFNDIRQDFLPWKSLASIVQFYYMWKTTDRYIQQKRLKAAEADSKLKQVYIPTYTKPNPNQIISVGSKPGMNGAGFQKGLTCESCHTTQSAQWYAWGPPNMQCRLCASCWIYWKKYGGLKTPTQLEGATRGTTEPHSRGHLSRPEAQSLSPYTTSANRAKLLAKNRQTFLLQTTKLTRLARRMCRDLLQPRRAARRPYAPINANAIKAECSIRLPKAAKTPLKIHPLVRLPLATIVKDLVAQAPLKPKTPRGTKTPINRNQLSQNRGLGGIMVKRAYETMAGAGVPFSANGRPLASGIRSSSQPAAKRQKLNPADAPNPVVFVATKDTRALRKALTHLEMRRAARRPNLPLKVKPTLIAVRPPVPLPAPSHPASTNEPIVLED

SEQ ID NO: 4973 - protein, 495 aa, Homo sapiens
MEMKVWDPDNPLTDRQIDQFLVVARAVGTFARALDCSSSIRQPSLHMSAAAASRDITLFHAMDTLQRNGYDLAKAMSTLVPQGGPVLCRDEMEEWSASEAMLFEEALEKYGKDFNDIRQDFLPWKSLASIVQFYYMWKTTDRYIQQKRLKAAEADSKLKQVYIPTYTKPNPNQIISVGSKPGMNGAGFQKGLTCESCHTTQSAQWYAWGPPNMQCRLCASCWIYWKKYGGLKTPTQLEGATRGTTEPHSRGHLSRPEAQSLSPYTTSANRAKLLAKNRQTFLLQTTKLTRLARRMCRDLLQPRRAARRPYAPINANAIKAECSIRLPKAAKTPLKIHPLVRLPLATIVKDLVAQAPLKPKTPRGTKTPINRNQLSQNRGLGGIMVKRAYETMAGAGVPFSANGRPLASGIRSSSQPAAKRQKLNPADAPNPVVFVATKDTRALRKALTHLEMRRAARRPNLPLKVKPTLIAVRPPVPLPAPSHPASTNEPIVLED

SEQ ID NO: 4974 - protein, 495 aa, Homo sapiens; identical to SEQ ID NO: 4973

SEQ ID NO: 4975 - protein, 586 aa, Homo sapiens
MAANMYRVGDYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAEYADRHAELSGSPLKSKSTRKPLACIIGYLEIHPAKKPNVIRSTPSLQTPTTKRMLTTPNHTSLSILGKRNYSHHNGLD

SEQ ID NO: 4976 - protein, 594 aa, Homo sapiens
MAANMYRVGDYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAEYADRHAELSGSPLKSKSTRKPLACIIGYLEIHPAKKPNVIRSTPSLQTPTTKRMLTTPNHTSLSILGKRNYSHHNGLDELTCCVSD

SEQ ID NO: 4977 - protein, 515 aa, Homo sapiens
MAANMYRVGDYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAECKMLLNS

SEQ ID NO: 4978 - protein, 194 aa, Homo sapiens
MAKSSQRKQRDCVNQCKSKPGLSTSIPLRMSSYTFKRPVTRITPHPGNEVRYHQWEESLEKPQQVCWQRRLQGLQAYSSAGELSSTLDLANTLQKLVPSYTGGSLLEDLASGLEHSCPMPHLACSSDAVEIIPAEGVGISQLLCKQFLVTEEDIRKQEGKVKTVRERLAIALIADGLANEAEKVRDQEGRPEKR

SEQ ID NO: 4979 - protein, 414 aa, Homo sapiens
MLGALPLPLSLGQPPPSPLLNHSLFGVLTGGGGQPPPEPLLPPPGGPGPPLAPGEPEGPSLLVASLLPPPPSDLLPPPSAPPSNLLASFLPLLALGPTAGDGEGSAEGAGGPSGEPFSGLGDLSPLLFPPLSAPPTLIALNSALLAATLDPPSGTPPQPCVLSAPQPGPPTSSVTTATTDPGASSLGKAPSNSGRPPQLLSPLLGASLLGDLSSLTSSPGALPSLLQPPGPLLSGQLGLQLLPGGGAPPPLSEASSPLACLLQSLQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERQEEPTIGSIMGSWLKGVLSPRIHPLPGPILRTLRCPSSQKVSSWP

SEQ ID NO: 4980 - protein, 1003 aa, Homo sapiens
MNGGNESSGADRAGGPVATSVPIGWQRCVREGAVLYISPSGTELSSLEQTRSYLLSDGTCKCGLECPLNVPKVFNFDPLAPVTPGGAGVGPASEEDMTKLCNHRRKAVAMATLYRSMETTCSHSSPGEGASPQMFHTVSPGPPSARPPCRVPPTTPLNGGPGSLPPEPPSVSQAFPTLAGPGGLFPPRLADPVPSGGSSSPRFLPRGNAPSPAPPPPPAISLNAPSYNWGAALRSSLVPSDLGSPPAPHASSSPPSDPPLFHCSDALTPPPLPPSNNLPAHPGPASQPPVSSATMHLPLVLGPLGGAPTVEGPGAPPFLASSLLSAAAKAQHPPLPPPSTLQGRRPRAQAPSASHSSSLRPSQRRPRRPPTVFRLLEGRGPQTPRRSRPRAPAPVPQPFSLPEPSQPILPSVLSLLGLPTPGPSHSDGSFNLLGSDAHLPPPPTLSSGSPPQPRHPIQPSLPGTTSGSLSSVPGAPAPPAASKAPVVPSPVLQSPSEGLGMGAGPACPLPPLAGGEAFPFPSPEQGLALSGAGFPGMLGALPLPLSLGQPPPSPLLNHSLFGVLTGGGGQPPPEPLLPPPGGPGPPLAPGEPEGPSLLVASLLPPPPSDLLPPPSAPPSNLLASFLPLLALGPTAGDGEGSAEGAGGPSGEPFSGLGDLSPLLFPPLSAPPTLIALNSALLAATLDPPSGTPPQPCVLSAPQPGPPTSSVTTATTDPGASSLGKAPSNSGRPPQLLSPLLGASLLGDLSSLTSSPGALPSLLQPPGPLLSGQLGLQLLPGGGAPPPLSEASSPLACLLQSLQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPAKNKRRKLAP

SEQ ID NO: 4981 - protein, 1003 aa, Homo sapiens; identical to SEQ ID NO: 4980

SEQ ID NO: 4982 - protein, 53 aa, Homo sapiens
MNGGNESSGADRAGGPVATSVPIGWQRCVREGAVLYISPSGTELSSLEQTRSY

SEQ ID NO: 4983 - protein, 73 aa, Homo sapiens
MNGGNESSGADRAGGPVATSVPIGWQRCVREGAVLYISPSGTELSSLEQTRSYLLSDGTCKCGLECPLNVPKV

SEQ ID NO: 4984 - protein, 148 aa, Homo sapiens
MNGGNESSGADRAGGPVATSVPIGWQRCVREGAVLYISPSGTELSSLEQTRSYLLSDGTCKCGLECPLNVPKVFNFDPLAPVTPGGAGVGPASEEDMTKLCNHRRKAVAMATLYRSMETTCSHSSPGEGASPQMFHTVSPGPPSARPP

SEQ ID NO: 4985 - protein, 53 aa, Homo sapiens; identical to SEQ ID NO: 4982

SEQ ID NO: 4986 - protein, 45 aa, Homo sapiens
MNGGNESSGADRAGGPVATSVPIGWQRCVREGAVLYISPSGTELS

SEQ ID NO: 4987 - protein, 223 aa, Homo sapiens
MTSEVIEDEKQFYSKAKTYWKQIPPTVDGMLGGYGHISSIDINSSRKFLQRFLREGPNKTGTSCALDCGAGIGRITKRLLLPLFREVDMVDITEDFLVQAKTYLGEEGKRVRNYFCCGLQDFTPEPDSYDVIWIQWVIGHLTDQHLAEFLRRCKGSLRPNGIIVIKDNMAQEGVILDDVDSSVCRDLDVVRRIICSAGLSLLAEERQENLPDEIYHVYSFALR

SEQ ID NO: 4988 - protein, 145 aa, Homo sapiens
MTSEVIEDEKQFYSKAKTYWKQIPPTVDGMLGGYGHISSIDINSSRKFLQRFLREGPNKTGTSCALDCGAGIGRITKRLLLPLFREVDMVDITEDFLVQAKTYLGEEGKRATSPISTWPSSCGAARAASAPTASSSSKTTWPRRA

SEQ ID NO: 4989 - protein, 223 aa, Homo sapiens; identical to SEQ ID NO: 4987

SEQ ID NO: 4990 - protein, 223 aa, Homo sapiens; identical to SEQ ID NO: 4987

SEQ ID NO: 4991 - protein, 456 aa, Homo sapiens
MDSRLQEIRERQKLRRQLLAQQLGAESADSIGAVLNSKDEQREIAETRETCRASYDTSAPNAKRKYLDEGETDEDKMEEYKDELEMQQDEENLPYEEEIYKDSSTFLKGTQSLNPHNDYCQHFVDTGHRPQNFIRDVGLADRFEEYPKLRELIRLKDELIAKSNTPPMYLQADIEAFDIRELTPKFDVILLEPPLEEYYRETGITANEKCWTWDDIMKLEIDEIAAPRSFIFLWCGSGEGLDLGRVCLRKWGYRRCEDICWIKTNKNNPGKTKTLDPKAVFQRTKEHCLMGIKGTVKRSTDGDFIHANVDIDLIITEEPEIGNIEKPVEIFHIIEHFCLGRRRLHLFGRDSTIRPGWLTVGPTLTNSNYNAETYASYFSAPNSYLTGCTEEIERLRPKSPPPKSKSDRGGGAPRGGGRGGTSAGRGRERNRSNFRGERGGFRGGRGGAHRGGFPPR

SEQ ID NO: 4992 - protein, 1132 aa, Homo sapiens
MIATPLKHSRIYLPPEASSQRRNLPMDAIFFDSIPSGTLTPVKDLVKYQNSSLKLNDHKKNQFLKMTTFNNKNIFQSTMLTEATTSNSSLDISAIKPNKDGLKNKANYESPGKIFLRMKEKVLRDKQEQPSRNSSLLEPQKSGNNETFTPNRVEKKKLQHTYLCEEKENNKSFQSDDSSLRASVQGVPLESSNNDIFLPVKQKIQCQQEKKAPLHNLTYELPTLNQEQENFLAVEARNKTLTRAQLAKQIFHSKESIVATTKSKKDTFVLESVDSADEQFQNTNAETLSTNCIPIKNGSLLMVSDSERTTEGTSQQKVKEGNGKTVPGETGLPGSMKDTCKIVLATPRLHITIPRRSKRNISKLSPPRIFQTVTNGLKKNQVVQLQEWMIKSINNNTAICVEGKLIDVTNIYWHSNVIIERIEHNKLRTISGNVYILKGMIDQISMKEAGYPNYLIRKFMFGFPENWKEHIDNFLEQLRAGEKNREKTKQKQKTGRSVRDIRKSMKNDARENQTDTAQRATTTYDFDCDNLELKSNKHSESPGATELNMCHSNCQNKPTLRFPDDQVNNTIQNGGGDDLSNQELIGKKEYKMSSKKLKIGERTNERIIKSQKQETTEELDVSIDILTSREQFFSDEERKYMAINQKKAYILVTPLKSRKVIEQRCMRYNLSAGTIKAVTDFVIPECQKKSPISKSMGTLENTFEGHKSKNKEDCDERDLLTVNRKIKISNLEKEQMLTSDFKKNTRLLPKLKKIENQVAMSFYKHQSSPDLSSEESETEKEIKRKAEVKKTKAGNTKEAVVHLRKSTRNTSNIPVILEPETEESENEFYIKQKKARPSVKETLQKSGVRKEFPITEAVGSDKTNRHPLECLPGLIQDKEWNEKELQKLHCAFASLPKHKPGFWSEVAAAVGSRSPEECQRKYMENPRGKGSQKHVTKKKPANSKGQNGKRGDADQKQTIKITAKVGTLKRKQQMREFLEQLPKDDHDDFFSTTPLQHQRILLPSFQDSEDDDDILPNMDKNPTTPSSVIFPLVKTPQCQHVSPGMLGSINRNDCDKYVFRMQKYHKSNGGIVWGNIKKKLVETDFSTPTPRRKTPFNTDLGENSGIGKLFTNAVESLDEEEKDYYFSNSDSA

SEQ ID NO: 4993 - protein, 155 aa, Homo sapiens
MIATPLKHSRIYLPPEASSQRRNLPMDAIFFDSIPSGTLTPVKDLVKYQNSSLKLNDHKKNQFLKMTTFNNKNIFQSTMLTEATTSNSSLDISAIKPNKDGLKNKANYESPGKIFLRMKEKVLRDKQEQPSRNSSLLEPQKSGNNETFTPNRVEK

SEQ ID NO: 4994 - protein, 233 aa, Homo sapiens
MAGVRSLRCSRGCAGGCECGDKGKCSDSSLLGKRLSEDSSRHQLLQKWASMWSSMSEDASVADMERAQLEEEAAAAEERPLVFLCSGCRRPLGDSLSWVASQEDTNCILLRCVSCNVSVDKEQKLSKREKENGCVLETLCCAGCSLNLGYVYRCTPKNLDYKRDLFCLSVEAIESYVLGSSEKQIVSEDKELFNLESRVEIEKSLTQMEDVLKALQMKLWEAESKLSFATCKS

SEQ ID NO: 4995 - protein, 1049 aa, Homo sapiens
MDHTGAIDTEDEVGPLAHLAPSPQSEAVAHEFQELSLQSSQNLPPLNERKNVLQLRLQQRRTREQLVDQGIMPPLKSPAAFHEQIKSLERARTENFLKHKIRSRPDRSELVRMHILEETFAEPSLQATQMKLKRARLADDLNEKIAQRPGPMELVEKNILPVDSSVKEAIIGVGKEDYPHTQGDFSFDEDSSDALSPDQPASQESQGSAASPSEPKVSESPSPVTTNTPAQFASVSPTVPEFLKTPPTADQPPPRPAAPVLPTNTVSSAKPGPALVKQSHPKNPNDKHRSKKCKDPKPRVKKLKYHQYIPPDQKGEKNEPQMDSNYARLLQQQQLFLQLQILSQQKQHYNYQTILPAPFKPLNDKNSNSGNSALNNATPNTPRQNTSTPVRKPGPLPSSLDDLKVSELKTELKLRGLPVSGTKPDLIERLKPYQEVNSSGLAAGGIVAVSSSAIVTSNPEVTVALPVTTLHNTVTSSVSTLKAELPPTGTSNATRVENVHSPLPISPSPSEQSSLSTDDTNMADTFTEIMTMMSPSQFLSSSPLRMTNNEDSLSPTSSTLSNLELDAAEKDRKLQEKEKQIEELKRKLEQEQKLVEVLKMQLEVEKRGQQQRPLEAQPSAPGHSVKSDQKHGSLGSSIKDEASLPDCSSSRQPIPVASHAVGQPVSTGGQTLVAKKAVVIKQEVPVGQAEQQSVVSQFYTSPQAGMQTQPQIATAAQIPTAALASGLAPTVPQTQDTFPQHVLSQPQQVRKVFTNSASSNTVLPYQRHPAPAVQQPFINKASNSVLQSRNAPLPSLQNGPNTPNKPSSPPPPQQFVVQHSLFGSPVAKTKDPPRYEEAIKQTRSTQAPLPEISNAHSQQMDDLFDILIKSGEISLPIKEEPSPISKMRPVTASITTMPVNTVVSRPPPQVQMAPPVSLEPMGSLSASLENQLEAFLDGTLPSANEIPPLQSSSEDREPFSLIEDLQNDLLSHSGMLDHSHSPMETSETQFAAGTPCLSLDLSDSNLDNMEWLDITMPNSSSGLTPLSTTAPSMFSADFLDPQDLPLPWD

SEQ ID NO: 4996 - protein, 1088 aa, Homo sapiens
MIDSSKKQQQGFPEILTAGDFEPLKEKECLEGSNQKSLKEVLQLRLQQRRTREQLVDQGIMPPLKSPAAFHEQIKSLERARTENFLKHKIRSRPDRSELVRMHILEETFAEPSLQATQMKLKRARLADDLNEKIAQRPGPMELVEKNILPVDSSVKEAIIGVGKEDYPHTQGDFSFDEDSSDALSPDQPASQESQGSAASPSEPKVSESPSPVTTNTPAQFASVSPTVPEFLKTPPTADQPPPRPAAPVLPTNTVSSAKPGPALVKQSHPKNPNDKHRSKKCKDPKPRVKKLKYHQYIPPDQKGEKNEPQMDSNYARLLQQQQLFLQLQILSQQKQHYNYQTILPAPFKPLNDKNSNSGNSALNNATPNTPRQNTSTPVRKPGPLPSSLDDLKVSELKTELKLRGLPVSGTKPDLIERLKPYQEVNSSGLAAGGIVAVSSSAIVTSNPEVTVALPVTTLHNTVTSSVSTLKAELPPTGTSNATRVENVHSPLPISPSPSEQSSLSTDDTNMADTFTEIMTMMSPSQFLSSSPLRMTNNEDSLSPTSSTLSNLELDAAEKDRKLQEKEKQIEELKRKLEQEQKLVEVLKMQLEVEKRGQQQRPLEAQPSAPGHSVKSDQKHGSLGSSIKDEASLPDCSSSRQPIPVASHAVGQPVSTGGQTLVAKKAVVIKQEVPVGQAEQQSVVSQFYVSSQGQPPPAVVAQPQALLTTQTAQLLLPVSIQGSSVTSVQLPVGSLKLQTSPQAGMQTQPQIATAAQIPTAALASGLAPTVPQTQDTFPQHVLSQPQQVRKVFTNSASSNTVLPYQRHPAPAVQQPFINKASNSVLQSRNAPLPSLQNGPNTPNKPSSPPPPQQFVVQHSLFGSPVAKTKDPPRYEEAIKQTRSTQAPLPEISNAHSQQMDDLFDILIKSGEISLPIKEEPSPISKMRPVTASITTMPVNTVVSRPPPQVQMAPPVSLEPMGSLSASLENQLEAFLDGTLPSANEIPPLQSSSEDREPFSLIEDLQNDLLSHSGMLDHSHSPMETSETQFAAGTPCLSLDLSDSNLDNMEWLDITMPNSSSGLTPLSTTAPSMFSADFLDPQDLPLPWD

SEQ ID NO: 4997 - protein, 460 aa, Homo sapiens
MIDSSKKQQQGFPEILTAGDFEPLKEKECLEGSNQKSLKEVLQLRLQQRRTREQLVDQGIMPPLKSPAAFHEQIKSLERARTENFLKHKIRSRPDRSELVRMHILEETFAEPSLQATQMKLKRARLADDLNEKIAQRPGPMELVEKNILPVDSSVKEAIIGVGKEDYPHTQGDFSFDEDSSDALSPDQPASQESQGSAASPSEPKVSESPSPVTTNTPAQFASVSPTVPEFLKTPPTADQPPPRPAAPVLPTNTVSSAKPGPALVKQSHPKNPNDKHRSKKCKDPKPRVKKLKYHQYIPPDQKGEKNEPQMDSNYARLLQQQQLFLQLQILSQQKQHYNYQTILPAPFKYGGAHAILNAGFSVFMRNYKLPKVECCHLFVLSNDFHFFVIRAYHTVSEVHMVRVACIPFQFLSSKIGSEFLQVRNAFSQLFIQICLLLEHQNSTRCSEKSVSSIIPGINS

SEQ ID NO: 4998 - protein, 1243 aa, Homo sapiens
MENCSAASTFLTDSLELELGTEWCKPPYFSCAVDNRGGGKHFSGESYLCSGALKRLILNLDPLPTNFEEDTLEIFGIQWVTETALVNSSRELFHLFRQQLYNLETLLQSSCDFGKVSTLHCKADNIRQQCVLFLHYVKVFIFRYLKVQNAESHVPVHPYEALEAQLPSVLIDELHGLLLYIGHLSELPSVNIGAFVNQNQIKLFPPSWHLLHLHLDIHWLVLEILYMLGEKLKQVVYGHQFMNLASDNLTNISLFEEHCETLLCDLISLSLNRYDKVRSSESLMSDQCPCLCIKELWVLLIHLLDHRSKWFVSESFWNWLNKLLKTLLEKSSDRRRSSMPVIQSRDPLGFSWWIITHVASFYKFDRHGVPDEMRKVESNWNFVEELLKKSISVQGVILEEQLRMYLHCCLTLCDFWEPNIAIVTILWEYYSKNLNSSFSISWLPFKGLANTMKSPLSMLEMVKTCCCDKQDQELYKSSSSYTIFLCILAKVVKKAMKSNGPHPWKQVKGRIYSKFHQKRMEELTEVGLQNFFSLFLLLAAVAEVEDVASHVLDLLNFLKPAFVTSQRALIWKGHMAFLLMYAQKNLDIGVLAEKFSCAFREKAKEFLVSKNEEMVQRQTIWTLLSIYIDGVQEVFETSYCLYPSHEKLLNDGFSMLLRACRESELRTVLSFLQAVLARIRSMHQQLCQELQRDNVDLFVQSSLSAKERHLAAVASALWRHFFSFLKSQRMSQVVPFSQLADAAADFTLLAMDMPSTAPSDFQPQPVISIIQLFGWDDIICPQVVARYLSHVLQNSTLCEALSHSGYVSFQALTVRSWIRCVLQMYIKNLSGPDDLLIDKNLEEAVEKEYMKQLVKLTRLLFNLSEVKSIFSKAQVEYLSISEDPKKALVRFFEAVGVTYGNVQTLSDKSAMVTKSLEYLGEVLKYIKPYLGKKVFSAGLQLTYGMMGILVKSWAQIFATSKAQKLLFRIIDCLLLPHAVLQQEKELPAPMLSAIQKSLPLYLQGMCIVCCQSQNPNAYLNQLLGNVIEQYIGRFLPASPYVSDLGQHPVLLALRNTATIPPISSLKKCIVQVIRKSYLEYKGSSPPPRLASILAFILQLFKETNTDIYEVELLLPGILKCLVLVSEPQVKRLATENLQYMVKACQVGSEEEPSSQLTSVFRQFIQDYGMRYYYQVYSILETVATLDQQVVIHLISTLTQSLKDSEQKWGLGRNIAQREAYSKLLSHLGQMGQDEMQRLENDNT

SEQ ID NO: 4999 - protein, 288 aa, Homo sapiens
MSSRKQGSQPRGQQSAEEENFKKPTRSNMQRSKMRGASSGKKTAGPQQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAILEEYANCKKSQGNVDNKEYAVNEVVAGIKEYFNVMLGTQLLYKFERPQYAEILLAHPDAPMSQVYGAPHLLRLFVRIGAMLAYTPLDEKSLALLLGYLHDFLKYLAKNSASLFTASDYKVASAEYHRKAL

SEQ ID NO: 5000 - protein, 270 aa, Homo sapiens
MSSRKQGSQPRGQQSAEEENFKKPTRSNMQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAILEEYANCKKSQGNVDNKEYAVNEVVAGIKEYFNVMLGTQLLYKFERPQYAEILLAHPDAPMSQVYGAPHLLRLFVRIGAMLAYTPLDEKSLALLLGYLHDFLKYLAKNSASLFTASDYKVASAEYHRKAL

SEQ ID NO: 5001 - protein, 170 aa, Homo sapiens
MEVKVKIPEELKPWLVEDWDLVTRQKQLFQLPAKKNVDAILEEYANCKKSQGNVDNKEYAVNEVVAGIKEYFNVMLGTQLLYKFERPQYAEILLAHPDAPMSQVYGAPHLLRLFVRIGAMLAYTPLDEKSLALLLGYLHDFLKYLAKNSASLFTASDYKVASAEYHRKAL

SEQ ID NO: 5002 - protein, 177 aa, Homo sapiens
MSSRKQGSQPRGQQSAEEENFKKPTRSNMQRSKMRGASSGKKTAGPQQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAILEEYANCKKSQGNVDNKEY

SEQ ID NO: 5003 - protein, 288 aa, Homo sapiens; identical to SEQ ID NO: 4999

SEQ ID NO: 5004 - protein, 67 aa, Homo sapiens
MSSRKQGSQPRGQQSAEEENFKKPTRSNMQRSKMRGASSGKKTAGPQQKNLEPALPGRWGGRSAENP

SEQ ID NO: 5005 - protein, 288 aa, Homo sapiens; identical to SEQ ID NO: 4999

SEQ ID NO: 5006 - protein, 288 aa, Homo sapiens; identical to SEQ ID NO: 4999

SEQ ID NO: 5007 - protein, 178 aa, Homo sapiens
MSSRKQGSQPRGQQSAEEENFKKPTRSNMQRSKMRGASSGKKTAGPQQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAILEEYANCKKSQGNVDNKEYA

SEQ ID NO: 5008 - protein, 288 aa, Homo sapiens; identical to SEQ ID NO: 4999

SEQ ID NO: 5009 - protein, 158 aa, Homo sapiens
MSSRKQGSQPRGQQSAEEENFKKPTRSNMQRSKMRGASSGKKTAGPQQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAI

SEQ ID NO: 5010 - protein, 288 aa, Homo sapiens; identical to SEQ ID NO: 4999

SEQ ID NO: 5011 - protein, 681 aa, Homo sapiens
MAPQVWRRRTLERCLTEVGKATGRPECFLTIQEGLASKFTSLTKVLYDFNKILENGRIHGSPLQKLVIENFDDEQIWQQLELQNEPILQYFQNAVSETINDEDISLLPESEEQEREEDGSEIEADDKEDLEDLEEEEVSDMGNDDPEMGERAENSSKSDLRKSPVFSDEDSDLDFDISKLEQQSKVQNKGQGKPREKSIVDDKFFKLSEMEAYLENIEKEEERKDDNDEEEEDIDFFEDIDSDEDEGGLFGSKKLKSGKSSRNLKYKDFFDPVESDEDITNVHDDELDSNKEDDEIAEEEAEELSISETDEDDDLQENEDNKQHKESLKRVTFALPDDAETEDTGVLNVKKNSDEVKSSFEKRQEKMNEKIASLEKELLEKKPWQLQGEVTAQKRPENSLLEETLHFDHAVRMAPVITEETTLQLEDIIKQRIRDQAWDDVVRKEKPKEDAYEYKKRLTLDHEKSKLSLAEIYEQEYIKLNQQKTAEEENPEHVEIQKMMDSLFLKLDALSNFHFIPKPPVPEIKVVSNLPAITMEEVAPVSVSDAALLAPEEIKEKNKAGDIKTAAEKTATDKKRERRKKKYQKRMKIKEKEKRRKLLEKSSVDQAGKYSKTVASEKLKQLTKTGKASFIKDEGKDKALKSSQAFFSKLQDQVKMQINDAKKTEKKKKKRQDISVHKLKL

SEQ ID NO: 5012 - protein, 239 aa, Homo sapiens
MPKSKRDKKVSLTKTAKKGLELKQNLIEELRKCVDTYKYLFIFSVANMRNSKLKDIRNAWKHSRMFFGKNKVMMVALGRSPSDEYKDNLHQVSKRLRGEVGLLFTNRTKEEVNEWFTKYTEMDYARAGNKAAFTVSLDPGPLEQFPHSMEPQLRQLGLPTALKRGVVTLLSDYEVCKEGDVLTPEQARVLKLFGYEMAEFKVTIKYMWDSQSGRFQQMGDDLPESASESTEESDSEDDD

SEQ ID NO: 5013 - protein, 206 aa, Homo sapiens
MSTGSVSDPEEMELRGLQREYPVPASKRPPLRGVERSYASPSDNSSAEEEDPDGEEERCALGTAGSAEGCKRKRPRVAGGGGAGGSAGGGGKKPLPAKGSAAECKQSQRNAANARERARMRVLSKAFSRLKTSLPWVPPDTKLSKLDTLRLASSYIAHLRQLLQEDRYENGYVHPVNLTWPFVVSGRPDSDTKEVSAANRLCGTTA

SEQ ID NO: 5014 - protein, 82 aa, Homo sapiens
MSQAGAQEAPIKKKRPPVKDEDLKGARGNLTKNQEIKSKTYQVMRECEQAGSAAPSVFSRTRTGTETVFEKPKAGPTKSVFG

SEQ ID NO: 5015 - protein, 835 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 5016 - protein, 822 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTPPGDLRFTPIPLLIPSQVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYLTMETCEDGNDLVFFYQVSDLIRSGKPIKPVKDLLKKNQMENCQTLVDKFMKLDLEDPNLDLNVFMSQEVLPAATSIL

SEQ ID NO: 5017 - protein, 851 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTPPGDLRFTPIPLLIPSQVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 5018 - protein, 834 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 5019 - protein, 834 aa, Homo sapiens; identical to SEQ ID NO: 5018

SEQ ID NO: 5020 - protein, 271 aa, Homo sapiens
MFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLDWPRVSGQEGGD

SEQ ID NO: 5021 - protein, 333 aa, Homo sapiens
KILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVYLSPQVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLG

SEQ ID NO: 5022 - protein, 508 aa, Homo sapiens
MWPVLLFVFLSQTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 5023 - protein, 834 aa, Homo sapiens; identical to SEQ ID NO: 5018

SEQ ID NO: 5024 - protein, 835 aa, Homo sapiens; identical to SEQ ID NO: 5015

SEQ ID NO: 5025 - protein, 194 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRR

SEQ ID NO: 5026 - protein, 194 aa, Homo sapiens; identical to SEQ ID NO: 5025

SEQ ID NO: 5027 - protein, 834 aa, Homo sapiens; identical to SEQ ID NO: 5018

SEQ ID NO: 5028 - protein, 194 aa, Homo sapiens; identical to SEQ ID NO: 5025

SEQ ID NO: 5029 - protein, 533 aa, Homo sapiens
MAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 5030 - protein, 835 aa, Homo sapiens; identical to SEQ ID NO: 5015

SEQ ID NO: 5031 - protein, 333 aa, Homo sapiens; identical to SEQ ID NO: 5021

SEQ ID NO: 5032 - protein, 835 aa, Homo sapiens; identical to SEQ ID NO: 5015

SEQ ID NO: 5033 - protein, 821 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTPPGDLRFTPIPLLIPSQVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVSDLIRSGKPIKPVKDLLKKNQMENCQTLVDKFMKLDLEDPNLDLNVFMSQEVLPAATSIL

SEQ ID NO: 5034 - protein, 508 aa, Homo sapiens; identical to SEQ ID NO: 5022

SEQ ID NO: 5035 - protein, 834 aa, Homo sapiens; identical to SEQ ID NO: 5018

SEQ ID NO: 5036 - protein, 834 aa, Homo sapiens; identical to SEQ ID NO: 5018

SEQ ID NO: 5037 - protein, 194 aa, Homo sapiens; identical to SEQ ID NO: 5025

SEQ ID NO: 5038 - protein, 822 aa, Homo sapiens; identical to SEQ ID NO: 5016

SEQ ID NO: 5039 - protein, 156 aa, Homo sapiens
TAQSLVLIDEFGKGTNTVDGLALLAAVLRHWLARGPTCPHIFVATNFLSLVQLQLLPQGPLVQYLVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 5040 - protein, 834 aa, Homo sapiens; identical to SEQ ID NO: 5018

SEQ ID NO: 5041 - protein, 834 aa, Homo sapiens; identical to SEQ ID NO: 5018

SEQ ID NO: 5042 - protein, 156 aa, Homo sapiens; identical to SEQ ID NO: 5039

SEQ ID NO: 5043 - protein, 821 aa, Homo sapiens; identical to SEQ ID NO: 5033

SEQ ID NO: 5044 - protein, 851 aa, Homo sapiens; identical to SEQ ID NO: 5017

SEQ ID NO: 5045 - protein, 533 aa, Homo sapiens; identical to SEQ ID NO: 5029

SEQ ID NO: 5046 - protein, 254 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYRLECNGAISAQCNLCLLGSSDSPASAS

SEQ ID NO: 5047 - protein, 271 aa, Homo sapiens; identical to SEQ ID NO: 5020

SEQ ID NO: 5048 - protein, 533 aa, Homo sapiens; identical to SEQ ID NO: 5029

SEQ ID NO: 5049 - protein, 271 aa, Homo sapiens; identical to SEQ ID NO: 5020

SEQ ID NO: 5050 - protein, 254 aa, Homo sapiens; identical to SEQ ID NO: 5046

SEQ ID NO: 5051 - protein, 254 aa, Homo sapiens; identical to SEQ ID NO: 5046

SEQ ID NO: 5052 - protein, 533 aa, Homo sapiens; identical to SEQ ID NO: 5029

SEQ ID NO: 5053 - protein, 851 aa, Homo sapiens; identical to SEQ ID NO: 5017

SEQ ID NO: 5054 - protein, 399 aa, Homo sapiens
MASAAAGEAEETTRLRKPRFSFEENQILIREVRAHYPQLYGAQSRRVSVAERRRVWDGIAAKINGITSWKRTGQEVQKRWNDFKRRTKEKLARVPHSTQGAGPAAEDAFSAEEETIFAILGPGVAAPGAGAGAEEPPAAPSSQPPPPSACPQRYVLSEDRREDRRADTSAHSKAGSSSPEPWARPSCTPQEGGCPRPKERESPPPSALQPVQLPRLALSPPPPAPPLPPPPPLAQVAPSPPSPPPPPRPPPTLSASDPSLDFLRAQQETANAIRELAGTLRQGLAKLSEALSALLPLLPGTPVDSLPPPLPPPPPPPPPPRPVLPPPAPKVEITPEPVSVVAAVVDGAVVAARGVIIAPRSEEGAPRPPPAPLPPHDSPPHKRRKGFPTRKRRGRWKSP

SEQ ID NO: 5055 - protein, 235 aa, Homo sapiens
MRTQVYEGLCKNYFSLAVLQRDRIKLLFFDILVFLSVFLLFLLFLVDIMANNTTSLGSPWPENFWEDLIMSFTVSMAIGLVLGGFIWAVFICLSRRRRASAPISQWSSSRRSRSSYTHGLNRTGFYRHSGCERRSNLSLASLTFQRQASLEQANSFPRKSSFRASTFHPFLQCPPLPVETESQLVTLPSSNISPTISTSHSLSRPDYWSSNSLRVGLSTPPPPAYESIIKAFPDS

SEQ ID NO: 5056 - protein, 216 aa, Homo sapiens
  MOD_RES (1)..(1): Any amino acid
XRDRIKLLFFDILVFLSVFLLFLLFLVDIMANNTTSLGSPWPENFWEDLIMSFTVSMAIGLVLGGFIWAVFICLSRRRRASAPISQWSSSRRSRSSYTHGLNRTGFYRHSGCERRSNLSLASLTFQRQASLEQANSFPRKSSFRASTFHPFLQCPPLPVETESQLVTLPSSNISPTISTSHSLSRPDYWSSNSLRVGLSTPPPPAYESIIKAFPDS

SEQ ID NO: 5057 - protein, 610 aa, Homo sapiens
MQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIKMEDFAFIANPSSTEISSITGNIELNQQTCLLTLRDYNNREKSEVSTDLIQANPKQGALAKKSSQTKKKKKAFNSPKTGQNKTVQYPSDILENASVELFLDANKLPTPVVEQVAQINDNSELELTSVVENTFPAQDIVHTVTVKRKRGKSQPNCALKEHSMSNIASVKSPYEAENSGEELDQRYSKAKPMCNTCGKVFSEASSLRRHMRIHKGVKPYVCHLCGKAFTQCNQLKTHVRTHTGEKPYKCELCDKGFAQKCQLVFHSRMHHGEEKPYKCDVCNLQFATSSNLKIHARKHSGEKPYVCDRCGQRFAQASTLTYHVRRHTGEKPYVCDTCGKAFAVSSSLITHSRKHTGEKPYICGICGKSFISSGELNKHFRSHTGERPFICELCGNSYTDIKNLKKHKTKVHSGADKTLDSSAEDHTLSEQDSIQKSPLSETMDVKPSDMTLPLALPLGTEDHHMLLPVTDTQSPTSDTLLRSTVNGYSEPQLIFLQQLY

SEQ ID NO: 5058 - protein, 610 aa, Homo sapiens; identical to SEQ ID NO: 5057

SEQ ID NO: 5059 - protein, 500 aa, Homo sapiens
MQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIKMEDFAFIANPSSTEISSITGNIELNQQTCLLTLRDYNNREKSEVSTDLIQANPKQGALAKKSSQTKKKKKAFNSPKTGQNKTVQYPSDILENASVELFLDANKLPTPVVEQVAQINDNSELELTSVVENTFPAQDIVHTVTVKRKRGKSQPNCALKEHSMSNIASVKSPYEAENSGEELDQRYSKAKPMCNTCGKVFSEASSLRRHMRIHKGVKPYVCHLCGKAFTQCNQLKTHVRTHTGEKPYKCELCDKGFAQKCQLVFHSRMHHGEEKPYKCDVCNLQFATSSNLKIHARKHSGEKPYVCDRCGQRFAQASTLTYHVRRHTGEKPYVCDTCGKAFAVSSSLITHSRKHTGEKPYICGICGKSFISSGELNKHFRSHTVVWSMN

SEQ ID NO: 5060 - protein, 581 aa, Homo sapiens
MQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIKMEDFAFIANPSSTEISSITGNIELNQQTCLLTLRDYNNREKSEVSTDLIQANPKQGALAKKSSQTKKKKKAFNSPKTGQNKTVQYPSDILENASVELFLDANKLPTPVVEQVAQINDNSELELTSVVENTFPAQDIVHTVTVKRKRGKSQPNCALKEHSMSNIASVKSPYEAENSGEELDQRYSKAKPMCNTCGKVFSEASSLRRHMRIHKGVKPYVCHLCGKAFTQCNQLKTHVRTHTGEKPYKCELCDKGFAQKCQLVFHSRMHHGEEKPYKCDVCNLQFATSSNLKIHARKHSGEKPYVCDRCGQRFAQASTLTYHVRRHTGEKPYVCDTCGKAFAVSSSLITHSRKHTGEKPYICGICGKSFISSGELNKHFRSHTGADKTLDSSAEDHTLSEQDSIQKSPLSETMDVKPSDMTLPLALPLGTEDHHMLLPVTDTQSPTSDTLLRSTVNGYSEPQLIFLQQLY

SEQ ID NO: 5061 - protein, 388 aa, Homo sapiens
MLKVKRLEEFNTCYNSNQLEKMAFFQCREEVEKVKCFLEKNSGDQDSRSGHNEAKEVWSNADLTERMPVKSKRTSALAVDIPAPPAPFDHRIVTAKQGAVNSFYTVSKTEILGGGRFGQVHKCEETATGLKLAAKIIKTRGMKDKEEVKNEISVMNQLDHANLIQLYDAFESKNDIVLVMEYVDGGELFDRIIDESYNLTELDTILFMKQICEGIRHMHQMYILHLDLKTTSFQCSRFLIDTSILPLCLLNCRYKPREKLKVNFGTPEFLAPEVVNYDFVSFPTDMWSVGVIAYMLLSGLSPFLGDNDAETLNNILACRWDLEDEEFQDISEEAKEFISKLLIKEKSWRISASEALKHPWLSDHKLHSRLNAQKKKNRGSDAQDFVTK

SEQ ID NO: 5062 - protein, 388 aa, Homo sapiens
MLKVKRLEEFNTCYNSNQLEKMAFFQCREEVEKVKCFLEKNSGDQDSRSGHNEAKEVWSNADLTERMPVKSKRTSALAVDIPAPPAPFDHRIVTAKQGAVNSFYTVSKTEILGGGRFGQVHKCEETATGLKLAAKIIKTRGMKDKEEVKNEISVMNQLDHANLIQLYDAFESKNDIVLVMEYVDGGELFDRIIDESYNLTELDTILFMKQICEGIRHMHQMYILHLDLKPENILCVNRDAKQIKIIDFGLARRYKPREKLKVNFGTPEFLAPEVVNYDFVSFPTDMWSVGVIAYMLLSGLSPFLGDNDAETLNNILACRWDLEDEEFQDISEEAKEFISKLLIKEKSWRISASEALKHPWLSDHKLHSRLNAQKKKNRGSDAQDFVTK

SEQ ID NO: 5063 - protein, 191 aa, Homo sapiens
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHRIDLKLNKKPRADY

SEQ ID NO: 5064 - protein, 192 aa, Homo sapiens
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHRMNVSPKTGWHQLHL

SEQ ID NO: 5065 - protein, 169 aa, Homo sapiens
MSLFFISQETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHRIDLKLNKKPRADY

SEQ ID NO: 5066 - protein, 201 aa, Homo sapiens
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHSPSGMFDYDFEIDLKLNKKPRADY

SEQ ID NO: 5067 - protein, 191 aa, Homo sapiens
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHSPSGMFDYDFEYVY

SEQ ID NO: 5068 - protein, 96 aa, Homo sapiens
MTSALENYINRTVAVITSDGRMIVGTLKGFDQTINLILDESHERVFSSSQGVEQVVLGLYIVRGDNVAVIGEIDEETDSALDLGNIRAEPLNSVAH

SEQ ID NO: 5069 - protein, 587 aa, Homo sapiens
MSQMLHIEIPNFGNTVLGCLNEQRLLGLYCDVSIVVKGQAFKAHRAVLAASSLYFRDLFSGNSKSAFELPGSVPPACFQQILSFCYTGRLTMTASEQLVVMYTAGFLQIQHIVERGTDLMFKVSSPHCDSQTAVIEDAGSEPQSPCNQLQPAAAAAAPYVVSPSVPIPLLTRVKHEAMELPPAGPGLAPKRPLETGPRDGVAVAAGAAVAAGTAPLKLPRVSYYGVPSLATLIPGIQQMPYPQGERTSPGASSLPTTDSPTSYHNEEDEEDDEAYDTMVEEQYGQMYIKASGSYAVQEKPEPVPLESRSCVLIRRDLVALPASLISQIGYRCHPKLYSEGDPGEKLELVAGSGVYITRGQLMNCHLCAGVKHKVLLRRLLATFFDRNTLANSCGTGIRSSTSDPSRKPLDSRVLNAVKLYCQNFAPSFKESEMNVIAADMCTNARRVRKRWLPKIKSMLPEGVEMYRTVMGSAAASVPLDPEFPPAAAQVFEQRIYAERRGDAATIVALRTDAVNVDLSAAANPAFDAGEEVDGAGSVIQEVAAPEPLPADGQSPPQPFEQGGGGPSRPQTPAAAARRPEGTYAGTL

SEQ ID NO: 5070 - protein, 587 aa, Homo sapiens; identical to SEQ ID NO: 5069

SEQ ID NO: 5071 - protein, 1025 aa, Homo sapiens
MHRKKVDNRIRILIENGVAERQRSLFVVVGDRGKDQVVILHHMLSKATVKARPSVLWCYKKELGFSSHRKKRMRQLQKKIKNGTLNIKQDDPFELFIAATNIRYCYYNETHKILGNTFGMCVLQDFEALTPNLLARTVETVEGGGLVVILLRTMNSLKQLYTVTMDVHSRYRTEAHQDVVGRFNERFILSLASCKKCLVIDDQLNILPISSHVATMEALPPQTPDESLGPSDLELRELKESLQDTQPVGVLVDCCKTLDQAKAVLKFIEGISEKTLRSTVALTAARGRGKSAALGLAIAGAVAFGYSNIFVTSPSPDNLHTLFEFVFKGFDALQYQEHLDYEIIQSLNPEFNKAVIRVNVFREHRQTIQYIHPADAVKLGQAELVVIDEAAAIPLPLVKSLLGPYLVFMASTINGYEGTGRSLSLKLIQQLRQQSAQSQVSTTAENKTTTTARLASARTLYEVSLQESIRYAPGDAVEKWLNDLLCLDCLNITRIVSGCPLPEACELYYVNRDTLFCYHKASEVFLQRLMALYVASHYKNSPNDLQMLSDAPAHHLFCLLPPVPPTQNALPEVLAVIQVCLEGEISRQSILNSLSRGKKASGDLIPWTVSEQFQDPDFGGLSGGRVVRIAVHPDYQGMGYGSRALQLLQMYYEGRFPCLEEKVLETPQEIHTVSSEAVSLLEEVITPRKDLPPLLLKLNERPAERLDYLGVSYGLTPRLLKFWKRAGFVPVYLRQTPNDLTGEHSCIMLKTLTDEDEADQGGWLAAFWKDFRRRFLALLSYQFSTFSPSLALNIIQNRNMGKPAQPALSREELEALFLPYDLKRLEMYSRNMVDYHLIMDMIPAISRIYFLNQLGDLALSAAQSALLLGIGLQHKSVDQLEKEIELPSGQLMGLFNRIIRKVVKLFNEVQEKAIEEQMVAAKDVVMEPTMKTLSDDLDEAAKEFQEKHKKEVGKLKSMDLSEYIIRGDDEEWNEVLNKAGPNASIISLKSDKKRKLEAKQEPKQSKKLKNRETKNKKDMKLKRKK

SEQ ID NO: 5072 - protein, 953 aa, Homo sapiens
MRQLQKKIKNGTLNIKQDDPFELFIAATNIRYCYYNETHKILGNTFGMCVLQDFEALTPNLLARTVETVEGGGLVVILLRTMNSLKQLYTVTMDVHSRYRTEAHQDVVGRFNERFILSLASCKKCLVIDDQLNILPISSHVATMEALPPQTPDESLGPSDLELRELKESLQDTQPVGVLVDCCKTLDQAKAVLKFIEGISEKTLRSTVALTAARGRGKSAALGLAIAGAVAFGYSNIFVTSPSPDNLHTLFEFVFKGFDALQYQEHLDYEIIQSLNPEFNKAVIRVNVFREHRQTIQYIHPADAVKLGQAELVVIDEAAAIPLPLVKSLLGPYLVFMASTINGYEGTGRSLSLKLIQQLRQQSAQSQVSTTAENKTTTTARLASARTLYEVSLQESIRYAPGDAVEKWLNDLLCLDCLNITRIVSGCPLPEACELYYVNRDTLFCYHKASEVFLQRLMALYVASHYKNSPNDLQMLSDAPAHHLFCLLPPVPPTQNALPEVLAVIQVCLEGEISRQSILNSLSRGKKASGDLIPWTVSEQFQDPDFGGLSGGRVVRIAVHPDYQGMGYGSRALQLLQMYYEGRFPCLEEKVLETPQEIHTVSSEAVSLLEEVITPRKDLPPLLLKLNERPAERLDYLGVSYGLTPRLLKFWKRAGFVPVYLRQTPNDLTGEHSCIMLKTLTDEDEADQGGWLAAFWKDFRRRFLALLSYQFSTFSPSLALNIIQNRNMGKPAQPALSREELEALFLPYDLKRLEMYSRNMVDYHLIMDMIPAISRIYFLNQLGDLALSAAQSALLLGIGLQHKSVDQLEKEIELPSGQLMGLFNRIIRKVVKLFNEVQEKAIEEQMVAAKDVVMEPTMKTLSDDLDEAAKEFQEKHKKEVGKLKSMDLSEYIIRGDDEEWNEVLNKAGPNASIISLKSDKKRKLEAKQEPKQSKKLKNRETKNKKDMKLKRKK

SEQ ID NO: 5073 - protein, 305 aa, Homo sapiens
MSVDPACPQSLPCFEASDCKESSPMPVICGPEENYPSLQMSSAEMPHTETVSPLPSSMDLLIQDSPDSSTSPKGKQPTSAEKSVAKKEDKVPVKKQKTRTVFSSTQLCVLNDRFQRQKYLSLQQMQELSNILNLSYKQVKTWFQNQRMKSKRWQKNNWPKNSNGVTQKASAPTYPSLYSSYHQGCLVNPTGNLPMWSNQTWNNSTWSNQTQNIQSWSNHSWNTQTWCTQSWNNQAWNSPFYNCGEESLQSCMQFQPNSPASDLEAALEAAGEGLNVIQQTTRYFSTPQTMDLFLNYSMNMQPEDV

SEQ ID NO: 5074 - protein, 289 aa, Homo sapiens
MSVDPACPQSLPCFEASDCKESSPMPVICGPEENYPSLQMSSAEMPHTETVSPLPSSMDLLIQDSPDSSTSPKGKQPTSAEKSVAKKEDKVPVKKQKTRTVFSSTQLCVLNDRFQRQKYLSLQQMQELSNILNLSYKQVKTWFQNQRMKSKRWQKNNWPKNSNGVTQGCLVNPTGNLPMWSNQTWNNSTWSNQTQNIQSWSNHSWNTQTWCTQSWNNQAWNSPFYNCGEESLQSCMQFQPNSPASDLEAALEAAGEGLNVIQQTTRYFSTPQTMDLFLNYSMNMQPEDV

SEQ ID NO: 5075 - protein, 188 aa, Homo sapiens
MHRARWLTPVIPALWEAEAGRSRGQEIETILANKKQSAMPWDQDPEQSTGNYSEDEQNGKQKWREEGEAGRKREREKEEKNEKELQDEQENKRKRENEKQKQYPEKRLVSKSLMHTLWAKFKLNRCPTIQESLSLSFEFDMTHKQISQWFCKTRKKYNKEMSKRKHKKKHMRWRSLCCQGWSRTPALK

SEQ ID NO: 5076 - protein, 896 aa, Homo sapiens
MAARAVLDEFTAPAEKAELLEQSRGRIEGLFGVSLAVLGALGAEEPLPARIWLQLCGAQEAVHSAKEYIKGICEPELEERECYPKDMHCIFVGAESLFLKSLIQDTCADLCILDIGLLGIRGSAEAVVMARSHIQQFVKLFENKENLPSSQKESEVKREFKQFVEAHADNYTMDLLILPTSLKKELLTLTQGEENLFETGDDEVIEMRDSQQTEFTQNAATGLNISRDETVLQEEARNKAGTPVSELTKQMDTVLSSSPDVLFDPINGLTPDEEALSNERICQKRRFSDSEERHTKKQFSLENVQEGEILHDAKTLAGNVIADLSDSSADSENLSPDIKETTEEMEYNILVNFFKTMGYSQEIVEKVIKVYGPSTEPLLLLEEIEKENKRFQEDREFSAGTVYPETNKTKNKGVYSSTNELTTDSTPKKTQAHTQQNMVEKFSQLPFKVEAKPCTSNCRINTFRTVPIEQKHEVWGSNQNYICNTDPETDGLSPSVASPSPKEVNFVSRGASSHQPRVPLFPENGLHQQPEPLLPNNMKSACEKRLGCCSSPHSKPNCSTLSPPMPLPQLLPSVTDARSAGPSDHIDSSVTGVQRFRDTLKIPYKLELKNEPGRTDLKHIVIDGSNVAITHGLKKFFSCRGIAIAVEYFWKLGNRNITVFVPQWRTRRDPNVTEQHFLTQLQELGILSLTPARMVFGERIASHDDRFLLHLADKTGGIIVTNDNFREFVNESVSWREIITKRLLQYTFVGDIFMVPDDPLGRSGPRLEEFLQKEVCLRDMQPLLSALPNVGMFDPSFRVPGTQAASTSHQPPTRIQGAPSSHWLPQQPHFPLLPALPSLQQNLPMPAQRSSAETNELREALLKIFPDSEQRLKIDQILVAHPYMKDLNALSAMVLD

SEQ ID NO: 5077 - protein, 615 aa, Homo sapiens
MAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQVLHAASGNLDEALKILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 5078 - protein, 601 aa, Homo sapiens
MAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 5079 - protein, 154 aa, Homo sapiens
MAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAM

SEQ ID NO: 5080 - protein, 254 aa, Homo sapiens
MAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGI

SEQ ID NO: 5081 - protein, 164 aa, Homo sapiens [sequence omitted]

SEQ ID NO: 5082 - protein, 601 aa, Homo sapiens; identical to SEQ ID NO: 5078

SEQ ID NO: 5083 - protein, 639 aa, Homo sapiens
MKTNGGRCRIRALCWSRREWRGAGMAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQVLHAASGNLDEALKILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 5084 - protein, 81 aa, Homo sapiens
MLIKVKTLTGKEIEIDIEPTDKVERIKERVEEKEGIPPQQQRLIYSGKQMNDEKTAADYKILGGSVLHLVLALRGGGGLRQ

SEQ ID NO: 5085 - protein, 272 aa, Homo sapiens
MFVKSETLELKEEEDVLVLLGSASPALAALTPLSSSADEEEEEEPGASGGARRQRGAEAGQGARGGVAAGAEGCRPARLLGLVHDCKRRPSRARAVSRGAKTAETVQRIKKTRRLKANNRERNRMHNLNAALDALREVLPTFPEDAKLTKIETLRFAHNYIWALTETLRLADHCGGGGGGLPGALFSEAVLLSPGGASAALSSSGDSPSPASTWSCTNSPAPSSSVSSNSTSPYSCTLSPASPAGSDMDYWQPPPPDKHRYAPHLPIARDCI

SEQ ID NO: 5086 - protein, 385 aa, Homo sapiens
MPQNVAKTEPVSILQPQTTVNPDRIKQTLPSSPTTTKSSPSDPMTTSRANQVKIIVPNSTAGLIIGKGGATVKAVMEQSGAWVQLSQKPDGINLQERVVTVSGEPEQNRKAVELIIQKIQEDPQSGSCLNISYANVTGPVANSNPTGSPYANTAEVLPTAAAAAGLLGHANLAGVAAFPAVLSGFTGNDLVAITSALNTLASYGYNLNTLGLGLSQAAATGALAAAAASANPAAAAANLLATYASEASASGSTAGGTAGTFALGSLAAATAATNGYFGAASPLAASAILGTEKSTDGSKDVVEIAVPENLVGAILGKGGKTLVEYQELTGARIQISKKGEFVPGTRNRKVTITGTPAATQAAQYLITQRITYEQGVRAANPQKVG

SEQ ID NO: 5087 - protein, 181 aa, Homo sapiens
MMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQTLPSSPTTTKSSPSDPMTTSRANQKHNISWIS

SEQ ID NO: 5088 - protein, 483 aa, Homo sapiens
MMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQVKIIVPNSTAGLIIGKGGATVKAVMEQSGAWVQLSQKPDGINLQERVVTVSGEPEQNRKAVELIIQKIQEDPQSGSCLNISYANVTGPVANSNPTGSPYANTAEVLPTAAAAAGLLGHANLAGVAAFPAVLSGFTGNDLVAITSALNTLASYGYNLNTLGLGLSQAAATGALAAAAASANPAAAAANLLATYASEASASGSTAGGTAGTFALGSLAAATAATNGYFGAASPLAASAILGTEKSTDGSKDVVEIAVPENLVGAILGKGGKTLVEYQELTGARIQISKKGEFVPGTRNRKVTITGTPAATQAAQYLITQRITYEQGVRAANPQKVG

SEQ ID NO: 5089 - protein, 507 aa, Homo sapiens
MMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQTLPSSPTTTKSSPSDPMTTSRANQVKIIVPNSTAGLIIGKGGATVKAVMEQSGAWVQLSQKPDGINLQERVVTVSGEPEQNRKAVELIIQKIQEDPQSGSCLNISYANVTGPVANSNPTGSPYANTAEVLPTAAAAAGLLGHANLAGVAAFPAVLSGFTGNDLVAITSALNTLASYGYNLNTLGLGLSQAAATGALAAAAASANPAAAAANLLATYASEASASGSTAGGTAGTFALGSLAAATAATNGYFGAASPLAASAILGTEKSTDGSKDVVEIAVPENLVGAILGKGGKTLVEYQELTGARIQISKKGEFVPGTRNRKVTITGTPAATQAAQYLITQRITYEQGVRAANPQKVG

SEQ ID NO: 5090 - protein, 492 aa, Homo sapiens
MEPEAPDSRKRPLETPPEVVCTKRSNTGEEGEYFLKVLIPSYAAGSIIGKGGQTIVQLQKETGATIKLSKSKDFYPGTTERVCLVQGTAEALNAVHSFIAEKVREIPQAMTKPEVVNILQPQTTMNPDRAKQAKLIVPNSTAGLIIGKGGATVKAVMEQSGAWVQLSQKPEGINLQERVVTVSGEPEQVHKAVSAIVQKVQEDPQSSSCLNISYANVAGPVANSNPTGSPYASPADVLPAAAAASAAAASGLLGPAGLAGVGAFPAALPAFSGTDLLAISTALNTLASYGYNTNSLGLGLNSAAASGVLAAVAAGANPAAAAAANLLASYAGEAGAGPAGGAAPPPPPPPGALGSFALAAAANGYLGAGAGGGAGGGGGPLVAAAAAAGAAGGFLTAEKLAAESAKELVEIAVPENLVGAILGKGGKTLVEYQELTGARIQISKKGEFLPGTRNRRVTITGSPAATQAAQYLISQRVTYEQGVRASNPQKVG

SEQ ID NO: 5091 - protein, 279 aa, Homo sapiens
MENSEKTEVVLLACGSFNPITNMHLRLFELAKDYMNGTGRYTVVKGIISPVGDAYKKKGLIPAYHRVIMAELATKNSKWVEVDTWESLQKEWKETLKVLRHHQEKLEASDCDHQQNSPTLERPGRKRKWTETQDSSQKKSLEPKTKAVPKVKLLCGADLLESFAVPNLWKSEDITQIVANYGLICVTRAGNDAQKFIYESDVLWKHRSNIHVVNEWIANDISSTKIRRALRRGQSIRYLVPDLVQEYIEKHNLYSSESEDRNAGVILAPLQRNTAEAKT

SEQ ID NO: 5092 - protein, 160 aa, Homo sapiens
MENSEKTEVVLLACGSFNPITNMHLRLFELAKDYMNGTGRYTVVKGIISPVGDAYKKKGLIPAYHRVIMAELATKNSKWVEVDTWESLQKEWKETLKVLRHHQEKLEASDCDHQQNSPTLERPGRKRKWTETQDSSQKKSLEPKTKDGVSLYHPGWSAVA

SEQ ID NO: 5093 - protein, 279 aa, Homo sapiens; identical to SEQ ID NO: 5091

SEQ ID NO: 5094 - protein, 412 aa, Homo sapiens [sequence omitted]

SEQ ID NO: 5095 - protein, 411 aa, Homo sapiens
MDGRAELPAFPRAGAPPLAASDTVPAAPEGAGAARPAAPLRPTSFSVLDILDPNKFNSRRRRCVLLGPVAPAACAPCASAPCAPAPAASGRPPRAEELERRALAGAGGVGAAGAEPPNAGDPFKAGEAETNDTNGYSSGGGGHSPSADSGDEVPDDEDDDEDEAPETEAARGAEEARGGGGGLGARGSGCQGAAETDASPGATVDEAAAPGPRENSPVAQGPPGGAAAPGGAGTTPQGTATAAKPKRKRTGSDSKSGKPRRARTAFTYEQLVALENKFKATRYLSVCERLNLALSLSLTETQVKIWFQNRRTKWKKQNPGADTSAPTGGGGGPGPGAGPGTGLPGGLSPLSPSPPMGAPLGMHGPAGYPAHGPGGLVCAAQLPFLSSPAVLSPFVLGSQTYGAPAFYAPHL

SEQ ID NO: 5096 - protein, 364 aa, Homo sapiens
MMLPSPVTSTPFSVKDILNLEQQHQHFHGAHLQADLEHHFHSAPCMLAAAEGTQFSDGGEEDEEDEGEKLSYLNSLAAADGHGDSGLCPQGYVHTVLRDSCSEPKEHEEEPEVVRDRSQKSCQLKKSLETAGDCKAAEESERPKPRSRRKPRVLFSQAQVFELERRFKQQRYLSAPEREHLASSLKLTSTQVKIWFQNRRYKCKRQRQDKSLELGAHAPPPPPRRVAVPVLVRDGKPCVTPSAQAYGAPYSVGASAYSYNSFPAYGYGNSAAAAAAAAAAAAAAAAYSSSYGCAYPAGGGGGGGGTSAATTAMQPACSAAGGGPFVNVSNLGGFGSGGSAQPLHQGTAAGAACAQGTLQGIRAW

SEQ ID NO: 5097 - protein, 367 aa, Homo sapiens
MLAVGAMEGTRQSAFLLSSPPLAALHSMAEMKTPLYPAAYPPLPAGPPSSSSSSSSSSSPSPPLGTHNPGGLKPPATGGLSSLGSPPQQLSAATPHGINDILSRPSMPVASGAALPSASPSGSSSSSSSSASASSASAAAAAAAAAAAAASSPAGLLAGLPRFSSLSPPPPPPGLYFSPSAAAVAAVGRYPKPLAELPGRTPIFWPGVMQSPPWRDARLACTPHQGSILLDKDGKRKHTRPTFSGQQIFALEKTFEQTKYLAGPERARLAYSLGMTESQVKVWFQNRRTKWRKKHAAEMATAKKKQDSETERLKGASENEEEDDDYNKPLDPNSDDEKITQLLKKHKSSSGGGGGLLLHASEPESSS

SEQ ID NO: 5098 - protein, 277 aa, Homo sapiens
MDTNRPGAFVLSSAPLAALHNMAEMKTSLFPYALQGPAGFKAPALGGLGAQLPLGTPHGISDILGRPVGAAGGGLLGGLPRLNGLASSAGVYFGPAAAVARGYPKPLAELPGRPPIFWPGVVQGAPWRDPRLAGPAPAGGVLDKDGKKKHSRPTFSGQQIFALEKTFEQTKYLAGPERARLAYSLGMTESQVKVWFQNRRTKWRKRHAVEMASAKKKQDSDAEKLKVGGSDAEDDDEYNRPLDPNSDDEKITRLLKKHKPSNLALVSPCGGGAGDAL

SEQ ID NO: 5099 - protein, 74 aa, Homo sapiens [sequence omitted]

SEQ ID NO: 5100 - protein, 35 aa, Homo sapiens
MVALRGLGSGLQPWCPLDLRLEWVDTVWELDFTET

SEQ ID NO: 5101 - protein, 1498 aa, Homo sapiens
MVALRGLGSGLQPWCPLDLRLEWVDTVWELDFTETEPLDPSIEAEIIETGLAAFTKLYESLLPFATGEHGSMESIWTFFIENNVSHSTLVALFYHFVQIVHKKNVSVQYREYGLHAAGLYFLLLEVPGSVANQVFHPVMFDKCIQTLKKSWPQESNLNRKRKKEQPKSSQANPGRHRKRGKPPRREDIEMDEIIEEQEDENICFSARDLSQIRNAIFHLLKNFLRLLPKFSLKEKPQCVQNCIEVFVSLTNFEPVLHECHVTQARALNQAKYIPELAYYGLYLLCSPIHGEGDKVISCVFHQMLSVILMLEVGEGSHRAPLAVTSQVINCRNQAVQFISALVDELKESIFPVVRILLQHICAKVVDKSEYRTFAAQSLVQLLSKLPCGEYAMFIAWLYKYSRSSKIPHRVFTLDVVLALLELPEREVDNTLSLEHQKFLKHKFLVQEIMFDRCLDKAPTVRSKALSSFAHCLELTVTSASESILELLINSPTFSVIESHPGTLLRNSSAFSYQRQTSNRSEPSGEINIDSSGETVGSGERCVMAMLRRRIRDEKTNVRKSALQVLVSILKHCDVSGMKEDLWILQDQCRDPAVSVRKQALQSLTELLMAQPRCVQIQKAWLRGVVPVVMDCESTVQEKALEFLDQLLLQNIRHHSHFHSGDDSQVLAWALLTLLTTESQELSRYLNKAFHIWSKKEKFSPTFINNVISHTGTEHSAPAWMLLSKIAGSSPRLDYSRIIQSWEKISSQQNPNSNTLGHILCVIGHIAKHLPKSTRDKVTDAVKCKLNGFQWSLEVISSAVDALQRLCRASAETPAEEQELLTQVCGDVLSTCEHRLSNIVLKENGTGNMDEDLLVKYIFTLGDIAQLCPARVEKRIFLLIQSVLASSADADHSPSSQGSSEAPASQPPPQVRGSVMPSVIRAHAIITLGKLCLQHEDLAKKSIPALVRELEVCEDVAVRNNVIIVMCDLCIRYTIMVDKYIPNISMCLKDSDPFIRKQTLILLTNLLQEEFVKWKGSLFFRFVSTLIDSHPDIASFGEFCLAHLLLKRNPVMFFQHFIECIFHFNNYEKHEKYNKFPQSEREKRLFSLKGKSNKERRMKIYKFLLEHFTDEQRFNITSKICLSILACFADGILPLDLDASELLSDTFEVLSSKEIKLLAMRSKPDKDLLMEEDDMALANVVMQEAQKKLISQVQKRNFIENIIPIIISLKTVLEKNKIPALRELMHYLREVMQDYRDELKDFFAVDKQLASELEYDMKKYQEQLVQEQELAKHADVAGTAGGAEVAPVAQVALCLETVPVPAGQENPAMSPAVSQPCTPRASAGHVAVSSPTPETGPLQRLLPKARPMSLSTIAILNSVKKAVESKSRHRSRSLGVLPFTLNSGSPEKTCSQVSSYSLEQESNGEIEHVTKRAISTPEKSISDVTFGAGVSYIGTPRTPSSAKEKIEGRSQGNDILCLSLPDKPPPQPQQWNVRSPARNKDTPACSRRSLRKTPLKTAN

SEQ ID NO: 5102 - protein, 888 aa, Homo sapiens
MLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 5103 - protein, 1143 aa, Homo sapiens
MEKRETFVQAVSKELVGEFLQFVQLDKEASDPFSLNELLDELSRKQKEELWQRLKNLLTDVLLESPVDGWQVVEAQGEDNMETEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRLLYSVQRPLHEFITAVQSRHTDTPVHRGVLSTLIAGPVVEISHQLRKVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 5104 - protein, 1156 aa, Homo sapiens
MEKRETFVQAVSKELVGEFLQFVQLDKEASDPFSLNELLDELSRKQKEELWQRLKNLLTDVLLESPVDGWQVVEAQGEDNMETEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRLLYSVQRPLHEFITAVQSRHTDTPVHRGVLSTLIAGPVVEISHQLRKVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERYEDLLCCPGWALTPGLLDSIYPSASVPIG

SEQ ID NO: 5105 - protein, 1143 aa, Homo sapiens; identical to SEQ ID NO: 5103

SEQ ID NO: 5106 - protein, 898 aa, Homo sapiens
  MOD_RES (1)..(1): Any amino acid
XLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 5107 - protein, 1156 aa, Homo sapiens; identical to SEQ ID NO: 5104

SEQ ID NO: 5108 - protein, 597 aa, Homo sapiens
MEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 5109 - protein, 571 aa, Homo sapiens [sequence omitted]

SEQ ID NO: 5110 - protein, 606 aa, Homo sapiens
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQSAALPRRYMLREREGAPEPASCVKETPDPWQSLDPFDSLESKPFKKGRPYSVPPCVEEALGQKRKRKGAAKLQDFHQWYLAAYADHADSRRLRRKGPSFADMEVLYWTHVKEQLETLRKLQRREVAEQWLRPAEEDHLEDSLEDLGAAADDFLEPEEYMEPEGADPREAADLDAVPMSLSYEELVRRNVELFIATSQKFVQETELSQRIRDWEDTVQPLLQEQEQHVPFDIHTYGDQLVSRFPQLNEWCPFAELVAGQPAFEVCRSMLASLQLANDYTVEITQQPGLEMAVDTMSLRLLTHQRAHKRFQTYAAPSMAQP

SEQ ID NO: 5111 - protein, 299 aa, Homo sapiens
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQVGPTWRPAEPEL

SEQ ID NO: 5112 - protein, 605 aa, Homo sapiens
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQSAALPRRYMLREREGAPEPASCVKETPDPWQSLDPFDSLESKPFKKGRPYSVPPCVEEALGQKRKRKGAAKLQDFHQWYLAAYADHADSRRLRRKGPSFADMEVLYWTHVKEQLETLRKLQRREVAEQWLRPAEEDHLEDSLEDLGAADDFLEPEEYMEPEGADPREAADLDAVPMSLSYEELVRRNVELFIATSQKFVQETELSQRIRDWEDTVQPLLQEQEQHVPFDIHTYGDQLVSRFPQLNEWCPFAELVAGQPAFEVCRSMLASLQLANDYTVEITQQPGLEMAVDTMSLRLLTHQRAHKRFQTYAAPSMAQP

SEQ ID NO: 5113 - protein, 266 aa, Homo sapiens
MQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASSTNILNLVDQLKGKKMRKKEAEQVLQKFVQNKWLIEKEGEFTLHGRAILEMEQYIRETYPDAVKICNICHSLLIQGQSCETCGIRMHLPCVAKYFQSNAEPRCPHCNDYWPHEIPKVFDPEKERESGVLKSNKKSLRSRQH

SEQ ID NO: 5114 - protein, 247 aa, Homo sapiens
MPGRSSSNSGSTGFISFSGVESALSSLKNFQACINSGMDTASSVALDLVESQTEVSSEYSMDKAMVEFATLDRQLNHYVKAVQSTINHVKEERPEKIPDLKLLVEKKFLALQSKNSDADFQNNEKFVQFKQQLKELKKQCGLQADREADGTEGVDEDIIVTQSQTNFTCPITKEEMKKPVKNKVCGHTYEEDAIVRMIESRQKRKKKAYCPQIGCSHTDIRKSDLIQDEALRRAIENHNKKRHRHSE

SEQ ID NO: 5115 - protein, 193 aa, Homo sapiens
MPGRSSSNSGSTGFISFSGVESALSSLKNFQACINSGMDTASSVALDLVESQTEVSSEYSMDKAMVEFATLDRQLNHYVKAVQSTINHVKEERPEKIPDLKLLVEKKFLALQSKNSDADFQNNEKFVQFKQQLKELKKQCGLQADREADGTEGVDEDIIVTQSQTNFTCPITKEEMKKPVKNKVCGHTYEEDA

SEQ ID NO: 5116 - protein, 45 aa, Homo sapiens
MPGRSSSNSGSTGFISFSGVESALSSLKNFQACINSGMDTASSVA

SEQ ID NO: 5117 - protein, 247 aa, Homo sapiens; identical to SEQ ID NO: 5114

SEQ ID NO: 5118 - protein, 139 aa, Homo sapiens
MPGRSSSNSGSTGFISFSGVESALSSLKNFQACINSGMDTASSVALDLVESQTEVSSEYSMDKAMVEFATLDRQLNHYVKAVQSTINHVKEERPEKIPDLKLLVEKKFLALQSKNSDADFQNNEKFVQFKQQLKELKKQ

SEQ ID NO: 5119 - protein, 234 aa, Homo sapiens
MLDGRQRRGSNAPTSDMPGTTLNRYGRTWPRWGWLWTPTGGALRKRKVKAMEVDIEERPKELVRKPYVLNDLEAEASLPEKKGNTLSRDLIDYVRYMVENHGEDYKAMAVMRRITIKIPQNRFGVRSTSINAFTQQSGKTSSILCRRGRWRWSDWFTSQLPQAEASPGPVKLEPGCKARRCCVAPEELARSHGIRRLHVHTPRSGEGTVLRGSNLYSSGGSRKSQNLLFSGWVM

SEQ ID NO: 5120 - protein, 178 aa, Homo sapiens
MPKAKGKTRRQKFGYSVNRKRLNRNARRKAAPRIECSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKAMARDEKNYYQDTPKQIRSKINVYKRFYPAEWQDFLDSLQKRKMEVE

SEQ ID NO: 5121 - protein, 231 aa, Homo sapiens
MPKAKGKTRRQKFGYSVNRKRLNRNARRKAAPRIECSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKQSGKTSSILCRRGRWRWSDWFTSQLPQAEASPGPVKLEPGCKARRCCVAPEELARSHGIRRLHHVHTPRSGEGTVLRGSNLYSSGGSRKSQNLLFSGWVM

SEQ ID NO: 5122 - protein, 236 aa, Homo sapiens
MPKAKGKTRRQKFGYSVNRKRLNRNARRKAAPRIECSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKSGKTSSILCRRGRWRWSDWFTSQLPQAEASPGPVKLEPGCKARRCCVAPEELARSHGIRRLHTRAHSPLWGRNCSQRLQFIFIWGFTEKPEPAVFRVGDVNIVCT

SEQ ID NO: 5123 - protein, 812 aa, Homo sapiens
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQLPEQPFEKAAFQKQNDTPKGPQPPTVSPIRSSRPPPAKRKKSQSRGNSQLLLS

SEQ ID NO: 5124 - protein, 808 aa, Homo sapiens
MGRKLDPTKEKRGPGRKARKQKGAETELVRFLPAVSDENSKRLSSRARKRAAKRRLGSVEAPKTNKSPEAKPLPGKLPKGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQLPEQPFEKAAFQKQNDTPKGPQPPTVSPIRSSRPPPAKRKKSQSRGNSQLLLS

SEQ ID NO: 5125 - protein, 812 aa, Homo sapiens; identical to SEQ ID NO: 5123

SEQ ID NO: 5126 - protein, 808 aa, Homo sapiens; identical to SEQ ID NO: 5124

SEQ ID NO: 5127 - protein, 845 aa, Homo sapiens
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPRGKKRPAPGSDEEEEEEDSEEDGMVNHGDLWGSEDDADTVDDYGADSNSEDEEEGEAAGVQWLGLGSLQPPPPGFKQFSCLSFPSSWDLQLLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQLPEQPFEKAAFQKQNDTPKGPQPPTVSPIRSSRPPPAKRKKSQSRGNSQLLLS

SEQ ID NO: 5128 - protein, 628 aa, Homo sapiens
MGRKLDPTKEKRGPGRKARKQKGAETELVRFLPAVSDENSKRLSSRARKRAAKRRLGSVEAPKTNKSPEAKPLPGKLPKGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTDGVLLCRSGWTAVVQSQLIATSTFQVQAILVPQTPK

SEQ ID NO: 5129 - protein, 193 aa, Homo sapiens
MALSTDYALRTGAFEPAEASVNPQDLQGSLQELKERALSRYNLVRGQGPERLVSGSDDFTLFLWSPAEDKKPLTRMTGHQALINQVLFSPDSRIVASASFDKSIKLWDGRTGKYLASLRGHVAAVYQIAWSADSRLLVSGSSDSTLKVWDVKAQKLAMDLPGHADEVYAVDWSPDGQRVASGGKDKCLRIWRR

SEQ ID NO: 5130 - protein, 304 aa, Homo sapiens
  MOD_RES (1)..(1): Any amino acid
XSSKDGSVRIWDTTAGRCERILTGHTQSVTCLRWGGDGLLYSASQDRTIKVWRAHDGVLCRTLQGHGHWVNTMALSTDYALRTGAFEPAEASVNPQDLQGSLQELKERALSRYNLVRGQGPERLVSGSDDFTLFLWSPAEDKKPLTRMTGHQALINQVLFSPDSRIVASASFDKSIKLWDGRTGKDDFHSVTWCSSGSSAAARSWLITTSASWVQVILLPQPPRYLASLRGHVAAVYQIAWSADSRLLVSGSSDSTLKVWDVKAQKLAMDLPGHADEVYAVDWSPDGQRVASGGKDKCLRIWRR

SEQ ID NO: 5131 - protein, 485 aa, Homo sapiens
MAAAVPDEAVARDVQRLLVQFQDEGGQLLGSPFDVPVDITPDRLQLVCNALLAQEDPLPLAFFVHDAEIVSSLGKTLESQAVETEKVLDIIYQPQAIFRVRAVTRCTSSLEGHSEAVISVAFSPTGKYLASGSGDTTVRFWDLSTETPHFTCKGHRHWVLSISWSPDGRKLASGCKNGQILLWDPSTGKQVGRTLAGHSKWITGLSWEPLHANPECRYVASSSKDGSVRIWDTTAGRCERILTGHTQSVTCLRWGGDGLLYSASQDRTIKVWRAHDGVLCRTLQGHGHWVNTMALSTDYALRTGAFEPAEASVNPQDLQGSLQELKERALSRYNLVRGQGPERLVSGSDDFTLFLWSPAEDKKPLTRMTGHQALINQVLFSPDSRIVASASFDKSIKLWDGRTGKYLASLRGHVAAVYQIAWSADSRLLVSGSSDSTLKVWDVKAQKLAMDLPGHADEVYAVDWSPDGQRVASGGKDKCLRIWRR

SEQ ID NO: 5132 - protein, 461 aa, Homo sapiens
MAAAVPDEAVARDVQRLLVQFQDEGGQLLGSPFDVPVDITPDRLQLVCNALLAQEDPLPLAFFVHDAEIVSSLGKTLESQAVETEKVLDIIYQPQAIFRVRAVTRCTSSLEGHSEAVISVAFSPTGKYLASGSGDTTVRFWDLSTETPHFTCKGHRHWVLSISWSPDGRKLASGCKNGQILLWEPLHANPECRYVASSSKDGSVRIWDTTAGRCERILTGHTQSVTCLRWGGDGLLYSASQDRTIKVWRAHDGVLCRTLQGHGHWVNTMALSTDYALRTGAFEPAEASVNPQDLQGSLQELKERALSRYNLVRGQGPERLVSGSDDFTLFLWSPAEDKKPLTRMTGHQALINQVLFSPDSRIVASASFDKSIKLWDGRTGKYLASLRGHVAAVYQIAWSADSRLLVSGSSDSTLKVWDVKAQKLAMDLPGHADEVYAVDWSPDGQRVASGGKDKCLRIWRR

SEQ ID NO: 5133 - protein, 193 aa, Homo sapiens; identical to SEQ ID NO: 5129

SEQ ID NO: 5134 - protein, 251 aa, Homo sapiens
MPSPRPRGSPPPAPSGSRVRPPRSGRSPAPRSPTGPNTPRAPGRFESPFSVEAILARPDPCAPAASQPSGSACVHPAFWTAASLCATGGLPWACPTSWLPAYLSVGFYPVPGPRVAPVCGLLGFGVTGLELAHCSGLWAFPDWAPTEDLQDTERQQKRVRTMFNLEQLEELEKVFAKQHNLVGKKRAQLAARLKLTENQVRVWFQNRRVKYQKQQKLRAAVTSAEAASLDEPSSSSIASIQSDDAESGVDG

SEQ ID NO: 5135 - protein, 369 aa, Homo sapiens
MFCCLGYEWLSGGCKTWHSAWVINTLADHRHRGTDFGGSPWLLIITVFLRSYKFAISLCTSYLCVSFLKTIFPSQNGHDGSTDVQQRARRSNCRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECVLYPLPPSADDNLKTPPECLLTPLPPSALPSADDNLKTPAECLLYPLPPSADDNLKTPPECLLTPLPPSAPPSADDNLKTPPECVCSLPFHPQRMIISRN

SEQ ID NO: 5136 - protein, 369 aa, Homo sapiens; identical to SEQ ID NO: 5135

SEQ ID NO: 5137 - protein, 369 aa, Homo sapiens; identical to SEQ ID NO: 5135

SEQ ID NO: 5138 - protein, 232 aa, Homo sapiens
MFCCLGYEWLSGGCKTWHSAWVINTLADHRHRGTDFGGSPWLLIITVFLRSYKFAISLCTSYLCVSFLKTIFPSQNGHDGSTDVQQRARRSNCRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRCTYNLVLPGSEKKYYSHA

SEQ ID NO: 5139 - protein, 232 aa, Homo sapiens; identical to SEQ ID NO: 5138

SEQ ID NO: 5140 - protein, 369 aa, Homo sapiens; identical to SEQ ID NO: 5135

SEQ ID NO: 5141 - protein, 688 aa, Homo sapiens
MENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEETEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALKATLVESSTSGFTPGGGGSSVSMIASRKPTDGASSSNCVTDISHLVRKKRKPEEESPRKDDAKKAKQEPEVNGGSGDAVPSGNEVSENMEEEAENQAESRAAVEGTVEAGATVESTAC

SEQ ID NO: 5142 - protein, 788 aa, Homo sapiens
MAMESTATAAVAAELVSADKIEDVPAPSTSADKVESLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEETEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALKATLVESSTSGFTPGGGGSSVSMIASRKPTDGASSSNCVTDISHLVRKKRKPEEESPRKDDAKKAKQEPEVNGGSGDAVPSGNEVSENMEEEAENQAESRAAVEGTVEAGATVESTAC

SEQ ID NO: 5143 - protein, 449 aa, Homo sapiens
MAMESTATAAVAAELVSADKIEDVPAPSTSADKVESLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDETEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALKATLVESSTSGFTPGGGGSSVSMIASRKPTDGASSSNCVTDISHLVRKKRKPEEESPRKDDAKKAKQEPEVNGGSGDAVPSGNEVSENMEEEAENQAESRAAVEGTVEAGATVESTAC

SEQ ID NO: 5144 - protein, 790 aa, Homo sapiens
MFLLLLHLQIKWRATINLLSVTEDGLHFVEYYLNRIIHLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEETEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALKATLVESSTSGFTPGGGGSSVSMIASRKPTDGASSSNCVTDISHLVRKKRKPEEESPRKDDAKKAKQEPEVNGGSGDAVPSGNEVSENMEEEAENQAESRAAVEGTVEAGATVESTAC

SEQ ID NO: 5145 - protein, 256 aa, Homo sapiens
MAMESTATAAVAAELVSADKIEDVPAPSTSADKVESLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDETEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYG

SEQ ID NO: 5146 - protein, 724 aa, Homo sapiens
MAMESTATAAVAAELVSADKIEDVPAPSTSADKVERMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEETEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALKATLVESSTSGFTPGGGGSSVSMIASRKPTDGASSSNCVTDISHLVRKKRKPEEESPRKDDAKKAKQEPEVNGGSGDAVPSGNEVSENMEEEAENQAESRAAVEGTVEAGATVESTAC

SEQ ID NO: 5147 - protein, 150 aa, Homo sapiens
MRSCCVVQAGLQLLASSDPPSSASQSARITGVNHRTPPREIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 5148 - protein, 465 aa, Homo sapiens
MWVCLRGILDSQAFWHETLRRWECLLAEMKVSRGERSHCPTQTVKKLLEEQRRRQQQQPDAGGVQGQFLPPPEQPLTPSVNEAVTGHPPFPAHSETVGSGPSSLGFPDWDPNTHAAYTDSPYSCPASAAENFLPPDFYPPSDPGQPCPFPQGMEAGPWRVSAPPSGPPQFPAVVPGPSLEVARAHMLALGPQQLLAQDEEGDTLLHLFAARGLRWAAYAAAEVLQVYRRLDIREHKGKTPLLVAAAANQPLIVEDLLNLGAEPNAADHQGRSVLHVAATYGLPGVLLAVLNSGVQVDLEARDFEGLTPLHTAILALNVAMRPSDLCPRVLSTQARDRLDCVHMLLQMGANHTSQEIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 5149 - protein, 313 aa, Homo sapiens
MEAGPWRVSAPPSGPPQFPAVVPGPSLEVARAHMLALGPQQLLAQDEEGDTLLHLFAARGLRWAAYAAAEVLQVYRRLDIREHKGKTPLLVAAAANQPLIVEDLLNLGAEPNAADHQGRSVLHVAATYGLPGVLLAVLNSGVQVDLEARDFEGLTPLHTAILALNVAMRPSDLCPRVLSTQARDRLDCVHMLLQMGANHTSQEIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 5150 - protein, 180 aa, Homo sapiens
MRPLTEEETRVMFEKIAKYIGENLQLLVDRPDGTYCFRLHNDRVYYVSEKIMKLAANISGDKLVSLGTCFGKFTKTHKFRLHVTALDYLAPYAKYKVWIKPGAEQSFLYGNHVLKSGLGRITENTSQYQGVVVYSMADIPLGFGVAAKSTQDCRKVDPMAIVVFHQADIGEYVRHEETLT

SEQ ID NO: 5151 - protein, 133 aa, Homo sapiens
MRPLTEEETRVMFEKIAKYIGENLQLLVDRPDGTYCFRLHNDRVYYVSEKIMKLAANISGDKLVSLGTCFGKFTKTHKFRLHVTALDYLAPYAKGFGVAAKSTQDCRKVDPMAIVVFHQADIGEYVRHEETLT

SEQ ID NO: 5152 - protein, 82 aa, Homo sapiens
MATFPPATSAPQQPPGPEDEDSSLDESDLYSLAHSYLGGGGRKGRTKREAAANTNRPSPGGHERKLVTKLQNSERKKRGARR

SEQ ID NO: 5153 - protein, 100 aa, Homo sapiens
MATFPPATSAPQQPPGPEDEDSSLDESDLYSLAHSYLGPLIMPMPTSPLTPALVTGGGGRKGRTKREAAANTNRPSPGGHERKLVTKLQNSERKKRGARR

SEQ ID NO: 5154 - protein, 139 aa, Homo sapiens
MTHSLVCPETVSRVSSVLNRNTRQFGKKHLFDQDEETCWNSDQGPSQWVTLEFPQLIRVSQLQIQFQGGFSSRRGCLEGSQGTQALHKIVDFYPEDNNSLQTFPIPAAEVDRLKVTFEDATDFFGRVVIYHLRVLGEKV

SEQ ID NO: 5155 - protein, 579 aa, Homo sapiens
MNTAPSRPSPTRRDPYGFGDSRDSRRDRSPIRGSPRREPRDGRNGRDARDSRDIRDPRDLRDHRHSRDLRDHRDSRSVRDVRDVRDLRDFRDLRDSRDFRDQRDPMYDRYRDMRDSRDPMYRREGSYDRYLRMDDYCRRKDDSYFDRYRDSFDGRGPPGPESQSRAKERLKREERRREELYRQYFEEIQRRFDAERPVDCSVIVVNKQTKDYAESVGRKVRDLGMVVDLIFLNTEVSLSQALEDVSRGGSPFAIVITQQHQIHRSCTVNIMFGTPQEHRNMPQADAMVLVARNYERYKNECREKEREEIARQAAKMADEAILQERERGGPEEGVRGGHPPAIQSLINLLADNRYLTAEETDKIINYLRERKERLMRSSTDSLPGPISRQPLGATSGASLKTQPSSQPLQSGQVLPSATPTPSAPPTSQQELQAKILSLFNSGTVTANSSSASPSVAAGNTPNQNFSTAANSQPQQRSQASGNQPPSILGQGGSAQNMGPRPGAPSQGLFGQPSSRLAPASNMTSQRPVSSTGINFDNPSVQKALDTLIQSGPALSHLVSQTTAQMGQPQAPMGSYQRHY

SEQ ID NO: 5156 - protein, 104 aa, Homo sapiens
MYDRYRDMRDSRDPMYRREGSYDRYLRMDDYCRRKDDSYFDRYRDSFDGRGPPGPESQSRAKERLKREERRREELYRQYFEEIQRRFDAERPVDCSVIVVNKQT

SEQ ID NO: 5157 - protein, 425 aa, Homo sapiens
MGSKMNLIEHSHLPTTDEFSFSENLFGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 5158 - protein, 579 aa, Homo sapiens
MEVNAGGVIAYISSSSSASSPASCHSEGSENSFQSSSSSVPSSPNSSNSDTNGNPKNGDLANIEGILKNDRIDCSMKTSKSSAPGMTKSHSGVTKFSGMVLLCKVCGDVASGFHYGVHACEGCKGFFRRSIQQNIQYKKCLKNENCSIMRMNRNRCQQCRFKKCLSVGMSRDAVRFGRIPKREKQRMLIEMQSAMKTMMNSQFSGHLQNDTLVEHHEQTALPAQEQLRPKPQLEQENIKSSSPPSSDFAKEEVIGMVTRAHKDTFMYNQEQQENSAESMQPQRGERIPKNMEQYNLNHDHCGNGLSSHFPCSESQQHLNGQFKGRNIMHYPNGHAICIANGHCMNFSNAYTQRVCDRVPIDGFSQNENKNSYLCNTGGRMHLVCPLSKSPYVDPHKSGHEIWEEFSMSFTPAVKEVVEFAKRIPGFRDLSQHDQVNLLKAGTFEVLMVRFASLFDAKERTVTFLSGKKYSVDDLHSMGAGDLLNSMFEFSEKLNALQLSDEEMSLFTAVVLVSADRSGIENVNSVEALQETLIRALRTLIMKNHPNEASIFTKLLLKLPDLRSLNNMHSEELLAFKVHP

SEQ ID NO: 5159 - protein, 408 aa, Homo sapiens
MEVNAGGVIAYISSSSSASSPASCHSEGSENSFQSSSSSVPSSPNSSNSDTNGNPKNGDLANIEGILKNDRIDCSMKTSKSSAPGMTKSHSGVTKFSGMVLLCKVCGDVASGFHYGVHACEGCKGFFRRSIQQNIQYKKCLKNENCSIMRMNRNRCQQCRFKKCLSVGMSRDAVRFGRIPKREKQRMLIEMQSAMKTMMNSQFSGHLQNDTLVEHHEQTALPAQEQLRPKPQLEQENIKSSSPPSSDFAKEEVIGMVTRAHKDTFMYNQEQQENSAESMQPQRGERIPKNMEQYNLNHDHCGNGLSSHFPCSESQQHLNGQFKGRNIMHYPNGHAICIANGHCMNFSNAYTQRVCDRVPIDGFSQNENKNSYLCNTGGRMHLYSVHIQPKFHQKQQYHTISSLNHEVL

SEQ ID NO: 5160 - protein, 579 aa, Homo sapiens; identical to SEQ ID NO: 5158

SEQ ID NO: 5161 - protein, 482 aa, Homo sapiens
MVMQFQGLENPIQISPHCSCTPSGFFMEMMSMKPAKGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 5162 - protein, 476 aa, Homo sapiens
MGSKMNLIEHSHLPTTDEFSFSENLFGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECMYTGLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 5163 - protein, 472 aa, Homo sapiens
MGSKMNLIEHSHLPTTDEFSFSENLFGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 5164 - protein, 486 aa, Homo sapiens
MVMQFQGLENPIQISPHCSCTPSGFFMEMMSMKPAKGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECMYTGLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 5165 - protein, 357 aa, Homo sapiens
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVSPTVGFQVEFLELLFHFHGTLRKLQLQEPEYVLLAAMALFSPAPYLTDRPGVTQRDEIDQLQEEMALTLQSYIKGQQRRPRDRFLYAKLLGLLAELRSINEAYGYQIQHIQGLSAMMPLLQEICS

SEQ ID NO: 5166 - protein, 357 aa, Homo sapiens; identical to SEQ ID NO: 5165

SEQ ID NO: 5167 - protein, 324 aa, Homo sapiens
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPAPYLTDRPGVTQRDEIDQLQEEMALTLQSYIKGQQRRPRDRFLYAKLLGLLAELRSINEAYGYQIQHIQGLSAMMPLLQEICS

SEQ ID NO: 5168 - protein, 352 aa, Homo sapiens
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVSPTVGFQVEFLELLFHFHGTLRKLQLQEPEYVLLAAMALFSPDRPGVTQRDEIDQLQEEMALTLQSYIKGQQRRPRDRFLYAKLLGLLAELRSINEAYGYQIQHIQGLSAMMPLLQEICS

SEQ ID NO: 5169 - protein, 348 aa, Homo sapiens
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPDRPGVTQRDEIDQLQEEMALTLQSYIKGQQRRPRDRFLYAKLLGLLAELRSINEAYGYQIQHIQGLSAMMPLLQEICS

SEQ ID NO: 5170 - protein, 309 aa, Homo sapiens
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARDRPGVTQRDEIDQLQEEMALTLQSYIKGQQRRPRDRFLYAKLLGLLAELRSINEAYGYQIQHIQGLSAMMPLLQEICS

SEQ ID NO: 5171 - protein, 314 aa, Homo sapiens
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARAPYLTDRPGVTQRDEIDQLQEEMALTLQSYIKGQQRRPRDRFLYAKLLGLLAELRSINEAYGYQIQHIQGLSAMMPLLQEICS

SEQ ID NO: 5172 - protein, 315 aa, Homo sapiens
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVSPTVGFQVEFLELLFHFHGTLRKLQLQEPEYVLLAAMALFSPAPYLTDRPGVTQRDEIDQLQEEMALTLQSYIKGQQRRPRDRSPGTPWIHWSGKMLGPKIGPGSKGAQWLQ

SEQ ID NO: 5173 - protein, 340 aa, Homo sapiens
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPAPYLTDRPGVTQRDEIDQLQEEMALTLQSYIKGQQRRPRDRSPGTPWIHWSGKMLGPKIGPGSKGAQWLQ

SEQ ID NO: 5174 - protein, 306 aa, Homo sapiens
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPDRPGVTQRDEIDQLQEEMALTLQSYIKGQQRRPRDRSPGTPWIHWSGKMLGPKIGPGSKGAQWLQ

SEQ ID NO: 5175 - protein, 339 aa, Homo sapiens
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVSPTVGFQVEFLELLFHFHGTLRKLQLQEPEYVLLAAMALFSPDRPGVTQRDEIDQLQEEMALTLQSYIKGQQRRPRDRSPGTPWIHWSGKMLGPKIGPGSKGAQWLQ

SEQ ID NO: 5176 - protein, 119 aa, Homo sapiens
MASREDELRNCVVCGDQATGYHFNALTCEGCKGFFRRTVSKSIGPTCPFAGSCEVSKTQRRHCPACRLQKCLDAGMRKDTSSSSVHPSPALAHPGPCAASGHTLRRHQHFHGTASHQVY

SEQ ID NO: 5177 - protein, 147 aa, Homo sapiens
MASREDELRNCVVCGDQATGYHFNALTCEGCKGFFRRTVSKSIGPTCPFAGSCEVSKTQRRHCPACRLQKCLDAGMRKDIPCPLKTRSPFSREQLWKSVTSYSIPLSVSKHKTSSAGLFATQLKMEPVTDLELPREMRLISCKRRWH

SEQ ID NO: 5178 - protein, 280 aa, Homo sapiens
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARDRPGVTQRDEIDQLQEEMALTLQSYIKGQQRRPRDRFLYAKLLGLLAELRSINEAYGYQIQHIQGLSAMMPLLQEICS

SEQ ID NO: 5179 - protein, 296 aa, Homo sapiens
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARDRPGVTQRDEIDQLQEEMALTLQSYIKGQQRRPRDRSPGTPWIHWSGKMLGPKIGPGSKGAQWLQ

SEQ ID NO: 5180 - protein, 274 aa, Homo sapiens
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVSPTVGFQVEFLELLFHFHGTLRKLQLQEPEYVLLAAMALFSPGEHLPKPRAFCCTTSAQILSSLSPSTQAF

SEQ ID NO: 5181 - protein, 90 aa, Homo sapiens
MLPKRSRRTVSKSIGPTCPFAGSCEVSKTQRRHCPACRLQKCLDAGMRKDTSSSSVHPSPALAHPGPCAASGHTLRRHQHFHGTASHQVY

SEQ ID NO: 5182 - protein, 118 aa, Homo sapiens
MLPKRSRRTVSKSIGPTCPFAGSCEVSKTQRRHCPACRLQKCLDAGMRKDIPCPLKTRSPFSREQLWKSVTSYSIPLSVSKHKTSSAGLFATQLKMEPVTDLELPREMRLISCKRRWH

SEQ ID NO: 5183 - protein, 311 aa, Homo sapiens
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPAPYLTDRPGVTQRDEIDQLQEEMALTLQSYIKGQQRRPRDRSPGTPWIHWSGKMLGPKIGPGSKGAQWLQ

SEQ ID NO: 5184 - protein, 90 aa, Homo sapiens; identical to SEQ ID NO: 5181

SEQ ID NO: 5185 - protein, 319 aa, Homo sapiens
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPDRPGVTQRDEIDQLQEEMALTLQSYIKGQQRRPRDRFLYAKLLGLLAELRSINEAYGYQIQHIQGLSAMMPLLQEICS

SEQ ID NO: 5186 - protein, 118 aa, Homo sapiens; identical to SEQ ID NO: 5182

SEQ ID NO: 5187 - protein, 147 aa, Homo sapiens; identical to SEQ ID NO: 5177

SEQ ID NO: 5188 - protein, 90 aa, Homo sapiens; identical to SEQ ID NO: 5181

SEQ ID NO: 5189 - protein, 267 aa, Homo sapiens
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARDRPGVTQRDEIDQLQEEMALTLQSYIKGQQRRPRDRSPGTPWIHWSGKMLGPKIGPGSKGAQWLQ

SEQ ID NO: 5190 - protein, 238 aa, Homo sapiens
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARGEMVLEQ

SEQ ID NO: 5191 - protein, 483 aa, Homo sapiens
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQDAKVIAALIHFTRRAITDL

SEQ ID NO: 5192 - protein, 603 aa, Homo sapiens
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQDKMSTERRKLLMEHIFKLQEFCNSMVKLCIDGYEYAYLKAIVLFSPDHPSLENMEQIEKFQEKAYVEFQDYITKTYPDDTYRLSRLLLRLPALRLMNATITEELFFKGLIGNIRIDSVIPHILKMEPADYNSQIIGHSI

SEQ ID NO: 5193 - protein, 467 aa, Homo sapiens
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQAEG

SEQ ID NO: 5194 - protein, 16 aa, Homo sapiens
MATIEEIAHQIIEQQM

SEQ ID NO: 5195 - protein, 322 aa, Homo sapiens
MCPVDKAHRNQCQACRLKKCLQAGMNQDAVQNERQPRSTAQVHLDSMESNTESRPESLVAPPAPAGRSPRGPTPMSAARALGHHFMASLITAETCAKLEPEDADENIDVTSNDPEFPSSPYSSSSPCGLDSIHETSARLLFMAVKWAKNLPVFSSLPFRDQVILLEEAWSELFLLGAIQWSLPLDSCPLLAPPEASAAGGAQGRLTLASMETRVLQETISRFRALAVDPTEFACMKALVLFKPETRGLKDPEHVEALQDQSQVMLSQHSKAHHPSQPVRFGKLLLLLPSLRFITAERIELLFFRKTIGNTPMEKLLCDMFKN

SEQ ID NO: 5196 - protein, 367 aa, Homo sapiens
METRPTALMSSTVAAAAPAAGAASRKESPGRWGLGEDPTGVSPSLQCRVCGDSSSGKHYGIYACNGCSGFFKRSVRRRLIYRCQVGAGMCPVDKAHRNQCQACRLKKCLQAGMNQDAVQNERQPRSTAQVHLDSMESNTESRPESLVAPPAPAGRSPRGPTPMSAARALGHHFMASLITAETCAKLEPEDADENIDVTSNDPEFPSSPYSSSSPCGLDSIHETSARLLFMAVKWAKNLPVFSSLPFRDQVILLEEAWSELFLLGAIQWSLPLDSCPLLAPPEASAAGGAQGRLTLASMETRVLQETISRFRALAVDPTEFACMKALVLFKPETRGLKDPEHVEALQDQSQVMLSQHSKAHHPSQPVR

SEQ ID NO: 5197 - protein, 476 aa, Homo sapiens
MERDEPPPSGGGGGGGSAGFLEPPAALPPPPRNGFCQDELAELDPGTNDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 5198 - protein, 475 aa, Homo sapiens
MERDEPPPSGGGGGGGSAGFLEPPAALPPPPRNGFCQDELAELDPGTNDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 5199 - protein, 480 aa, Homo sapiens
MERDEPPPSGGGGGGGSAGFLEPPAALPPPPRNGFCQDELAELDPGTISVSDDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 5200 - protein, 558 aa, Homo sapiens
MAIPGRQYGLILPKKTQQLHPVLQKPSVFGNDSDDDDETSVSESLQREAAKKQAMKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSARDRYLARQMARVNAKTYIEKEDD

SEQ ID NO: 5201 - protein, 353 aa, Homo sapiens
LKMTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEK

SEQ ID NO: 5202 - protein, 489 aa, Homo sapiens
MLLCMNMTVFMMKCRKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSARDRYLARQMARVNAKTYIEKEDD

SEQ ID NO: 5203 - protein, 157 aa, Homo sapiens
MGKHEFRSNIPCHLVDISCGLPCSATLPCGMHKCQRLCHKGECLVDEPCKQPCTTPRADCGHPCMAPCHTSSPCPVTACKAKVVELQCECGRRKEMVICSEASSTYQRLVIAAISMASKITDMQLGGSVEISKLITKKEVHQARLECDEECSALERK

SEQ ID NO: 5204 - protein, 833 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEQSHYWASTQKKRSHYMKKIPAHACL

SEQ ID NO: 5205 - protein, 1024 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEFRSNIPCHLVDISCGLPCSATLPCGMHKCQRLCHKGECLVDEPCKQPCTTPRADCGHPCMAPCHTSSPCPVTACKAKVELQCECGRRKEMVICSEASSTYQRIAAISMASKITDMQLGGSVEISKLITKKEVHQARLECDEECSALERKKRLAEAFHISEDSDPFNIRSSGSKFSDSLKEDARKDLKFVSDVEKEMETLVEAVNKVEVETSHWTFL

SEQ ID NO: 5206 - protein, 1120 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEFRSNIPCHLVDISCGLPCSATLPCGMHKCQRLCHKGECLVDEPCKQPCTTPRADCGHPCMAPCHTSSPCPVTACKAKVELQCECGRRKEMVICSEASSTYQRIAAISMASKITDMQLGGSVEISKLITKKEVHQARLECDEECSALERKKRLAEAFHISEDSDPFNIRSSGSKFSDSLKEDARKDLKFVSDVEKEMETLVEAVNKGKNSKKSHSFPPMNRDHRRIIHDLAQVYGLESVSYDSEPKRNVVVTAIRGKSVCPPTTLTGVLEREMQARPPPPIPHHRHQSDKNPGSSNLQKITKEPIIDYFDVQD

SEQ ID NO: 5207 - protein, 796 aa, Homo sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSRSVPLALS

SEQ ID NO: 5208 - protein, 638 aa, Homo sapiens
MQVSSLNEVKIYSLSCGKSLPEWLSDRKKRALQKKDVDVRRRIELIQDFEMPTVCTTIKVSKDGQYILATGTYKPRVRCYDTYQLSLKFERCLDSEVVTFEILSDDYSKIVFLHNDRYIEFHSQSGFYYKTRIPKFGRDFSYHYPSCDLYFVGASSEVYRLNLEQGRYLNPLQTDAAENNVCDINSVHGLFATGTIEGRVECWDPRTRNRVGLLDCALNSVTADSEINSLPTISALKFNGALTMAVGTTTGQGKIFTSLEPEHDLNDVCLYPNSGMLLTANETPKMGIYYIPVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 5209 - protein, 688 aa, Homo sapiens
MQVSSLNEVKIYSLSCGKSLPEWLSDRKKRALQKKDVDVRRRIELIQDFEMPTVCTTIKVSKDGQYILATGTYKPRVRCYDTYQLSLKFERCLDSEVVTFEILSDDYSKIVFLHNDRYIEFHSQSGFYYKTRIPKFGRDFSYHYPSCDLYFVGASSEVYRLNLEQGRYLNPLQTDAAENNVCDINSVHGLFATGTIEGRVECWDPRTRNRVGLLDCALNSVTADSEINSLPTISALKFNGALTMAVGTTTGQVLLYDLRSDKPLLVKDHQYGLPIKSVHFQDSLDLILSADSRIVKMWNKNSGKIFTSLEPEHDLNDVCLYPNSGMLLTANETPKMGIYYIPVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 5210 - protein, 662 aa, Homo sapiens
MQVSSLNEVKIYSLSCGKSLPEWLSDRKKRALQKKDVDVRRRIELIQDFEMPTVCTTIKVSKDGQYILATVVTFEILSDDYSKIVFLHNDRYIEFHSQSGFYYKTRIPKFGRDFSYHYPSCDLYFVGASSEVYRLNLEQGRYLNPLQTDAAENNVCDINSVHGLFATGTIEGRVECWDPRTRNRVGLLDCALNSVTADSEINSLPTISALKFNGALTMAVGTTTGQVLLYDLRSDKPLLVKDHQYGLPIKSVHFQDSLDLILSADSRIVKMWNKNSGKIFTSLEPEHDLNDVCLYPNSGMLLTANETPKMGIYYIPVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 5211 - protein, 638 aa, Homo sapiens
MPTVCTTIKVSKDGQYILATGTYKPRVRCYDTYQLSLKFERCLDSEVVTFEILSDDYSKIVFLHNDRYIEFHSQSGFYYKTRIPKFGRDFSYHYPSCDLYFVGASSEVYRLNLEQGRYLNPLQTDAAENNVCDINSVHGLFATGTIEGRVECWDPRTRNRVGLLDCALNSVTADSEINSLPTISALKFNGALTMAVGTTTGQVLLYDLRSDKPLLVKDHQYGLPIKSVHFQDSLDLILSADSRIVKMWNKNSGKIFTSLEPEHDLNDVCLYPNSGMLLTANETPKMGIYYIPVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 5212 - protein, 719 aa, Homo sapiens
MAALEEEFTLSSVVLSAGPEGLLGVEQSDKTDQFLVTDSGRTVILYKVSDQKPLGSWSVKQGQIITCPAVCNFQTGEYVVVHDNKVLRIWNNEDVNLDKVFKATLSAEVYRILSVQGTEPLVLFKEGAVRGLEALLADPQQKIETVISDEEVIKWTKFFVVFRHPVLIFITEKHGNYFAYVQMFNSRILTKYTLLLGQDENSVIKSFTASVDRKFISLMSLSSDGCIYETLIPIRPADPEKNQSLVKSLLLKAVVSGNARNGVALTALDQDHVAVLGSPLAASKECLSVWNIKFQTLQTSKELPQGTSGQLWYYGEHLFMLHGKSLTVIPYKCEVSSLAGALGKLKHSQDPGTHVVSHFVNWETPQGCGLGFQNSEQSRRILRRRKIEVSLQPEVPPSKQLLSTIMKDSEKHIEVEVRKFLALKQTPDFHTVIGDTVTGLLERCKAEPSFYPRNCLMQLIQTHVLSYSLCPDLMEIALKKKDVQLLQLCLQQFPDIPESVTCACLKIFLSIGDDSLQETDVNMESVFDYSINSVHDEKMEEQTEILQNGFNPEEDKCNNCDQELNKKPQDETKESTSCPVVQKRAALLNAILHSAYSETFLLPHLKDIPAQHITLFLKYLYFLYLKCSENATMTLPGIHPPTLNQIMDWICLLLDANFTVVVMMPEAKRLLINLYKLVKSQISVYSELNKIEVSFRELQKLNQEKNNRGLYSIEVLELF

SEQ ID NO: 5213 - protein, 537 aa, Homo sapiens
MFNSRILTKYTLLLGQDENSVIKSFTASVDRKFISLMSLSSDGCIYETLIPIRPADPEKNQSLVKSLLLKAVVSGNARNGVALTALDQDHVAVLGSPLAASKECLSVWNIKFQTLQTSKELPQGTSGQLWYYGEHLFMLHGKSLTVIPYKCEVSSLAGALGKLKHSQDPGTHVVSHFVNWETPQGCGLGFQNSEQSRRILRRRKIEVSLQPEVPPSKQLLSTIMKDSEKHIEVEVRKFLALKQTPDFHTVIGDTVTGLLERCKAEPSFYPRNCLMQLIQTHVLSYSLCPDLMEIALKKKDVQLLQLCLQQFPDIPESVTCACLKIFLSIGDDSLQETDVNMESVFDYSINSVHDEKMEEQTEILQNGFNPEEDKCNNCDQELNKKPQDETKESTSCPVVQKRAALLNAILHSAYSETFLLPHLKDIPAQHITLFLKYLYFLYLKCSENATMTLPGIHPPTLNQIMDWICLLLDANFTVVVMMPEAKRLLINLYKLVKSQISVYSELNKIEVSFRELQKLNQEKNNRGLYSIEVLELF

SEQ ID NO: 5214 - protein, 213 aa, Homo sapiens
MGRNKKKKRDGDDRRPRLVLSFDEEKRREYLTGFHKRKVERKKAAIEEIKQRLKEEQRKLREERHQEYLKMLAEREEALEEADELDRLVTAKTESVQYDHPNHTVTVTTISDLDLSGARLLGLTPPEGGAGDRSEEEASSTEKPTKALPRKSRDPLLSQRISSLTASLHAHSRKKVKRKHPRRAQDSKKPPRAPRTSKAQRRRLTGKARHSGE

SEQ ID NO: 5215 - protein, 213 aa, Homo sapiens; identical to SEQ ID NO: 5214

SEQ ID NO: 5216 - protein, 638 aa, Homo sapiens
MESERDMYRQFQDWCLRTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 5217 - protein, 422 aa, Homo sapiens
MHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 5218 - protein, 199 aa, Homo sapiens
MDQTMLDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNSRPIPSHLTSAVAESILASACESESRNAAKRMRLERQQ

SEQ ID NO: 5219 - protein, 353 aa, Homo sapiens
MGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 5220 - protein, 419 aa, Homo sapiens
MSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 5221 - protein, 564 aa, Homo sapiens
MADLMQETFLHHATDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 5222 - protein, 702 aa, Homo sapiens
MADSGLLLKRGSCRSTWLRVRKARPQLILSRRPRRRLGSLRWCGRRRLRWRLLQAQASGVDWREGARQVSRAAAARRPNTATPSPIPSPTPASEPESEPELESASSCHRPLLIPPVRPVGPGRALLLLPVEQGFTFSGICRVTCLYGQVQVFGFTISQGQPAQDIFSVYTHSCLSIHALHYSQPEKSKKELKREARNLLKSHLNLDDRRWSMQNFSPQCSIVLLEHLKTATVNFITSYPGSSYIFVQESPTPQIKPEYLALRSVGIRREKKRKGLQLTESTLSALEELVNVSCEEVDGCPVILVCGSQDVGKSTFNRYLINHLLNSLPCVDYLECDLGQTEFTPPGCISLLNITEPVLGPPFTHLRTPQKMVYYGKPSCKNNYENYIDIVKYVFSAYKRESPLIVNTMGWVSDQGLLLLIDLIRLLSPSHVVQFRSDHSKYMPDLTPQYVDDMDGLYTKSKTKMRNRRFRLAAFADALEFADEEKESPVEFTGHKLIGVYTDFAFRITPRNRESHNKILRDLSILSYLSQLQPPMPKPLSPLHSLTPYQVPFNAVALRITHSDVAPTHILYAVNASWVGLCKIQDDVRGYTNGPILLAQTPICDCLGFGICRGIDMEKRLYHILTPVPPEELRTVNCLLVGAIAIPHCVLKCQRGIEGTVPYVTTDYNFKLPGASEKIGAREPEEAHKEKPYRRPKFCRKMK

SEQ ID NO: 5223 - protein, 860 aa, Homo sapiens
MAASRSAGEAGPGGSQGRVVRMKRRGGRGPRRGPAGGGEKALKRLKLAVEEFVHATSEGEAPGGCEGRGAPVSFRPGGRKSRKELRKEKRHLRKARRLQRTAGPEQGPGLGGRSGAEEASGHRQDTEERARPAPSRDPSPPRKPRPSRVKAKATAATAKTRPSAAATAAARKRALLAANEEEDREIRKLERCLGLNKRKKKDGSSSVPLSFARDGLDYILGALESGKNSGLYDSSGEEEEDAGQTLPESDLESDSQDESEEEEEGDVEKEKKAQEAEAQSEDDDEDTEEEQGEEKEKGAQEKRRGKRVRFAEDEEKSENSSEDGDITDKSLCGSGEKYIPPHVRQAEETVDFKKKEELERLKKHVKGLLNRLSEPNMASISGQLEELYMAHSRKDMNDTLTSALMGACVTASAMPSRLMMEHVLLVSILHHTVGIEVGAHFLEAVVRKFDAIYKYGSEGKECDNLFTVIAHLYNFHVVQSLLIFDILKKLIGTFTEKDIELILLMLKNVGFSLRKDDALSLKELITEAQTKASGAGSEFQDQTRIRFMLETMLALKNNDMRKIPGYDPEPVEKLRKLQRALVRNAGSGSETQLRVSWDSVLSAEQTGRWWIVGSAWSGAPMIDNSHHTHLQKQLVGTVSSKILELARKQRMNTDIRRNIFCTIMTSEDFLDAFEKLLKLGLKDQQEREIIHVLMDCCLQEKTYNPFYAFLASKFCEYERRFQMTFQFSIWDKFRDLENLPATNFSNLVHLVAHLLKTKSLSLSILKVVEFSELDKPRVRFLRKVLSILLMETEVEDLSLIFTRVSDNPKLGVLREGLKLFISHFLLKNAQAHRSADEANVLREKADLATKCLQGKASLRM

SEQ ID NO: 5224 - protein, 1638 aa, Homo sapiens
MAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 5225 - protein, 1749 aa, Homo sapiens
MAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 5226 - protein, 72 aa, Homo sapiens
MQFTSISNSLTSTAAIGLSFTTSTTTTATFTTNTTTTITSGFTVNQNQLLSRGFENLVPYTSTVRFVFYMEK

SEQ ID NO: 5227 - protein, 266 aa, Homo sapiens
MQFTSISNSLTSTAAIGLSFTTSTTTTATFTTNTTTTITSGFTVNQNQLLSRGFENLVPYTSTVSVVATPVMTYGHLEGLINEWNLELEDQEKYFLLQATQVNAWDHTLIENGEMIRILHGEVNKVKLDQKRLEQELDFILSQQQELEFLLTYLEESTRDQSGLHYLQDADEEHVEIYRLAESIDAQLKQMAQDLKDVVNHLNTFESSSDTTDPLHQICRILNAHMDSLQWIDRNSGMLRRKVEVVTRVFEDYRHEEHAHNVNTAF

SEQ ID NO: 5228 - protein, 184 aa, Homo sapiens
MQFTSISNSLTSTAAIGLSFTTSTTTTATFTTNTTTTITSGFTVNQNQLLSRGFENLVPYTSTVSVVATPVMTYGHLEGLINEWNLELEDQEKYFLLQATQVNAWDHTLIENGEMIRILHGEVNKVKLDQKRLEQELDFILSQQQELEFLLTYLEESTRDQSGLHYLQDADEEHVEISTRSAEF

SEQ ID NO: 5229 - protein, 136 aa, Homo sapiens
MQFTSISNSLTSTAAIGLSFTTSTTTTATFTTNTTTTITSGFTVNQNQLLSRGFENLVPYTSTVSVVATPVMTYGHLEGLINEWNLELEDQEKYFLLQATQVNAWDHTLIENGEMIRILHGEVNKVKLDQKRLEQE

SEQ ID NO: 5230 - protein, 198 aa, Homo sapiens
  MOD_RES (1)..(1): Any amino acid
XPVMTYGHLEGLINEWNLELEDQEKYFLLQATQVNAWDHTLIENGEMIRILHGEVNKVKLDQKRLEQELDFILSQQQELEFLLTYLEESTRDQSGLHYLQDADEEHVEIYRLAESIDAQLKQMAQDLKDVVNHLNTFESSSDTTDPLHQICRILNAHMDSLQWIDRNSGMLRRKVEVVTRVFEDYRHEEHAHNVNTAF

SEQ ID NO: 5231 - protein, 460 aa, Homo sapiens
MAESENRKELSESSQEEAGNQIMVEGLGEHLERGEDAAAGLGDDGKCGEEAAAGLGEEGENGEDTAAGSGEDGKKGGDTDEDSEADRPKGLIGYVLDTDFVESLPVKVKYRVLALKKLQTRAANLESKFLREFHDIERKFAEMYQPLLEKRRQIINAIYEPTEEECEYKSDSEDCDDEEMCHEEMYGNEEGMVHEYVDEDDGYEDYYYDYAVEEEEEEEEEDDIEATGEENKEEEDPKGIPDFWLTVLKNVDTLTPLIKKYDEPILKLLTDIKVKLSDPGEPLSFTLEFHFKPNEYFKNELLTKTYVLKSKLAYYDPHPYRGTAIEYSTGCEIDWNEGKNVTLKTIKKKQKHRIWGTIRTVTEDFPKDSFFNFFSPHGITSNGRDGNDDFLLGHNLRTYIIPRSVLFFSGDALESQQEGVVREVNDAIYDKIIYDNWMAAIEEVKACCKNLEALVEDIDR

SEQ ID NO: 5232 - protein, 318 aa, Homo sapiens
MYQPLLEKRRQIINAIYEPTEEECEYKSDSEDCDDEEMCHEEMYGNEEGMVHEYVDEDDGYEDYYYDYAVEEEEEEEEEDDIEATGEENKEEEDPKGIPDFWLTVLKNVDTLTPLIKKYDEPILKLLTDIKVKLSDPGEPLSFTLEFHFKPNEYFKNELLTKTYVLKSKLAYYDPHPYRGTAIEYSTGCEIDWNEGKNVTLKTIKKKQKHRIWGTIRTVTEDFPKDSFFNFFSPHGITSNGRDGNDDFLLGHNLRTYIIPRSVLFFSGDALESQQEGVVREVNDAIYDKIIYDNWMAAIEEVKACCKNLEALVEDIDR

SEQ ID NO: 5233 - protein, 162 aa, Homo sapiens
MLFGRIPLRYAILMQMRFDGRLGFPGGFVDTQDRSLEDGLNRELREELGEAAAAFRVERTDYRSSHVGSGPRVVAHFYAKRLTLEELLAVEAGATRAKDHGLEVLGLVRVPLYTLRDGVGGLPTFLENSFIGSAREQLLEALQDLGLLQSGSISGLKIPAHH

SEQ ID NO: 5234 - protein, 195 aa, Homo sapiens
MAGARRLELGEALALGSGWRHACHALLYAPDPGMLFGRIPLRYAILMQMRFDGRLGFPGGFVDTQDRSLEDGLNRELREELGEAAAAFRVERTDYRSSHVGSGPRVVAHFYAKRLTLEELLAVEAGATRAKDHGLEVLGLVRVPLYTLRDGVGGLPTFLENSFIGSAREQLLEALQDLGLLQSGSISGLKIPAHH

SEQ ID NO: 5235 - protein, 159 aa, Homo sapiens
MQMRFDGRLGFPGGFVDTQDRSLEDGLNRELREELGEAAAAFRVERTDYRSSHVGSGPRVVAHFYAKRLTLEELLAVEAGATRAKDHGLEVLGLVRVPLYTLRDGVGGLPTFLENSFIGSAREQLLEAALHGPMKTEMRTLVLGREGRTWECFLIGSER

SEQ ID NO: 5236 - protein, 227 aa, Homo sapiens
MAGARRLELGEALALGSGWRHACHALLYAPDPGMLFGRIPLRYAILMQMRFDGRLGFPGGFVDTQDRSLEDGLNRELREELGEAAAAFRVERTDYRSSHVGSGPRVVAHFYAKRLTLEELLAVEAGATRAKDHGLEVGPAWDSVPFPISSSPKAFSPPRKHPWRKVFAPLTLPSPQLSWWSWDRDHLYSELVLPTWAFCKGLSHPLPGEILSRTHSSMSLCCSLLTV

SEQ ID NO: 5237 - protein, 255 aa, Homo sapiens
MLRPQRPGDLQLGASLYELVGYRQPPSSSSSSTSSTSSTSSSSTTAPLLPKAAREKPEAPAEPPGPGPGSGAHPGGSARPDAKEEQQQQLRRKINSRERKRMQDLNLAMDALREVILPYSAAHCQGAPGRKLSKIATLLLARNYILLLGSSLQELRRALGEGAGPAAPRLLLAGLPLLAAAPGSVLLAPGAVGPPDALRPAKYLSLALDEPPCGQFALPGGGAGGPGLCTCAVCKFPHLVPASLGLAAVQAQFSK

SEQ ID NO: 5238 - protein, 271 aa, Homo sapiens
MYYAVSQARVNAVPGTMLRPQRPGDLQLGASLYELVGYRQPPSSSSSSTSSTSSTSSSSTTAPLLPKAAREKPEAPAEPPGPGPGSGAHPGGSARPDAKEEQQQQLRRKINSRERKRMQDLNLAMDALREVILPYSAAHCQGAPGRKLSKIATLLLARNYILLLGSSLQELRRALGEGAGPAAPRLLLAGLPLLAAAPGSVLLAPGAVGPPDALRPAKYLSLALDEPPCGQFALPGGGAGGPGLCTCAVCKFPHLVPASLGLAAVQAQFSK

SEQ ID NO: 5239 - protein, 32 aa, Homo sapiens
  MOD_RES (1)..(1): Any amino acid
XGPGLCTCAVCKFPHLVPASLGLAAVQAQFSK

SEQ ID NO: 5240 - protein, 494 aa, Homo sapiens
MELSLESLGGLHSVAHAQAGELLSPGHARSAAAQHRGLVAPGRPGLVAGMASLLDGGGGGGGGGAGGAGGAGSAGGGADFRGELAGPLHPAMGMACEAPGLGGTYTTLTPLQHLPPLAAVADKFHQHAAAAAVAGAHGGHPHAHPHPAAAPPPPPPPQRLAASVSGSFTLMRDERAALASVGHLYGPYGKELPAMGSPLSPLPNALPPALHGAPQPPPPPPPPPLAAYGPPGHLAGDKLLPPAAFEPHAALLGRAEDALARGLPGGGGGTGSGGAGSGSAAGLLAPLGGLAAAGAHGPHGGGGGPGGSGGGPSAGAAAEEINTKEVAQRITAELKRYSIPQAIFAQRILCRSQGTLSDLLRNPKPWSKLKSGRETFRRMWKWLQEPEFQRMSALRLAACKRKEQEQQKERALQPKKQRLVFTDLQRRTLIAIFKENKRPSKEMQVTISQQLGLELNTVSNFFMNARRRCMNRWAEEPSTAPGGPAGATATFSKA

SEQ ID NO: 5241 - protein, 229 aa, Homo sapiens
MAAQPLRHRSRCATPPRGDFCGGTERAIDQASFTTSMEWDTQVVKGSSPLGPAGLGAEEPAAGPQLPSWLQPERCAVFQCAQCHAVLADSVHLAWDLSRSLGAVVFSRVTNNVVLEAPFLVGIEGSLKGSTYNLLFCGSCGIPVGFHLYSTHAALAALRGHFCLSSDKMVCYLLKTKAIVNASEMDIQNVPLSEKIAELKEKIVLTHNRLKSLMKILSEVTPDQSKPEN

SEQ ID NO: 5242 - protein, 275 aa, Homo sapiens
MPKVFLVKRRSLGVSVRSWDELPDEKRADTYIPVGLGRLLHDPPEDCRSDGGSSSGSGSSSAGEPGGAESSSSPHAPESETPEPGDAEGPDGHLATKQRPVARSKIKFTTGTCSDSVVHSCDLCGKGFRLQRMLNRHLKCHNQVKRHLCTFCGKGFNDTFDLKRHVRTHTGIRPYKCNVCNKAFTQRCSLESHLKKIHGVQQQYAYKQRRDKLYVCEDCGYTGPTQEDLYLHVNSAHPGSSFLKKTSKKLAALLQGKLTSAHQENTSLSEEEERK

SEQ ID NO: 5243 - protein, 422 aa, Homo sapiens [sequence omitted]

SEQ ID NO: 5244 - protein, 436 aa, Homo sapiens
MQNSHSGVNQLGGVFVNGRPLPDSTRQKIVELAHSGARPCDISRILQTHADAKVQVLDNQNVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPRLQ

SEQ ID NO: 5245 - protein, 422 aa, Homo sapiens [sequence omitted]

SEQ ID NO: 5246 - protein, 422 aa, Homo sapiens [sequence omitted]

SEQ ID NO: 5247 - protein, 436 aa, Homo sapiens; identical to SEQ ID NO: 5244

SEQ ID NO: 5248 - protein, 422 aa, Homo sapiens [sequence omitted]

SEQ ID NO: 5249 - protein, 436 aa, Homo sapiens; identical to SEQ ID NO: 5244

SEQ ID NO: 5250 - protein, 422 aa, Homo sapiens [sequence omitted]

SEQ ID NO: 5251 - protein, 436 aa, Homo sapiens; identical to SEQ ID NO: 5244

SEQ ID NO: 5252 - protein, 66 aa, Homo sapiens
MQNSHSGVNQLGGVFVNGRPLPDSTRQKIVELAHSGARPCDISRILQTHADAKVQVLDNQNVSNGC

SEQ ID NO: 5253 - protein, 39 aa, Homo sapiens
MQNSHSGVNQLGGVFVNGRPLPDSTRQKIVELAHSGARP

SEQ ID NO: 5254 - protein, 124 aa, Homo sapiens
MQNSHSGVNQLGGVFVNGRPLPDSTRQKIVELAHSGARPCDISRILQTHADAKVQVLDNQNVSNGCVSSINRVLRNLASEKQQMGADGMYDKLRMLNGQTGSWGTRPGWYPGTSVPGQPTQDGC

SEQ ID NO: 5255 - protein, 58 aa, Homo sapiens
MQNSHSGVNQLGGVFVNGRPLPDSTRQKIVELAHSGARPCDISRILQVSNGCVSKILG

SEQ ID NO: 5256 - protein, 2 aa, Homo sapiens
MQ

SEQ ID NO: 5257 - protein, 377 aa, Homo sapiens [sequence omitted]

SEQ ID NO: 5258 - protein, 542 aa, Homo sapiens
MSPCPEEAAMRREVVKRIETVVKDLWPTADVQIFGSFSTGLYLPTSDIDLVVFGKWERPPLQLLEQALRKHNVAEPCSIKVLDKATVPIIKLTDQETEVKVDISFNMETGVRAAEFIKNYMKKYSLLPYLILVLKQFLLQRDLNEVFTGGISSYSLILMAISFLQLHPRIDARRADENLGMLLVEFFELYGRNFNYLKTGIRIKEGGAYIAKEEIMKAMTSGYRPSMLCIEDPLLPGNDVGRSSYGAMQVKQVFDYAYIVLSHAVSPLARSYPNRDAESTLGRIIKVTQEVIDYRRWIKEKWGSKAHPSPGMDSRIKIKERIATCNGEQTQNREPESPYGQRLTLSLSSPQLLSSGSSASSVSSLSGSDVDSDTPPCTTPSVYQFSLQAPAPLMAGLPTALPMPSGKPQPTTSRTLIMTTNNQTRFTIPPPTLGVAPVPCRQAGVEGTASLKAVHHMSSPAIPSASPNPLSSPHLYHKQHNGMKLSMKGSHGHTQGGGYSSVGSGGVRPPVGNRGHHQYNRTGWRRKKHTHTRDSLPVSLSR

SEQ ID NO: 5259 - protein, 27 aa, Homo sapiens
MSPCPEEAAMRREVVKRIETVVKDLWP

SEQ ID NO: 5260 - protein, 364 aa, Homo sapiens
MALALLEDWCRIMSVDEQKSLMVTGIPADFEEAEIQEVLQETLKSLGRYRLLGKIFRKQENANAVLLELLEDTDVSAIPSEVQGKGGVWKVIFKTPNQDTEFLERLNLFLEKEGQTVSGMFRALGQEGVSPATVPCISPELLAHLLGQAMAHAPQPLLPMRYRKLRVFSGSAVPAPEEESFEVWLEQATEIVKEWPVTEAEKKRWLAESLRGPALDLMHIVQADNPSISVEECLEAFKQVFGSLESRRTAQVRYLKTYQEEGEKVSAYVLRLETLLRRAVEKRAIPRRIADQVRLEQVMAGATLNQMLWCRLRELKDQGPPPSFLELMKVIREEEEEEASFENESIEEPEERDGYGRWNHEGDD

SEQ ID NO: 5261 - protein, 463 aa, Homo sapiens
MPLTLLQDWCRGEHLNTRRCMLILGIPEDCGEDEFEETLQEACRHLGRYRVIGRMFRREENAQAILLELAQDIDYALLPREIPGKGGPWEVIVKPRNSDGEFLNRLNRFLEEERRTVSDMNRVLGSDTNCSAPRVTISPEFWTWAQTLGAAVQPLLEQMLYRELRVFSGNTISIPGALAFDAWLEHTTEMLQMWQVPEGEKRRRLMECLRGPALQVVSGLRASNASITVEECLAALQQVFGPVESHKIAQVKLCKAYQEAGEKVSSFVLRLEPLLQRAVENNVVSRRNVNQTRLKRVLSGATLPDKLRDKLKLMKQRRKPPGFLALVKLLREEEEWEATLGPDRESLEGLEVAPRPPARITGVGAVPLPASGNSFDVRPSQGYRRRRGRGQHRRGGVARAGSRGSRKRKRHTFCYSCGEDGHIRVQCINPSNLLLVKQKKQAAVESGNGNWAWDKSHPKSKAK

SEQ ID NO: 5262 - protein, 463 aa, Homo sapiens; identical to SEQ ID NO: 5261

SEQ ID NO: 5263 - protein, 463 aa, Homo sapiens; identical to SEQ ID NO: 5261

SEQ ID NO: 5264 - protein, 252 aa, Homo sapiens
MESEMETQSARAEEGFTQVTRKGGRRAKKRQAEQLSAAGEGGDAGRMDTEEARPAKRPVFPPLCGDGLLSGKEETRKIPVPANRYTPLKENWMKIFTPIVEHLGLQIRFNLKSRNVEIRTCKETKDVSALTKAADFVKAFILGFQVEDALALIRLDDLFLESFEITDVKPLKGDHLSRAIGRIAGKGGKTKFTIENVTRTRIVLADVKVHILGSFQNIKMARTAICNLILGNPPSKVYGNIRAVASRSADRF

SEQ ID NO: 5265 - protein, 773 aa, Homo sapiens
MKMRGEKRRDKVNPKSSQRKLNWIPSFPTYDYFNQVTLQLLDGFMITLSTDGVIICVAENISSLLGHLPAEIVGKKLLSLLPDEEKDEVYQKIILKFPLLNSETHIEFCCHLKRGNVEHGDSSAYENVKFIVNVRDICNEFPVVFSGLFSSHLCADFAACVPQEDRLYLVGNVCILRTQLLQQLYTSKAVSDEAVLTQDSDEEPFVGELSSSQGQRGHTSMKAVYVEPAAAAAAAAISDDQIDIAEVEQYGPQENVHMFVDSDSTYCSSTVFLDTMPESPALSLQDFRGEPEVNPLYRADPVDLEFSVDQVDSVDQEGPMDQQDPENPVAPLDQAGLMDPVDPEDSVDLGAAGASAQPLQPSSPVAYDIISQELELMKKLKEQLEERTWLLHDAIQNQQNALELMMDHLQKQPNTLRHVVIPDLQSSEAVPKKQQKQHAGQVKRPLPHPKDVKCFCGLSLSNSLKNTGELQEPCVAFNQQQLVQQEQHLKEQQRQLREQLQQLREQRKVQKQKKMQEKKKLQEQKMQEKKKLQEQRRQKKKKLQERKKWQGQMLQKEPEEEQQKQQLQEQPLKHNVIVGNERVQICLQNPRDVSVPLCNHPVRFLQAQPIVPVQRAAEQQPSGFYQDENCGQQEDESQSFYPEAYQGPPVNQLPLIDTSNSEAISSSSIPQFPITSDSTISTLETPQDYIRLWQELSDSLGPVVQVNTWSCDEQGTLHGQPTYHQVQVSEVGVEGPPDPQAFQGPAAYQPDQMRSAEQTRLMPAEQRDSNKPC

SEQ ID NO: 5266 - protein, 1022 aa, Homo sapiens
MFREVKYYAVGDIDPQVIQLLKAGKAKEVSYNALASHIISEDGDNPEVGEAREVFDLPVVKVSSEDRSALWALVTFYGGDCQLTLNKKCTHLIVPEPKGEKYECALKRASIKIVTPDWVLDCVSEKTKKDEAFYHPRLIIYEEEEEEEEEEEEVENEEQDSQNEGSTDEKSSPASSQEGSPSGDQQFSPKSNTEKSKGELMFDDSSDSSPEKQERNLNWTPAEVPQLAAAKRRLPQGKEPGLINLCANVPPVPGNILPPEVRGNLMAAGQNLQSSERSEMIATWSPAVRTLRNITNNADIQQMNRPSNVAHILQTLSAPTKNLEQQVNHSQQGHTNANAVLFSQVKVTPETHMLQQQQQAQQQQQQHPVLHLQPQQIMQLQQQQQQQISQQPYPQQPPHPFSQQQQQQQQAHPHQFSQQQLQFPQQQLHPPQQLHRPQQQLQPFQQQHALQQQFHQLQQHQLQQQQLAQLQQQHSLLQQQQQQQIQQQQLQRMHQQQQQQQMQSQTAPHLSQTSQALQHQVPPQQPPQQQQQQQPPPSPQQHQLFGHDPAVEIPEEGFLLGCVFAIADYPEQMSDKQLLATWKRIIQAHGGTVDPTFTSRCTHLLCESQVSSAYAQAIRERKRCVTAHWLNTVLKKKKMVPPHRALHFPVAFPPGGKPCSQHIISVTGFVDSDRDDLKLMAYLAGAKYTGYLCRSNTVLICKEPTGLKYEKAKEWRIPCVNAQWLGDILLGNFEALRQIQYSRYTAFSLQDPFAPTQHLVLNLLDAWRVPLKVSAELLMSIRLPPKLKQNEVANVQPSSKRARIEDVPPPTKKLTPELTPFVLFTGFEPVQVQQYIKKLYILGGEVAESAQKCTHLIASKVTRTVKFLTAISVVKHIVTPEWLEECFRCQKFIDEQNYILRDAEAEVLFSFSLEESLKRAHVSPLFKAKYFYITPGICPSLSTMKAIVECAGGKVLSKQPSFRKLMEHKQNSSLSEIILISCENDLHLCREYFARGIDVHNAEFVLTGVLTQTLDYESYKFN

SEQ ID NO: 5267 - protein, 893 aa, Homo sapiens
VRVLIQAGALCWSLPELSQGEVGKGACPAEVGKHRDHLPSSDPVLMQAEASVVMCWVSSEDRSALWALVTFYGGDCQLTLNKKCTHLIVPEPKGEKYECALKRASIKIVTPDWVLDCVSEKTKKDEAFYHPRLIIYEEEEEEEEEEEEVENEEQDSQNEGSTDEKSSPASSQEGSPSGDQQFSPKSNTEKSKGELMFDDSSDSSPEKQERNLNWTPAEVPQLAAAKRRLPQGKEPGLINLCANVPPVPGNILPPEVRGNLMAAGQNLQSSERSEMIATWSPAVRTLRNITNNADIQQMNRPSNVAHILQTLSAPTKNLEQQVNHSQQGHTNANAVLFSQVKVTPETHMLQQQQQAQQQQQQHPVLHLQPQQIMQLQQQQQQQISQQPYPQQPPHPFSQQQQQQQQPPPSPQQHQLFGHDPAVEIPEEGFLLGCVFAIADYPEQMSDKQLLATWKRIIQAHGGTVDPTFTSRCTHLLCESQVSSAYAQAIRERKRCVTAHWLNTVLKKKKMVPPHRALHFPVAFPPGGKPCSQHIISVTGFVDSDRDDLKLMAYLAGAKYTGYLCRSNTVLICKEPTGLKYEKAKEWRIPCVNAQWLGDILLGNFEALRQIQYSRYTAFSLQDPFAPTQHLVLNLLDAWRVPLKVSAELLMSIRLPPKLKQNEVANVQPSSKRARIEDVPPPTKKLTPELTPFVLFTGFEPVQVQQYIKKLYILGGEVAESAQKCTHLIASKVTRTVKFLTAISVVKHIVTPEWLEECFRCQKFIDEQNYILRDAEAEVLFSFSLEESLKRAHVSPLFKAKYFYITPGICPSLSTMKAIVECAGGKVLSKQPSFRKLMEHKQNSSLSEIILISCENDLHLCREYFARGIDVHNAEFVLTGVLTQTLDYESYKFN

SEQ ID NO: 5268 - protein, 1069 aa, Homo sapiens
MSDQAPKVPEEMFREVKYYAVGDIDPQVIQLLKAGKAKEVSYNALASHIISEDGDNPEVGEAREVFDLPVVKPSWVILSVQCGTLLPVNGFSPESCQIFFGITACLSQVSSEDRSALWALVTFYGGDCQLTLNKKCTHLIVPEPKGEKYECALKRASIKIVTPDWVLDCVSEKTKKDEAFYHPRLIIYEEEEEEEEEEEEVENEEQDSQNEGSTDEKSSPASSQEGSPSGDQQFSPKSNTEKSKGELMFDDSSDSSPEKQERNLNWTPAEVPQLAAAKRRLPQGKEPGLINLCANVPPVPGNILPPEVRGNLMAAGQNLQSSERSEMIATWSPAVRTLRNITNNADIQQMNRPSNVAHILQTLSAPTKNLEQQVNHSQQGHTNANAVLFSQVKVTPETHMLQQQQQAQQQQQQHPVLHLQPQQIMQLQQQQQQQISQQPYPQQPPHPFSQQQQQQQQAHPHQFSQQQLQFPQQQLHPPQQLHRPQQQLQPFQQQHALQQQFHQLQQHQLQQQQLAQLQQQHSLLQQQQQQQIQQQQLQRMHQQQQQQQMQSQTAPHLSQTSQALQHQVPPQQPPQQQQQQQPPPSPQQHQLFGHDPAVEIPEEGFLLGCVFAIADYPEQMSDKQLLATWKRIIQAHGGTVDPTFTSRCTHLLCESQVSSAYAQAIRERKRCVTAHWLNTVLKKKKMVPPHRALHFPVAFPPGGKPCSQHIISVTGFVDSDRDDLKLMAYLAGAKYTGYLCRSNTVLICKEPTGLKYEKAKEWRIPCVNAQWLGDILLGNFEALRQIQYSRYTAFSLQDPFAPTQHLVLNLLDAWRVPLKVSAELLMSIRLPPKLKQNEVANVQPSSKRARIEDVPPPTKKLTPELTPFVLFTGFEPVQVQQYIKKLYILGGEVAESAQKCTHLIASKVTRTVKFLTAISVVKHIVTPEWLEECFRCQKFIDEQNYILRDAEAEVLFSFSLEESLKRAHVSPLFKAKYFYITPGICPSLSTMKAIVECAGGKVLSKQPSFRKLMEHKQNSSLSEIILISCENDLHLCREYFARGIDVHNAEFVLTGVLTQTLDYESYKFN

SEQ ID NO: 5269 - protein, 1069 aa, Homo sapiens; identical to SEQ ID NO: 5268

SEQ ID NO: 5270 - protein, 1555 aa, Homo sapiens
MSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHRESWSSTKGILSPRAPKQQQHRLSVDANLQIPKELTLASKRELLQKTSERLASGEITQDDFLVVVHQIRQLFQYQEGVREEQRSPFNDRFPLKRPRYEDSDKPFVDSPASRFAGLDTNQRLTALAEDRPLFDGPSRPSVARDGPTKMIFEGPNKLSPRIDGPPTPASLRFDGSPGQMGGGGPLRFEGPQGQLGGGCPLRFEGPPGPVGTPLRFEGPIGQAGGGGFRFEGSPGLRFEGSPGGLRFEGPGGQPVGGLRFEGHRGQPVGGLRFEGPHGQPVGGLRFDNPRGQPVGGLRFEGGHGPSGAAIRFDGPHGQPGGGIRFEGPLLQQGVGMRFEGPHGQSVAGLRFEGQHNQLGGNLRFEGPHGQPGVGIRFEGPLVQQGGGMRFEGPSVPGGGLRIEGPLGQGGPRFEGCHALRFDGQPGQPSLLPRFDGLHGQPGPRFERTPGQPGPQRFDGPPGQQVQPRFDGVPQRFDGPQHQQASRFDIPLGLQGTRFDNHPSQRLESVSFNQTGPYNDPPGNAFNAPSQGLQFQRHEQIFDSPQGPNFNGPHGPGNQSFSNPLNRASGHYFDEKNLQSSQFGNFGNIPAPMTVGNIQASQQVLSGVAQPVAFGQGQQFLPVHPQNPGFVQNPSGALPKAYPDNHLSQVDVNELFSKLLKTGILKLSQTDSATTQVSEVTAQPPPEEEEDQNEDQDVPDLTNFTVEELKQRYDSVINRLYTGIQCYSCGMRFTTSQTDVYADHLDWHYRQNRTEKDVSRKVTHRRWYYSLTDWIEFEEIADLEERAKSQFFEKVHEEVVLKTQEAAKEKEFQSVPAGPAGAVESCEICQEQFEQYWDEEEEEWHLKNAIRVDGKIYHPSCYEDYQNTSSFDCTPSPSKTPVENPLNIMLNIVKNELQEPCDSPKVKEERIDTPPACTEESIATPSEIKTENDTVESV

SEQ ID NO: 5271 - protein, 784 aa, Homo sapiens
MSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHRESWSSTKGILSPRAPKQQQHRLSVDANLQIPKELTLASKRELLQKTSERLASGEITQDDFLVVVHQIRQLFQYQEGVREEQRSPFNDRFPLKRPRYEDSDKPFVDSPASRFAGLDTNQRLTALAEDRPLFDGPSRPSVARDGPTKMIFEGPNKLSPRIDGPP

SEQ ID NO: 5272 - protein, 1447 aa, Homo sapiens
MAHSKTRTNDGKITYPPGVKEISDKISKEEMVRRLKMVVKTFMDMDQDSEEEKELYLNLALHLASDFFLKHPDKDVRLLVACCLADIFRIYAPEAPYTSPDKLKDIFMFITRQLKGLEDTKSPQFNRYFYLLENIAWVKSYNICFELEDSNEIFTQLYRTLFSVINNGHNQKVHMHMVDLMSSIICEGDTVSQELLDTVLVNLVPAHKNLNKQAYDLAKALLKRTAQAIEPYITNFFNQVLMLGKTSISDLSEHVFDLILELYNIDSHLLLSVLPQLEFKLKSNDNEERLQVVKLLAKMFGAKDSELASQNKPLWQCYLGRFNDIHVPIRLECVKFASHCLMNHPDLAKDLTEYLKVRSHDPEEAIRHDVIVSIVTAAKKDILLVNDHLLNFVRERTLDKRWRVRKEAMMGLAQIYKKYALQSAAGKDAAKQIAWIKDKLLHIYYQNSIDDRLLVERIFAQYMVPHNLETTERMKCLYYLYATLDLNAVKALNEMWKCQNLLRHQVKDLLDLIKQPKTDASVKAIFSKVMVITRNLPDPGKAQDFMKKFTQVLEDDEKIRKQLEVLVSPTCSCKQAEGCVREITKKLGNPKQPTNPFLEMIKFLLERIAPVHIDTESISALIKQVNKSIDGTADDEDEGVPTDQAIRAGLELLKVLSFTHPISFHSAETFESLLACLKMDDEKVAEAALQIFKNTGSKIEEDFPHIRSALLPVLHHKSKKGPPRQAKYAIHCIHAIFSSKETQFAQIFEPLHKSLDPSNLEHLITPLVTIGHIALLAPDQFAAPLKSLVATFIVKDLLMNDRLPGKKTTKLWVPDEEVSPETMVKIQAIKMMVRWLLGMKNNHSKSGTSTLRLLTTILHSDGDLTEQGKISKPDMSRLRLAAGSAIVKLAQEPCYHEIITLEQYQLCALAINDECYQVRQVFAQKLHKGLSRLRLPLEYMAICALCAKDPVKERRAHARQCLVKNINVRREYLKQHAAVSEKLLSLLPEYVVPYTIHLLAHDPDYVKVQDIEQLKDVKECLWFVLEILMAKNENNSHAFIRKMVENIKQTKDAQGPDDAKMNEKLYTVCDVAMNIIMSKSTTYSLESPKDPVLPARFFTQPDKNFSNTKNYLPPEMKSFFTPGKPKTTNVLGAVNKPLSSAGKQSQTKSSRMETVSNASSSSNPSSPGRIKGRLDSSEMDHSENEDYTMSSPLPGKKSDKRDDSDLVRSELEKPRGRKKTPVTEQEEKLGMDDLTKLVQEQKPKGSQRSRKRGHTASESDEQQWPEEKRLKEDILENEDEQNSPPKKGKRGRPPKPLGGGTPKEEPTMKTSKKGSKKKSGPPAPEEEEEEERQSGNTEQKSKSKQHRVSRRAQQRAESPESSAIESTQSTPQKGRGRPSKTPSPSQPKKNVRVGRSKQAATKENDSSEEVDVFQGSSPVDDIPQEETEEEEVSTVNVRRRSAKRERR

SEQ ID NO: 5273 - protein, 1302 aa, Homo sapiens
MAHSKTRTNDGKITYPPGVKEISDKISKEEMVRRLKMVVKTFMDMDQDSEEEKELYLNLALHLASDFFLKHPDKDVRLLVACCLADIFRIYAPEAPYTSPDKLKDIFMFITRQLKGLEDTKSPQFNRYFYLLENIAWVKSYNICFELEDSNEIFTQLYRTLFSVINNGHNQKVHMHMVDLMSSIICEGDTVSQELLDTVLVNLVPAHKNLNKQAYDLAKALLKRTAQAIEPYITNFFNQVLMLGKTSISDLSEHVFDLILELYNIDSHLLLSVLPQLEFKLKSNDNEERLQVVKLLAKMFGAKDSELASQNKPLWQCYLGRFNDIHVPIRLECVKFASHCLMNHPDLAKDLTEYLKVRSHDPEEAIRHDVIVSIVTAAKKDILLVNDHLLNFVRERTLDKRWRVRKEAMMGLAQIYKKYALQSAAGKDAAKQIAWIKDKLLHIYYQNSIDDRLLVERIFAQYMVPHNLETTERMKCLYYLYATLDLNAVKALNEMWKCQNLLRHQVKDLLDLIKQPKTDASVKAIFSKVMVITRNLPDPGKAQDFMKKFTQVLEDDEKIRKQLEVLVSPTCSCKQAEGCVREITKKLGNPKQPTNPFLEMIKFLLERIAPVHIDTESISALIKQVNKSIDGTADDEDEGVPTDQAIRAGLELLKVLSFTHPISFHSAETFESLLACLKMDDEKVAEAALQIFKNTGSKIEEDFPHIRSALLPVLHHKSKKGPPRQAKYAIHCIHAIFSSKETQFAQIFEPLHKSLDPSNLEHLITPLVTIGHIALLAPDQFAAPLKSLVATFIVKDLLMNDRLPGKKTTKLWVPDEEVSPETMVKIQAIKMMVRWLLGMKNNHSKSGTSTLRLLTTILHSDGDLTEQGKISKPDMSRLRLAAGSAIVKLAQEPCYHEIITLEQYQLCALAINDECYQVRQVFAQKLHKGLSRLRLPLEYMAICALCAKDPVKERRAHARQCLVKNINVRREYLKQHAAVSEKLLSLLPEYVVPYTIHLLAHDPDYVKVQDIEQLKDVKECLWFVLEILMAKNENNSHAFIRKMVENIKQTKDAQGPDDAKMNEKLYTVCDVAMNIIMSKSTTYSLESPKDPVLPARFFTQPDKNFSNTKNYLPPEMKSFFTPGKPKTTNVLGAVNKPLSSAGKQSQTKSSRMETVSNASSSSNPSSPGRIKGRLDSSEMDHSENEDYTMSSPLPGKKSDKRDDSDLVRSELEKPRGRKKTPVTEQEEKLGMDDLTKLVQEQKPKGSQRSRKRGHTASESDEQQWPEEKRLKEDILENEDEQNSLPLHQKDASDRRTTMQIVK

SEQ ID NO: 5274 - protein, 704 aa, Homo sapiens
MANENHGSPREEASLLSHSPGTSNQSQPCSPKPIRLVQDLPEELVHAGWEKCWSRRENRPYYFNRFTNQSLWEMPVLGQHDVISDPLGLNATPLPQDSSLVETPPAENKPRKRQLSEEQPSGNGVKKPKIEIPVTPTGQSVPSSPSIPGTPTLKMWGTSPEDKQQAALLRPTEVYWDLDIQTNAVIKHRGPSEVLPPHPEVELLRSQLILKLRQHYRELCQQREGIEPPRESFNRWMLERKVVDKGSDPLLPSNCEPVVSPSMFREIMNDIPIRLSRIKFREEAKRLLFKYAEAARRLIESRSASPDSRKVVKWNVEDTFSWLRKDHSASKEDYMDRLEHLRRQCGPHVSAAAKDSVEGICSKIYHISLEYVKRIREKHLAILKENNISEEVEAPEVEPRLVYCYPVRLAVSAPPMPSVEMHMENNVVCIRYKGEMVKVSRNYFSKLWLLYRYSCIDDSAFERFLPRVWCLLRRYQMMFGVGLYEGTGLQGSLPVHVFEALHRLFGVSFECFASPLNCYFRQYCSAFPDTDGYFGSRGPCLDFAPLSGSFEANPPFCEELMDAMVSHFERLLESSPEPLSFIVFIPEWREPPTPALTRMEQSRFKRHQLILPAFEHEYRSGSQHICKKEEMHYKAVHNTAVLFLQNDPGFAKWAPTPERLQELSAAYRQSGRSHSSGSSSSSSSEAKDRDSGREQGPSREPHPT

SEQ ID NO: 5275 - protein, 710 aa, Homo sapiens [sequence omitted]

SEQ ID NO: 5276 - protein, 165 aa, Homo sapiens
MSVTLHTDVGDIKIEVFCERTPKTCEMESRCVPQAGVQWRDLGSLQPPPPGFKQVFCLSLPRTGRGGNSIWGKKFEDEYSEYLKHNVRGVVSMANNGPNTNGSQFFITYGKQPHLDMKYTVFGKVIDGLETLDELEKLPVNEKTYRPLNDVHIKDITIHANPFAQ

SEQ ID NO: 5277 - protein, 161 aa, Homo sapiens
MSVTLHTDVGDIKIEVFCERTPKTCENFLALCASNYYNGCIFHRNIKGFMVQTGDPTGTGRGGNSIWGKKFEDEYSEYLKHNVRGVVSMANNGPNTNGSQFFITYGKQPHLDMKYTVFGKVIDGLETLDELEKLPVNEKTYRPLNDVHIKDITIHANPFAQ

SEQ ID NO: 5278 - protein, 165 aa, Homo sapiens; identical to SEQ ID NO: 5276

SEQ ID NO: 5279 - protein, 80 aa, Homo sapiens
MSVTLHTDVGDIKIEVFCERTPKTCENFLALCASNYYNGCIFHRNIKGFMVQTGDPTGTGRGGNSIWGKKFEDEYSEYLK

SEQ ID NO: 5280 - protein, 646 aa, Homo sapiens
MAAESGSDFQQRRRRRRDPEEPEKTELSERELAVAVAVSQENDEENEERWVGPLPVEATLAKKRKVLEFERVYLDNLPSASMYERSYMHRDVITHVVCTKTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNRCVRILGKQENIRVMQLALFQGIAKKHRAATTIEMKASENPVLQNIQADPTIVCTSFKKNRFYMFTKREPEDTKSADSDRDVFNEKPSKEEVMAATQAEGPKRVSDSAIIHTSMGDIHTKLFPVECPKTVENFCVHSRNGYYNGHTFHRIIKGFMIQTGDPTGTGMGGESIWGGEFEDEFHSTLRHDRPYTLSMANAGSNTNGSQFFITVVPTPWLDNKHTVFGRVTKGMEVVQRISNVKVNPKTDKPYEDVSIINITVK

SEQ ID NO: 5281 - protein, 616 aa, Homo sapiens
MRRTKSAGLDLYLWRQHWPRRGKQPHEVGISNSYLVLEFERVYLDNLPSASMYERSYMHRDVITHVVCTKTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNRCVRILGKQENIRVMQLALFQGIAKKHRAATTIEMKASENPVLQNIQADPTIVCTSFKKNRFYMFTKREPEDTKSADSDRDVFNEKPSKEEVMAATQAEGPKRVSDSAIIHTSMGDIHTKLFPVECPKTVENFCVHSRNGYYNGHTFHRIIKGFMIQTGDPTGTGMGGESIWGGEFEDEFHSTLRHDRPYTLSMANAGSNTNGSQFFITVVPTPWLDNKHTVFGRVTKGMEVVQRISNVKVNPKTDKPYEDVSIINITVK

SEQ ID NO: 5282 - protein, 490 aa, Homo sapiens
MKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNRCVRILGKQENIRVMQLALFQGIAKKHRAATTIEMKASENPVLQNIQADPTIVCTSFKKNRFYMFTKREPEDTKSADSDRDVFNEKPSKEEVMAATQAEGPKRVSDSAIIHTSMGDIHTKLFPVECPKTVENFCVHSRNGYYNGHTFHRIIKGFMIQTGDPTGTGMGGESIWGGEFEDEFHSTLRHDRPYTLSMANAGSNTNGSQFFITVVPTPWLDNKHTVFGRVTKGMEVVQRISNVKVNPKTDKPYEDVSIINITVK

SEQ ID NO: 5283 - protein, 301 aa, Homo sapiens
MATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 5284 - protein, 296 aa, Homo sapiens
MATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEKQEESAITSQPRSWKLT

SEQ ID NO: 5285 - protein, 314 aa, Homo sapiens
MATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEVAPDTKASKARGSRKNKDGQERNWGKSQKVESHTI

SEQ ID NO: 5286 - protein, 2080 aa, Homo sapiens
MSSSPSRSAADIYIREYFHSHVSGGHPEATPLRVMYTDRPLSQTDPVTLQYCCLTDDRQAFRPPTRAELARHRVVVTTTSQARELRVPVGFFSHILIDEAAQMLECEALTPLAYASHGTRLVLAGDHMQVTPRLFSVARARAAEHTLLHRLFLCYQQETHEVARQSRLVFHENYRCTDAIVSFISRHFYVAKGNPIHARGKVPPHPRHYPLMFCHVAGSPDRDMSMASWLNLAEIAQVVEKVQEAYNTWPSCWGGREQRCICVVSHGAQVSALRQELRRRDLGQVSVGSFEILPGRQFRVVVLSTVHTCQSLLSPGALAPEFFTDARVLNTVLTRAQSQLVVVGDAVALCSFGACGKLWESFIRECVERHSVCPEGLSMEQVEQGVAQRRRWPPRGTQAGAAGNWEAAPEPVGDLAEEQAAVVTAMVKAEPGDEALSPASRDITATTAQTEAAAAPAGDAVKEDVVPGACAAGAAAAAGVESTEAEDAEADFWPWDGELNADDAILRELLDESQKVMVTVGEDGLLDTVARPESLQQARLYENLPPAALRKLLHAEPERYRHCSFVPETFERASAIPLDDASSGPIQVRGRLDCGMAFAGDEVLVQLLSGDKAPEGRLRGRVLGVLKRKRHELAFVCRMDTWDPRIMVPINGSVTKIFVAELKDPSQVPIYSLRKGRLQRVGLERLTAEARHSRLFWVQIVLWRQGFYYPLGIVREVLPEASTWEQGLRILGLEYSLRVPPSDQATITKVLQKYHTELGRVAGRREDCRAFLTFTVDPQGACNLDDALSVRDLGPRCEVAVHITDVASFVPRDGVLDVEARRQGAAFYAPGREPVPMLPASLCQDVLSLLPGRDRLAISLFLTMEKASGQLKSLRFAPSVVQSDRQLSYEEAEEVIRQHPGAGRELPARLDSVDACVVAACYFSRLLRRHRLRSDCFYEQPDEDGTLGFRAAHIMVKEYMIQFNRLVAEFLVGSECTRTVTPLRWQPAPRSQQLKALCEKHGDRVPLSLHLGHHLHGGGGSPPDTRLHLLASLWKQVQFAARTQDYEQMVDLVTTDDMHPFLAPAGRDLRKALERSAFGRCARGHQQQGGHYSLQVDWYTWATSPIRRYLDVVLQRQILLALGHGGSAYSARDIDGLCQAFSLQHALAQSYQRRARSLHLAVQLKAQPLDKLGFVVDVEAGSRCFRLLFPSNRETLPDPCPVPYGSLQLAEHPHALAGRPGLRLLWRRRVYSAQGSSPPLPLPGTVPDPHTLAVETALWKQLLELVELQRWPEAAALIQEKGEASQRRELVQVQRSHCGHFLEVARELGSGDTLQVQLGTSLQHGFLVPSPQLWTVAPGFSLCLEHVERPGDCFSGRVYRAPRDRYRDVDEYACVWEPFCALESATGAVAENDSVTLQHLSVSWEASRTPQGQLQGAFRLEAAFLEENCADINFSCCYLCIRLEGLPAPTASPRPGPSSLGPGLNVDPGTYTWVAHGQTQDWDQERRADRQEAPRRVHLFVHHMGMEKVPEEVLRPGTLFTVELLPKQLPDLRKEEAVRGLEEASPLVTSIALGRPVPQPLCRVIPSRFLERQTYNIPGGRHKLNPSQNVAVREALEKPFTVIQGPPGTGKTIVGLHIVFWFHKSNQEQVQPGGPPRGEKRLGGPCILYCGPSNKSVDVLAGLLLRRMELKPLRVYSEQAEASEFPVPRVGSRKLLRKSPREGRPNQSLRSITLHHRIRQAPNPYSSEIKAFDTRLQRGELFSREDLVWYKKVLWEARKFELDRHEVILCTCSCAASASLKILDVRQILVDEAGMATEPETLIPLVQFPQAEKVVLLGDHKQLRPVVKNERLQNLGLDRSLFERYHEDAHMLDTQYRMHEGICAFPSVAFYKSKLKTWQGLRRPPSVLGHAGKESCPVIFGHVQGHERSLLVSTDEGNENSKANLEEVAEVVRITKQLTLGRTVEPQDIAVLTPYNAQASEISKALRREGIAGVAVSSITKSQGSEWRYVLVSTVRTCAKSDLDQRPTKSWLKKFLGFVVDPNQVNVAVTRAQEGLCLIGDHLLLRCCPLWRSLLDFCEAQQTLVPAGQVRVCRRPTMPS

SEQ ID NO: 5287 - protein, 2649 aa, Homo sapiens
MAVWEAEQLGGLQRGDLLTPPAPDGDGRTAPLGQPPGAQLYCPACLVTCHSQEAFENHCASSEHAQMVAFDQALPWEHRSPPPGLSKFELCPKPDLCEYGDACTKAHSAQELQEWVRRTQAVELRGQAAWQDGLVPYQERLLAEYQRSSSEVLVLAETLDGVRVTCNQPLMYQAQERKTQYSWTFAVHSEEPLLHVALLKQEPGADFSLVAPGLPPGRLYARGERFRVPSSTADFQVGVRVQAASFGTFEQWVVFDFGRRPVLLQKLGLQLGQGRRPGPCRNLALGHPEEMERWHTGNRHVVPGVERTAEQTALMAKYKGPALALEFNRSSVASGPISPTNYRQRMHQFLYEEEAAQQQLVAKLTLRGQVFLKTALQTPALNMLFAPPGALYAEVPVPSSLMPDTDQGFLLGRAVSTALVAPVPAPDNTVFEVRLERRASSEQALWLLLPARCCLALGLQPEARLVLEVQFQIDPMTFRLWHQAVDTLPEEQLVVPDLPTCALPRPWSVPPLRRGNRKQELAVALIAGWGPGDGRRVPPLLIYGPFGTGKTYTLAMASLEVIRRPETKVLICTHTNSAADIYIREYFHSHVSGGHPEATPLRVMYTDRPLSQTDPVTLQYCCLTDDRQAFRPPTRAELARHRVVVTTTSQARELRVPVGFFSHILIDEAAQMLECEALTPLAYASHGTRLVLAGDHMQVTPRLFSVARARAAEHTLLHRLFLCYQQETHEVARQSRLVFHENYRCTDAIVSFISRHFYVAKGNPIHARGKVPPHPRHYPLMFCHVAGSPDRDMSMASWLNLAEIAQVVEKVQEAYNTWPSCWGGREQRCICVVSHGAQVSALRQELRRRDLGQVSVGSFEILPGRQFRVVVLSTVHTCQSLLSPGALAPEFFTDARVLNTVLTRAQSQLVVVGDAVALCSFGACGKLWESFIRECVERHSVCPEGLSMEQVEQGVAQRRRWPPRGTQAGAAGNWEAAPEPVGDLAEEQAAVVTAMVKAEPGDEALSPASRDITATTAQTEAAAAPAGDAVKEDVVPGACAAGAAAAAGVESTEAEDAEADFWPWDGELNADDAILRELLDESQKVMVTVGEDGLLDTVARPESLQQARLYENLPPAALRKLLHAEPERYRHCSFVPETFERASAIPLDDASSGPIQVRGRLDCGMAFAGDEVLVQLLSGDKAPEGRLRGRVLGVLKRKRHELAFVCRMDTWDPRIMVPINGSVTKIFVAELKDPSQVPIYSLRKGRLQRVGLERLTAEARHSRLFWVQIVLWRQGFYYPLGIVREVLPEASTWEQGLRILGLEYSLRVPPSDQATITKVLQKYHTELGRVAGRREDCRAFLTFTVDPQGACNLDDALSVRDLGPRCEVAVHITDVASFVPRDGVLDVEARRQGAAFYAPGREPVPMLPASLCQDVLSLLPGRDRLAISLFLTMEKASGQLKSLRFAPSVVQSDRQLSYEEAEEVIRQHPGAGRELPARLDSVDACVVAACYFSRLLRRHRLRSDCFYEQPDEDGTLGFRAAHIMVKEYMIQFNRLVAEFLVGSECTRTVTPLRWQPAPRSQQLKALCEKHGDRVPLSLHLGHHLHGGGGSPPDTRLHLLASLWKQVQFAARTQDYEQMVDLVTTDDMHPFLAPAGRDLRKALERSAFGRCARGHQQQGGHYSLQVDWYTWATSPIRRYLDVVLQRQILLALGHGGSAYSARDIDGLCQAFSLQHALAQSYQRRARSLHLAVQLKAQPLDKLGFVVDVEAGSRCFRLLFPSNRETLPDPCPVPYGSLQLAEHPHALAGRPGLRLLWRRRVYSAQGSSPPLPLPGTVPDPHTLAVETALWKQLLELVELQRWPEAAALIQEKGEASQRRELVQVQRSHCGHFLEVARELGSGDTLQVQLGTSLQHGFLVPSPQLWTVAPGFSLCLEHVERPGDCFSGRVYRAPRDRYRDVDEYACVWEPFCALESATGAVAENDSVTLQHLSVSWEASRTPQGQLQGAFRLEAAFLEENCADINFSCCYLCIRLEGLPAPTASPRPGPSSLGPGLNVDPGTYTWVAHGQTQDWDQERRADRQEAPRRVHLFVHHMGMEKVPEEVLRPGTLFTVELLPKQLPDLRKEEAVRGLEEASPLVTSIALGRPVPQPLCRVIPSRFLERQTYNIPGGRHKLNPSQNVAVREALEKPFTVIQGPPGTGKTIVGLHIVFWFHKSNQEQVQPGGPPRGEKRLGGPCILYCGPSNKSVDVLAGLLLRRMELKPLRVYSEQAEASEFPVPRVGSRKLLRKSPREGRPNQSLRSITLHHRIRQAPNPYSSEIKAFDTRLQRGELFSREDLVWYKKVLWEARKFELDRHEVILCTCSCAASASLKILDVRQILVDEAGMATEPETLIPLVQFPQAEKVVLLGDHKQLRPVVKNERLQNLGLDRSLFERYHEDAHMLDTQYRMHEGICAFPSVAFYKSKLKTWQGLRRPPSVLGHAGKESCPVIFGHVQGHERSLLVSTDEGNENSKANLEEVAEVVRITKQLTLGRTVEPQDIAVLTPYNAQASEISKALRREGIAGVAVSSITKSQGSEWRYVLVSTVRTCAKSDLDQRPTKSWLKKFLGFVVDPNQVNVAVTRAQEGLCLIGDHLLLRCCPLWRSLLDFCEAQQTLVPAGQVRVCRRPTMPS

SEQ ID NO: 5288 - protein, 1664 aa, Homo sapiens
MAARRGRRDGVAPPPSGGPGPDPGGGARGSGWGSRSQAPYGTLGAVSGGEQVLLHEEAGDSGFVSLSRLGPSLRDKDLEMEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSGGVDIPQEKRPLDRLQAPELANVAGLTPPATPPHQLWKPLAAVSLLAKAKSPKSTAQEGTLKPEGVTEAKHPAAVRLQEGVHGPSRVHVGSGDHDYCVRSRTPPKKMPALVIPEVGSRWNVKRHQDITIKPVLSLGPAAPPPPCIAASREPLDHRTSSEQADPSAPCLAPSSLLSPEASPCRNDMNTRTPPEPSAKQRSMRCYRKACRSASPSSQGWQGRRGRNSRSVSSGSNRTSEASSSSSSSSSSSRSRSRSLSPPHKRWRRSSCSSSGRSRRCSSSSSSSSSSSSSSSSSSSSRSRSRSPSPRRRSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLDSNREDFDPAPVKSKFDSLDFDTLLKQAQKNLRR

SEQ ID NO: 5289 - protein, 1400 aa, Homo sapiens
MAARRGRRDGVAPPPSGGPGPDPGGGARGSGWGSRSQAPYGTLGAVSGGEQVLLHEEAGDSGFVSLSRLGPSLRDKDLEMEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSGSSCSSSGRSRRCSSSSSSSSSSSSSSSSSSSSRSRSRSPSPRRRSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLDSNREDFDPAPVKSKFDSLDFDTLLKQAQKNLRR

SEQ ID NO: 5290 - protein, 178 aa, Homo sapiens
MADGKAGDEKPEKSQRAGAAGGPEEEAEKPVKTKTVSSSNGGESSSRSAEKRSAEEEAADLPTKPTKISKFGFAIGSQTTKKASAISIKLGSSKPKETVPTLAPKTLSVAAAFNEDEDSEPEEMPPEAKMRMKNIGRDTPTSAGPNSFNKGKHGFSDNQKLWERNIKSHLGNVHDQDN

SEQ ID NO: 5291 - protein, 1649 aa, Homo sapiens
MDDDSLDELVARSPGPDGHPQVGPADPAGDFEESSVGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILRKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQVFSELPFPSHVLPEPGFPDTDPSQVYSPGLPPAPAQPSSIPPCALVSQPTVQFILQGSLPLVGCGAAQTLAPVPAALTPASEPASQATAASNSEEKTPAPRLAAEKTKKEEYMKKLHMQERAVEEVKLAIKPFYQKREVTKEEYKDILRKAVQKICHSKSGEINPVKVANLVKAYVDKYRHMRRHKKPEAGEEPPTQGAEG

SEQ ID NO: 5292 - protein, 1648 aa, Homo sapiens
MDDDSLDELVARSPGPDGHPQVGPADPAGDFEESSVGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILRKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQVFSELPFPSHVLPEPGFPDTDPSQVYSPGLPPAPAQPSSIPPCALVSQPTVQFILQGSLPLVGCGAAQTLAPVPAALTPASEPASQATAASNSEEKTPAPRLAAEKTKKEEYMKKLHMQERAVEEVKLAIKPFYQKREVTKEEYKDILRKAVQKICHSKSGEINPVKVANLVKAYVDKYRHMRRHKKPEAGEEPPTQGAEG

SEQ ID NO: 5293 - protein, 704 aa, Homo sapiens
MWEKMETKTIVYDLDTSGGLMEQIQALLAPPKTDEAEKRSRKPEKEPRRSGRATNHDSCDSCKEGGDLLCCDHCPAAFHLQCCNPPLSEEMLPPGEWMCHRCTVRRKKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVKKTQHELDHNGLVPLPVKVCFTCNRSCRVAPLIQCDYCPLLFHMDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSGECCSALG

SEQ ID NO: 5294 - protein, 1004 aa, Homo sapiens
MWEKMETKTIVYDLDTSGGLMEQIQALLAPPKTDEAEKRSRKPEKEPRRSGRATNHDSCDSCKEGGDLLCCDHCPAAFHLQCCNPPLSEEMLPPGEWMCHRCTVRRKKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVKKTQHELDHNGLVPLPVKVCFTCNRSCRVAPLIQCDYCPLLFHMDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEVQRKEVQARAVFYPLLGLGGAVNMCYRTLYIGTGADMDVCLTNYGHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 5295 - protein, 849 aa, Homo sapiens
MWEKMETKTIVYDLDTSGGLMEQIQALLAPPKTDEAEKRSRKPEKEPRRSGRATNHDSCDSCKEGGDLLCCDHCPAAFHLLVYQDFVAPISLFHGTFHDGPTCSFAQKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVKKTQHELDHNGLVPLPVKVCFTCNRSCRVAPLIQCDYCPLLFHMDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEGAHVHTCHHIIRSPLYVCEWSPCLHGESELPVSQTSLCAFHGLNKAPWFFSEESRNKMATTAF

SEQ ID NO: 5296 - protein, 300 aa, Homo sapiens
MDSDSCAAAFHPEEYSPSCKRRRTVEDFNKFCTFVLAYAGYIPYPKEELPLRSSPSPANSTAGTIDSDGWDAGFSDIASSVPLPVSDRCFSHLQPTLLQRAKPSNFLLDRKKTDKLKKKKKRKRRDSDAPGKEGYRGGLLKLEAADPYVETPTSPTLQDIPQAPSDPCSGWDSDTPSSGSCATVSPDQVKEIKTEGKRTIVRQGKQVVFRDEDSTGNDEDIMVDSDDDSWDLVTCFCMKPFAGRPMIECNECHTWIHLSCAKIRKSNVPEVFVCQKCRDSKFDIRRSNRSRTGSRKLFLD

SEQ ID NO: 5297 - protein, 790 aa, Homo sapiens
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 5298 - protein, 793 aa, Homo sapiens
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRERSGRRAKGKKSDSKRKGCEGSKGSTEKKEKVKAGPDSVLGQLAGLSTSFPIDGTFFNSWLAQSVQITAENMAMSEWPLNNGHREDPAPGLLSEELLQDEETLLSFMRDPSLRPGDPARKARGRTRLPAKKKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 5299 - protein, 255 aa, Homo sapiens
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCL

SEQ ID NO: 5300 - protein, 791 aa, Homo sapiens
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRAGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 5301 - protein, 850 aa, Homo sapiens
MVPTAAIAVGGYFLGGMEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRERSGRRAKGKKSDSKRKGCEGSKGSTEKKEKVKAGPDSVLGQLAGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 5302 - protein, 149 aa, Homo sapiens
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLEL

SEQ ID NO: 5303 - protein, 823 aa, Homo sapiens
MKRHRPVSSSDSSDESPSTSFTSGSMYRIKSKIPNEHKKPAEVFRKDLISAMKLPDSHHINPDSYYLFADTWKEEWEKGVQVPASPDTVPQPSLRIIAEKVKDVLFIRPRKYIHCSSPDTTEPGYINIMELAASVCRYDLDDMDIFWLQELNEDLAEMGCGPVDENLMEKTVEVLERHCHENMNHAIETEEGLGIEYDEDVICDVCRSPDSEEGNDMVFCDKCNVCVHQACYGILKVPEGSWLCRSCVLGIYPQCVLCPKKGGALKTTKTGTKWAHVSCALWIPEVSIACPERMEPITKISHIPPSRWALVCNLCKLKTGACIQCSIKSCITAFHVTCAFEHGLEMKTILDEGDEVKFKSYCLKHSQNRQKLGEAEYPHHRAKEQSQAKSEKTSLRAQKLRELEEEFYSLVRVEDVAAELGMPTLAVDFIYNYWKLKRKSNFNKPLFPPKEDEENGLVQPKEESIHTRMRMFMHLRQDLERVRNLCYMISRREKLKLSHNKIQEQIFGLQVQLLNQEIDAGLPLTNALENSLFYPPPRITLKLKMPKSTPEDHRNSSTETDQQPHSPDSSSSVHSIRNMQVPQESLEMRTKSYPRYPLESKNNRLLASLSHSRSEAKESSPAWRTPSSECYHGQSLGKPLVLQAALHGQSSIGNGKSQPNSKFAKSNGLEGSWSGNVTQKDSSSEMFCDQEPVFSPHLVSQGSFRKSTVEHFSRSFKETTNRWVKNTEDLQCYVKPTKNMSPKEQFWGRQVLRRSAGRAPYQENDGYCPDLELSDSEAESDGNKEKVRVRKDSSDRENPPHDSRRDCHGKSKTHPLSHSSMQR

SEQ ID NO: 5304 - protein, 823 aa, Homo sapiens; identical to SEQ ID NO: 5303

SEQ ID NO: 5305 - protein, 186 aa, Homo sapiens
MKRHRPVSSSDSSDESPSTSFTSGSMYRIKSKIPNEHKKPAEVFRKDLISAMKLPDSHHINPDSYYLFADTWKEEWEKGVQVPASPDTVPQPSLRIIAEKVKDVLFIRPRKYIHCSSPDTTEPGYINIMELAASVCRYDLDDMDIFWLQELNEDLAEMGCGPVDENLMEKTVEVLERHCHENMNHA

SEQ ID NO: 5306 - protein, 114 aa, Homo sapiens
MKRHRPVSSSDSSDESPSTSFTSGSMYRIKSKIPNEHKKPAEVFRKDLISAMKLPDSHHINPDSYYLFADTWKEEWEKGVQVPASPDTVPQPSLRIIAEKVKDVLFIRPRKYIH

SEQ ID NO: 5307 - protein, 543 aa, Homo sapiens
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKK

SEQ ID NO: 5308 - protein, 549 aa, Homo sapiens
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKK

SEQ ID NO: 5309 - protein, 1012 aa, Homo sapiens
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKKKTKPECPCSEEISDTSQEPSPPKAFAVTRCGSSHKPGVHMSPQLHGPESGHHKGKVKALEEDNLSESSSESFLWSDDEYGQDVDVTTNPDEELDGDDRYDFEVVRCICEVQEENDFMIQCEECQCWQHGVCMGLLEENVPEKYTCYVCQDPPGQRPGFKYWYDKEWLSRGHMHGLAFLEENYSHQNAKKIVATHQLLGDVQRVIEVLHGLQLKMSILQSREHPDLPLWCQPWKQHSGEGRSHFRNIPVTDTRSKEEAPSYRTLNGAVEKPRPLALPLPRSVEESYITSEHCYQKPRAYYPAVEQKLVVETRGSALDDAVNPLHENGDDSLSPRLGWPLDQDRSKGDSDPKPGSPKVKEYVSKKALPEEAPARKLLDRGGEGLLSSQHQWQFNLLTHVESLQDEVTHRMDSIEKELDVLESWLDYTGELEPPEPLARLPQLKHCIKQLLMDLGKVQQIALCCST

SEQ ID NO: 5310 - protein, 272 aa, Homo sapiens
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQKTRQTPFHSSYCCGFKLSNFATNNIGTEKKENIKRM

SEQ ID NO: 5311 - protein, 110 aa, Homo sapiens
MAKHHPDLIFCRKQAGVAIGRLCEKCDGKCVICDSYVRPCTLVRICDECNYGSYQGRCVICGGPGVSDAYYCKECTIQEKDRDGCPKIVNLGSSKTDLFYERKKYGFKKR

SEQ ID NO: 5312 - protein, 381 aa, Homo sapiens
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDRDAAWELEPGAFSDLYQRYQHCDAPICLYEQGRDSFEDEGRWCLILCATCGSHGTHRDCSSLRSNSKKWECEECSPAAATDYIPENSGDIPCCSSTFHPEEHFCRDNTLEENPGLSWTDWPEPSLLEKPESSRGRRSYSWRSKGVRITNSCKKSK

SEQ ID NO: 5313 - protein, 342 aa, Homo sapiens
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDRRWCLILCATCGSHGTHRDCSSLRSNSKKWECEECSPAAATDYIPENSGDIPCCSSTFHPEEHFCRDNTLEENPGLSWTDWPEPSLLEKPESSRGRRSYSWRSKGVRITNSCKKSK

SEQ ID NO: 5314 - protein, 290 aa, Homo sapiens
FNRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDSRDAAWELEPGAFSDLYQRYQHCDAPICLYEQGRDSFEDEGRWCLILCATCGSHGTHRDCSSLRSNSKKWECEECSPAAATDYIPENSGDIPCCSSTFHPEEHFCRDNTLEENPGLSWTDWPEPSLLEKPESSRGRRSYSWRSKGVRITNSCKKSK

SEQ ID NO: 5315 - protein, 213 aa, Homo sapiens [sequence omitted]

SEQ ID NO: 5316 - protein, 23 aa, Homo sapiens
MKTVKEKKECQRLRKSAKTRRVT

SEQ ID NO: 5317 - protein, 381 aa, Homo sapiens; identical to SEQ ID NO: 5312

SEQ ID NO: 5318 - protein, 518 aa, Homo sapiens
MDQTPPARPEYLVSGIRTPPVRRNSKLATLGRIFKPWKWRKKKNEKLKQTTSALEKKMAGRQGREELIKKGLLEMMEQDAESKTCNPDGGPRSVQSEPPTPKSETLTSEDAQPGSPLATGTDQVSLDKPLSSAAHLDDAAKMPSASSGEEADAGSLLPTTNELSQALAGADSLDSPPRPLERSVGQLPSPPLLPTPPPKASSKTTKNVTGQATLFQASSMKSADPSLRGQLSTPTGSPHLTTVHRPLPPSRVIEELHRALATKHRQDSFQGRESKGSPKKRLDVRLSRTSSVERGKEREEAWSFDGALENKRTAAKESEENKENLIINSELKDDLLLYQDEEALNDSIISGTLPRKCKKELLAVKLRNRPSKQELEDRNIFPRRTDEERQEIRQQIEMKLSKRLSQRPAVEELERRNILKQRNDQTEQEERREIKQRLTRKLNQRPTVDELRDRKILIRFSDYVEVAKAQDYDRRADKPWTRLSAADKAAIRKELNEYKSNEMEVHASSKHLTRFHRP

SEQ ID NO: 5319 - protein, 448 aa, Homo sapiens
MDQTPPARPEYLVSGIRTPPVRRNSKLATLGRIFKPWKWRKKKNEKLKQTTSALEKKMAGRQGREELIKKGLLEMMEQDAESKTCNPDGGPRSVQSEPPTPKSETLTSEDAQPGSPLATGTDQVSLDKPLSSAAHLDDAGQATLFQASSMKSADPSLRGQLSTPTGSPHLTTVHRPLPPSRVIEELHRALATKHRQDSFQGRESKGSPKKRLDVRLSRTSSVERGKEREEAWSFDGALENKRTAAKESEENKENLIINSELKDDLLLYQDEEALNDSIISGTLPRKCKKELLAVKLRNRPSKQELEDRNIFPRRTDEERQEIRQQIEMKLSKRLSQRPAVEELERRNILKQRNDQTEQEERREIKQRLTRKLNQRPTVDELRDRKILIRFSDYVEVAKAQDYDRRADKPWTRLSAADKAAIRKELNEYKSNEMEVHASSKHLTRFHRP

SEQ ID NO: 5320 - protein, 559 aa, Homo sapiens
MAASEDGSGCLVSRGRSQSDPSVLTDSSATSSADAGENPDEMDQTPPARPEYLVSGIRTPPVRRNSKLATLGRIFKPWKWRKKKNEKLKQTTSALEKKMAGRQGREELIKKGLLEMMEQDAESKTCNPDGGPRSVQSEPPTPKSETLTSEDAQPGSPLATGTDQVSLDKPLSSAAHLDDAAKMPSASSGEEADAGSLLPTTNELSQALAGADSLDSPPRPLERSVGQLPSPPLLPTPPPKASSKTTKNVTGQATLFQASSMKSADPSLRGQLSTPTGSPHLTTVHRPLPPSRVIEELHRALATKHRQDSFQGRESKGSPKKRLDVRLSRTSSVERGKEREEAWSFDGALENKRTAAKESEENKENLIINSELKDDLLLYQDEEALNDSIISGTLPRKCKKELLAVKLRNRPSKQELEDRNIFPRRTDEERQEIRQQIEMKLSKRLSQRPAVEELERRNILKQRNDQTEQEERREIKQRLTRKLNQRPTVDELRDRKILIRFSDYVEVAKAQDYDRRADKPWTRLSAADKAAIRKELNEYKSNEMEVHASSKHLTRFHRP

SEQ ID NO: 5321 - protein, 518 aa, Homo sapiens; identical to SEQ ID NO: 5318

SEQ ID NO: 5322 - protein, 448 aa, Homo sapiens; identical to SEQ ID NO: 5319

SEQ ID NO: 5323 - protein, 41 aa, Homo sapiens
MAASEDGSGCLVSRGRSQSDPSVLTDSSATSSADAGENPDE

SEQ ID NO: 5324 - protein, 518 aa, Homo sapiens; identical to SEQ ID NO: 5318

SEQ ID NO: 5325 - protein, 809 aa, Homo sapiens
MYEALPGPAPENEDGLVKVKEEDPTWEQVCNSQEGSSHTQEICRLRFRHFCYQEAHGPQEALAQLRELCHQWLRPEMHTKEQIMELLVLEQFLTILPKELQPCVKTYPLESGEEAVTVLENLETGSGDTGQQASVYIQGQDMHPMVAEYQGVSLECQSLQLLPGITTLKCEPPQRPQGNPQEVSGPVPHGSAHLQEKNPRDKAVVPVFNPVRSQTLVKTEEETAQAVAAEKWSHLSLTRRNLCGNSAQETVMSLSPMTEEIVTKDRLFKAKQETSEEMEQSGEASGKPNRECAPQIPCSTPIATERTVAHLNTLKDRHPGDLWARMHISSLEYAAGDITRKGRKKDKARVSELLQGLSFSGDSDVEKDNEPEIQPAQKKLKVSCFPEKSWTKRDIKPNFPSWSALDSGLLNLKSEKLNPVELFELFFDDETFNLIVNETNNYASQKNVSLEVTVQEMRCVFGVLLLSGFMRHPRREMYWEVSDTDQNLVRDAIRRDRFELIFSNLHFADNGHLDQKDKFTKLRPLIKQMNKNFLLYAPLEEYYCFDKSMCECFDSDQFLNGKPIRIGYKIWCGTTTQGYLVWFEPYQEESTMKVDEDPDLGLGGNLVMNFADVLLERGQYPYHLCFDSFFTSVKLLSALKKKGVRATGTIRENRTEKCPLMNVEHMKKMKRGYFDFRIEENNEIILCRWYGDGIISLCSNAVGIEPVNEVSCCDADNEEIPQISQPSIVKVYDECKEGVAKMDQIISKYRVRIRSKKWYSILVSYMIDVAMNNAWQLHRACNPGASLDPLDFRRFVAHFYLEHNAHLSD

SEQ ID NO: 5326 - protein, 809 aa, Homo sapiens; identical to SEQ ID NO: 5325

SEQ ID NO: 5327 - protein, 805 aa, Homo sapiens
MWDQGGQPWQQWPLNQQQWMQSFQHQQDPSQIDWAALAQAWIAQREASGQQSMVEQPPGMMPNGQDMSTMESGPNNHGNFQGDSNFNRMWQPEWGMHQQPPHPPPDQPWMPPTPGPMDIVPPSEDSNSQDSGEFAPDNRHIFNQNNHNFGGPPDNFAVGPVNQFDYQHGAAFGPPQGGFHPPYWQPGPPGPPAPPQNRRERPSSFRDRQRSPIALPVKQEPPQIDAVKRRTLPAWIREGLEKMEREKQKKLEKERMEQQRSQLSKKEKKATEDAEGGDGPRLPQRSKFDSDEEEEDTENVEAASSGKVTRSPSPVPQEEHSDPEMTEEEKEYQMMLLTKMLLTEILLDVTDEEIYYVAKDAHRKATKAPAKQLAQSSALASLTGLGGLGGYGSGDSEDERSDRGSESSDTDDEELRHRIRQKQEAFWRKEKEQQLLHDKQMEEEKQQTERVTKEMNEFIHKEQNSLSLLEAREADGDVVNEKKRTPNETTSVLEPKKEHKEKEKQGRSRSGSSSSGSSSSNSRTSSTSSTVSSSSYSSSSGSSRTSSRSSSPKRKKRHSRSRSPTIKARRSRSRSYSRRIKIESNRARVKIRDRRRSNRNSIERERRRNRSPSRERRRSRSRSRDRRTNRASRSRSRDRRKIDDQRGNLSGNSHKHKGEAKEQERKKERSRSIDKDRKKKDKEREREQDKRKEKQKREEKDFKFSSQDDRLKRKRESERTFSRSGSISVKIIRHDSRQDSKKSTTKDSKKHSGSDSSGRSSSESPGSSKEKKAKKPKHSRSRSVEKSQRSGKKASRKHKSKSRSR

SEQ ID NO: 5328 - protein, 805 aa, Homo sapiens; identical to SEQ ID NO: 5327

SEQ ID NO: 5329 - protein, 609 aa, Homo sapiens
MESTAYPLNLSLKEEEEEEEIQSRELEDGPADMQKVRICSEGGWVPALFDEVAIYFSDEEWEVLTEQQKALYREVMRMNYETVLSLEFPFPKPDMITRLEGEEESQNSDEWQLQGGTSAENEESDVKPPDWPNPMNATSQFPQPQHFDSFGLRLPRDITELPEWSEGYPFYMAMGFPGYDLSADDIAGKFQFSRGMRRSYDAGFKLMVVEYAESTNNCQAAKQFGVLEKNVRDWRKVKPQLQNAHAMRRAFRGPKNGRFALVDQRVAEYVRYMQAKGDPITREAMQLKALEIAQEMNIPEKGFKASLGWCRRMMRRYDLSLRHKVPVPQHLPEDLTEKLVTYQRSVLALRRAHDYEVAQMGNADETPICLEVPSRVTVDNQGEKPVLVKTPGREKLKITAMLGVLADGRKLPPYIILRGTYIPPGKFPSGMEIRCHRYGWMTEDLMQDWLEVVWRRRTGAVPKQRGMLILNGFRGHATDSVKNSMESMNTDMVIIPGGLTSQLQVLDVVVYKPLNDSVRAQYSNWLLAGNLALSPTGNAKKPPLGLFLEWVMVAWNSISSESIVQGFKKCHISSNLEEEDDVLWEIESELPGGGEPPKDCDTESMAESN

SEQ ID NO: 5330 - protein, 609 aa, Homo sapiens; identical to SEQ ID NO: 5329

SEQ ID NO: 5331 - protein, 209 aa, Homo sapiens
MESTAYPLNLSLKEEEEEEEIQSRELEDGPADMQKVRICSEGGWVPALFDEVAIYFSDEEWEVLTEQQKALYREVMRMNYETVLSLEFPFPKPDMITRLEGEEESQNSDEWQLQGGTSAENEESDVKPPDWPNPMNATSQFPQPQHFDSFGLRLPRDITELPEWSEGYPFYMAMGFPGYDLSADDIAGKFQFSRGMRRSYDAGFKLMVV

SEQ ID NO: 5332 - protein, 524 aa, Homo sapiens
MEFPFPKPDMITRLEGEEESQNSDEWQLQGGTSAENEESDVKPPDWPNPMNATSQFPQPQHFDSFGLRLPRDITELPEWSEGYPFYMAMGFPGYDLSADDIAGKFQFSRGMRRSYDAGFKLMVVEYAESTNNCQAAKQFGVLEKNVRDWRKVKPQLQNAHAMRRAFRGPKNGRFALVDQRVAEYVRYMQAKGDPITREAMQLKALEIAQEMNIPEKGFKASLGWCRRMMRRYDLSLRHKVPVPQHLPEDLTEKLVTYQRSVLALRRAHDYEVAQMGNADETPICLEVPSRVTVDNQGEKPVLVKTPGREKLKITAMLGVLADGRKLPPYIILRGTYIPPGKFPSGMEIRCHRYGWMTEDLMQDWLEVVWRRRTGAVPKQRGMLILNGFRGHATDSVKNSMESMNTDMVIIPGGLTSQLQVLDVVVYKPLNDSVRAQYSNWLLAGNLALSPTGNAKKPPLGLFLEWVMVAWNSISSESIVQGFKKCHISSNLEEEDDVLWEIESELPGGGEPPKDCDTESMAESN

SEQ ID NO: 5333 - protein, 736 aa, Homo sapiens
MKEMSANTVLDSQRQQKHYGITSPISLASPKEIDHIYTQKLIDAMKPFGVFEDEEELNHRLVVLGKLNNLVKEWISDVSESKNLPPSVVATVGGKIFTFGSYRLGVHTKGADIDALCVAPRHVERSDFFQSFFEKLKHQDGIRNLRAVEDAFVPVIKFEFDGIEIDLVFARLAIQTISDNLDLRDDSRLRSLDIRCIRSLNGCRVTDEILHLVPNKETFRLTLRAVKLWAKRRGIYSNMLGFLGGVSWAMLVARTCQLYPNAAASTLVHKFFLVFSKWEWPNPVLLKQPEESNLNLPVWDPRVNPSDRYHLMPIITPAYPQQNSTYNVSTSTRTVMVEEFKQGLAVTDEILQGKSDWSKLLEPPNFFQKYRHYIVLTASASTEENHLEWVGLVESKIRVLVGNLERNEFITLAHVNPQSFPGNKEHHKDNNYVSMWFLGIIFRRVENAESVNIDLTYDIQSFTDTVYRQANNINMLKEGMKIEATHVKKKQLHHYLPAEILQKKKKQSLSDVNRSSGGLQSKRLSLDSSCLDSSRDTDNGTPFNSPASKSDSPSVGETERNSAEPAAVIVEKPLSVPPAQGLSIPVIGAKVDSTVKTVSPPTVCTIPTVVGRNVIPRITTPHNPAQGQPHLNGMSNITKTVTPKRSHSPSIDGTPKRLKDVEKFIRLESTFKDPRTAEERKRKSVDAIGGESMPIPTIDTSRKKRLPSKELPDSSSPVPANNIRVIKNSIRLTLNR

SEQ ID NO: 5334 - protein, 403 aa, Homo sapiens
MPIITPAYPQQNSTYNVSTSTRTVMVEEFKQGLAVTDEILQGKSDWSKLLEPPNFFQKYRHYIVLTASASTEENHLEWVGLVESKIRVLVGNLERNEFITLAHVNPQSFPGNKEHHKDNNYVSMWFLGIIFRRVENAESVNIDLTYDIQSFTDTVYRQANNINMLKEGMKIEATHVKKKQLHHYLPAEILQKKKKQSLSDVNRSSGGLQSKRLSLDSSCLDSSRDTDNGTPFNSPASKSDSPSVGETERNSAEPAAVIVEKPLSVPPAQGLSIPVIGAKVDSTVKTVSPPTVCTIPTVVGRNVIPRITTPHNPAQGQPHLNGMSNITKTVTPKRSHSPSIDGTPKRLKDVEKDAIGGESMPIPTIDTSRKKRLPSKELPDSSSPVPANNIRVIKNSIRLTLNR

SEQ ID NO: 5335 - protein, 382 aa, Homo sapiens
RTVMVEEFKQGLAVTDEILQGKSDWSKLLEPPNFFQKYRHYIVLTASASTEENHLEWVGLVESKIRVLVGNLERNEFITLAHVNPQSFPGNKEHHKDNNYVSMWFLGIIFRRVENAESVNIDLTYDIQSFTDTVYRQANNINMLKEGMKIEATHVKKKQLHHYLPAEILQKKKKQSLSDVNRSSGGLQSKRLSLDSSCLDSSRDTDNGTPFNSPASKSDSPSVGETERNSAEPAAVIVEKPLSVPPAQGLSIPVIGAKVDSTVKTVSPPTVCTIPTVVGRNVIPRITTPHNPAQGQPHLNGMSNITKTVTPKRSHSPSIDGTPKRLKDVEKDAIGGESMPIPTIDTSRKKRLPSKELPDSSSPVPANNIRVIKNSIRLTLNR

SEQ ID NO: 5336 - protein, 259 aa, Homo sapiens
MASPQGGQIAIAMRLRNQLQSVYKMDPLRNEEEVRVKIKDLNEHIVCCLCAGYFVDATTITECLHTFCKSCIVKYLQTSKYCPMCNIKIHETQPLLNLKLDRVMQDIVYKLVPGLQDSEEKRIREFYQSRGLDRVTQPTGEEPALSNLGLPFSSFDHSKAHYYRYDEQLNLCLERLSSGKDKNKSVLQNKYVRCSVRAEVRHLRRVLCHRLMLNPQHVQLLFDNEVLPDHMTMKQIWLSRWFGKPSPLLLQYSVKEKRR

SEQ ID NO: 5337 - protein, 344 aa, Homo sapiens
MHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKVEVLYEDEPLKEYYTLMDIAYIYPWRRNGPLPLKYRVQPACKRLTLATVPTPSEGTNTSGASECESVSDKAPSPATLPATSSSLPSPATPSHGSPSSHGPPATHPTSPTPPSTASGATTAANGGSLNCLQTPSSTSRGRKMTVNGAPVPPLT

SEQ ID NO: 5338 - protein, 242 aa, Homo sapiens
MLTRKIKLWDINAHITCRLCSGYLIDATTVTECLHTFCRSCLVKYLEENNTCPTCRIVIHQSHPLQYIGHDRTMQDIVYKLVPGLQEAEMRKQREFYHKLGMEVPGDIKGETCSAKQHLDSHRNGETKADDSSNKEAAEEKPEEDNDYHRSDEQVSICLECNSSKLRGLKRKWIRCSAQATVLHLKKFIAKKLNLSSFNELDILCNEEILGKDHTLKFVVVTRWRFKKAPLLLHYRPKMDLL

SEQ ID NO: 5339 - protein, 40 aa, Homo sapiens
MLTRKIKLWDINAHITCRLCSGYLIDATTVTECLHTFCRS

SEQ ID NO: 5340 - protein, 62 aa, Homo sapiens
MLTRKIKLWDINAHITCRLCSGYLIDATTVTECLHTFCRSCLVKYLEENNTCPTCRIVIHQS

SEQ ID NO: 5341 - protein, 109 aa, Homo sapiens
MLTRKIKLWDINAHITCRLCSGYLIDATTVTECLHTFCRSCLVKYLEENNTCPTCRIVIHQSHPLQYIGHDRTMQDIVYKLVPGLQEAEMRKQREFYHKLGMEVPGDIK

SEQ ID NO: 5342 - protein, 242 aa, Homo sapiens; identical to SEQ ID NO: 5338

SEQ ID NO: 5343 - protein, 242 aa, Homo sapiens; identical to SEQ ID NO: 5338

SEQ ID NO: 5344 - protein, 208 aa, Homo sapiens
MTVCRSCLVKYLEENNTCPTCRIVIHQSHPLQYIGHDRTMQDIVYKLVPGLQEAEMRKQREFYHKLGMEVPGDIKGETCSAKQHLDSHRNGETKADDSSNKEAAEEKPEEDNDYHRSDEQVSICLECNSSKLRGLKRKWIRCSAQATVLHLKKFIAKKLNLSSFNELDILCNEEILGKDHTLKFVVVTRWRFKKAPLLLHYRPKMDLL

SEQ ID NO: 5345 - protein, 1004 aa, Homo sapiens
METESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASINLATTSAAQLISRSQSVSSPSATTLTQSVLLGNTTSPPLNQSQAQMYLRPQLGNLLQVNRTLGRNVPLASQLILMPNGAVAAVQQEVPSAQSPGVHADADQVQNLAVRNQQASAQGPQMQGSTQKAIPPGASPVSSLSQASSQALAVAQASSGATNQSLNLSQAGGGSGNSIPGSMGPGGGGQAHGGLGQLPSSGMGGGSCPRKGTGVVQPLPAAQTVTVSQGSQTEAESAAAKKAEADGSGQQNVGMNLTRTATPAPSQTLISSATYTQIQPHSLIQQQQQIHLQQKQVVIQQQIAIHHQQQFQHRQSQLLHTATHLQLAQQQQQQQQQQQQQQQPQATTLTAPQPPQVPPTQQVPPSQSQQQAQTLVVQPMLQSSPLSLPPDAAPKPPIPIQSKPPVAPIKPPQLGAAKMSAAQQPPPHIPVQVVGTRQPGTAQAQALGLAQLAAAVPTSRGMPGTVQSGQAHLASSPPSSQAPGALQECPPTLAPGMTLAPVQGTAHVVKGGATTSSPVVAQVPAAFYMQSVHLPGKPQTLAVKRKADSEEERDDVSTLGSMLPAKASPVAESPKVMDEKSSLGEKAESVANVNANTPSSELVALTPAPSVPPPTLAMVSRQMGDSKPPQAIVKPQILTHIIEGFVIQEGAEPFPVGCSQLLKESEKPLQTGLPTGLTENQSGGPLGVDSPSAELDKKANLLKCEYCGKYAPAEQFRGSKRFCSMTCAKRYNVSCSHQFRLKRKKMKEFQEANYARVRRRGPRRSSSDIARAKIQGKCHRGQEDSSRGSDNSSYDEALSPTSPGPLSVRAGHGERDLGNPNTAPPTPELHGINPVFLSSNPSRWSVEEVYEFIASLQGCQEIAEEFRSQEIDGQALLLLKEEHLMSAMNIKLGPALKICAKINVLKET

SEQ ID NO: 5346 - protein, 610 aa, Homo sapiens
MQGSTQKAIPPGASPVSSLSQASSQALAVAQASSGATNQSLNLSQAGGGSGNSIPGSMGPGGGGQAHGGLGQLPSSGMGGGSCPRKGTGVVQPLPAAQTVTVSQGSQTEAESAAAKKAEADGSGQQNVGMNLTRTATPAPSQTLISSATYTQIQPHSLIQQQQQIHLQQKQVVIQQQIAIHHQQQFQHRQSQLLHTATHLQLAQQQQQQQQQQQQQQQPQATTLTAPQPPQVPPTQQGKPQTLAVKRKADSEEERDDVSTLGSMLPAKASPVAESPKVMDEKSSLGEKAESVANVNANTPSSELVALTPAPSVPPPTLAMVSRQMGDSKPPQAIVKPQILTHIIEGFVIQEGAEPFPVGCSQLLKESEKPLQTGLPTGLTENQSGGPLGVDSPSAELDKKANLLKCEYCGKYAPAEQFRGSKRFCSMTCAKRYNVSCSHQFRLKRKKMKEFQEANYARVRRRGPRRSSSDIARAKIQGKCHRGQEDSSRGSDNSSYDEALSPTSPGPLSVRAGHGERDLGNPNTAPPTPELHGINPVFLSSNPSRWSVEEVYEFIASLQGCQEIAEEFRSQEIDGQALLLLKEEHLMSAMNIKLGPALKICAKINVLKET

SEQ ID NO: 5347 - protein, 172 aa, Homo sapiens
METESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASINLATTSAAQLISRSQSVSSPSATTLTQSVLLGNTTSPPLNQSQAQMYLRPQLGNLLQVNRTLGRNVPLA

SEQ ID NO: 5348 - protein, 1004 aa, Homo sapiens; identical to SEQ ID NO: 5345

SEQ ID NO: 5349 - protein, 1004 aa, Homo sapiens; identical to SEQ ID NO: 5345

SEQ ID NO: 5350 - protein, 858 aa, Homo sapiens
MENELPVPHTSSSACATSSTSGASSSSGCNNSSSGGSGRPTGPQISVYSGIPDRQTVQVIQQALHRQPSTAAQYLQQMYAAQQQHLMLQTAALQQQHLSSAQLQSLAAVQQASLVSNRQGSTSGSNVSAQAPAQSSSINLAASPAAAQLLNRAQSVNSAAASGIAQQAVLLGNTSSPALTASQAQMYLRAQMLIFTPTATVATVQPELGTGSPARPPTPAQVQNLTLRTQQTPAAAASGPTPTQPVLPSLALKPTPGGSQPLPTPAQSRNTAQASPAGAKPGIADSVMEPHKKGDGNSSVPGSMEGRAGLSRTVPAVAAHPLIAPAYAQLQPHQLLPQPSSKHLQPQFVIQQQPQPQQQQPPPQQSRPVLQAEPHPQLASVSPSVALQPSSEAHAMPLGPVTPALPLQCPTANLHKPGGSQQCHPPTPDTGPQNGHPEGVPHTPQRRFQHTSAVILQLQPASPPQQCVPDDWKEVAPGEKSVPETRSGPSPHQQAIVTAMPGGLPVPTSPNIQPSPAHETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 5351 - protein, 434 aa, Homo sapiens [sequence omitted]

SEQ ID NO: 5352 - protein, 317 aa, Homo sapiens
MTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGLPSSFPKGHETSIYSLSKHLRHSRFPQSPSGSCLWPVLRPRPHL

SEQ ID NO: 5353 - protein, 323 aa, Homo sapiens
MTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 5354 - protein, 464 aa, Homo sapiens
MPLGPVTPALPLQCPTANLHKPGGSQQCHPPTPDTGPQNGHPEGVPHTPQRRFQHTSAVILQLQPASPVPQQCVPDDWKEVAPGEKSVPETRSGPSPHQQAIVTAMPGGLPVPTSPNIQPSPAHETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 5355 - protein, 859 aa, Homo sapiens
MENELPVPHTSSSACATSSTSGASSSSGCNNSSSGGSGRPTGPQISVYSGIPDRQTVQVIQQALHRQPSTAAQYLQQMYAAQQQHLMLQTAALQQQHLSSAQLQSLAAVQQASLVSNRQGSTSGSNVSAQAPAQSSSINLAASPAAAQLLNRAQSVNSAAASGIAQQAVLLGNTSSPALTASQAQMYLRAQMLIFTPTATVATVQPELGTGSPARPPTPAQVQNLTLRTQQTPAAAASGPTPTQPVLPSLALKPTPGGSQPLPTPAQSRNTAQASPAGAKPGIADSVMEPHKKGDGNSSVPGSMEGRAGLSRTVPAVAAHPLIAPAYAQLQPHQLLPQPSSKHLQPQFVIQQQPQPQQQQPPPQQSRPVLQAEPHPQLASVSPSVALQPSSEAHAMPLGPVTPALPLQCPTANLHKPGGSQQCHPPTPDTGPQNGHPEGVPHTPQRRFQHTSAVILQLQPASPVPQQCVPDDWKEVAPGEKSVPETRSGPSPHQQAIVTAMPGGLPVPTSPNIQPSPAHETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 5356 - protein, 829 aa, Homo sapiens
MENELPVPHTSSSACATSSTSGASSSSGCNNSSSGGSGRPTGPQISVYSGIPDRQTVQVIQQALHRQPSTAAQYLQQMYAAQQQHLMLQTAALQQQHLSSAQLQSLAAVQQASLVSNRQGSTSGSNVSAQAPAQSSSINLAASPAAAQLLNRAQSVNSAAASGIAQQAVLLGNTSSPALTASQAQMYLRAQMVQNLTLRTQQTPAAAASGPTPTQPVLPSLALKPTPGGSQPLPTPAQSRNTAQASPAGAKPGIADSVMEPHKKGDGNSSVPGSMEGRAGLSRTVPAVAAHPLIAPAYAQLQPHQLLPQPSSKHLQPQFVIQQQPQPQQQQPPPQQSRPVLQAEPHPQLASVSPSVALQPSSEAHAMPLGPVTPALPLQCPTANLHKPGGSQQCHPPTPDTGPQNGHPEGVPHTPQRRFQHTSAVILQLQPASPPQQCVPDDWKEVAPGEKSVPETRSGPSPHQQAIVTAMPGGLPVPTSPNIQPSPAHETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 5357 - protein, 186 aa, Homo sapiens
MDTEPNPGTSSVSTTTSSTTTTTITTSSSRMQQPQISVYSGSDRHAVQALHRPPSSAAQYLQQMYAAQQQHLMLHTAALQQQHLSSSQLQSLAAVQASLSSGRPSTSPTGSVTQQSSMSQTSINLSTSPTPAQLISRSQASSSTSGSITQQTMLLGSTSPTLTASQAQMYLRAQMVRYELPNFFSV

SEQ ID NO: 5358 - protein, 247 aa, Homo sapiens
MAEAEFKDHSTAMDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSSMSQTSINLSTSPTPAQLISRSQASSSTSGSITQQTMLLGSTSPTLTASQAQMYLRAQMLIFTPATTVAAVQSDIPVVSSSSSSSCQSAATQVQNLTLRSQKLGVLSSSQNGPPK

SEQ ID NO: 5359 - protein, 147 aa, Homo sapiens
MAEAEFKDHSTAMDTEPNPGTSSVSTTTSSTTTTTITTSSSRMQQPQISVYSGSDRHAVQALHRPPSSAAQYLQQMYAAQQQHLMLHTAALQQQHLSSSQLQSLAAVQASLSSGRPSTSPTGSVTQQSSMSQTSVSSLNFFFLDLKF

SEQ ID NO: 5360 - protein, 161 aa, Homo sapiens
  MOD_RES (1)..(1): Any amino acid
XRWNRKPDNQSLGHRGRRPSGPDGAAREHILRQLPITYPSAEEDLASHEDSVPSAMTTRLRRQSERERERELRDVRIRKMPENSDLLPVAQTEPSIWTVDDVWAFIHSLPGCQDIADEFRAQEIDGQALLLLKEDHLMSAMNIKLGPALKICARINSLKES

SEQ ID NO: 5361 - protein, 983 aa, Homo sapiens
MDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSSMSQTSINLSTSPTPAQLISRSQASSSTSGSITQQTMLLGSTSPTLTASQAQMYLRAQMLIFTPATTVAAVQSDIPVVSSSSSSSCQSAATQVQNLTLRSQKLGVLSSSQNGPPKSTSQTQSLTICHNKTTVTSSKISQRDPSPESNKKGESPSLESRSTAVTRTSSIHQLIAPASYSPIQPHSLIKHQQIPLHSPPSKVSHHQLILQQQQQQIQPITLQNSTQDPPPSQHCIPLQNHGLPPAPSNAQSQHCSPIQSHPSPLTVSPNQSQSAQQSVVVSPPPPHSPSQSPTIIIHPQALIQPHPLVSSALQPGPNLQQSTANQVQATAQLNLPSHLPLPASPVVHIGPVQQSALVSPGQQIVSPSHQQYSSLQSSPIPIASPPQMSTSPPAQIPPLPLQSMQSLQVQPEILSQGQVLVQNALVSEEELPAAEALVQLPFQTLPPPQTVAVNLQVQPPAPVDPPVVYQVEDVCEEEMPEESDECVRMDRTPPPPTLSPAAITVGRGEDLTSEHPLLEQVELPAVASVSASVIKSPSDPSHVSVPPPPLLLPAATTRSNSTSMHSSIPSIENKPPQAIVKPQILTHVIEGFVIQEGLEPFPVSRSSLLIEQPVKKRPLLDNQVINSVCVQPELQNNTKHADNSSDTEMEDMIAEETLEEMDSELLKCEFCGKMGYANEFLRSKRFCTMSCAKRYNVSCSKKFALSRWNRKPDNQSLGHRGRRPSGPDGAAREHILRQLPITYPSAEEDLASHEDSVPSAMTTRLRRQSERERERELRDVRIRKMPENSDLLPVAQTEPSIWTVDDVWAFIHSLPGCQDIADEFRAQEIDGQALLLLKEDHLMSAMNIKLGPALKICARINSLKES

SEQ ID NO: 5362 - protein, 995 aa, Homo sapiens
MAEAEFKDHSTAMDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSSMSQTSINLSTSPTPAQLISRSQASSSTSGSITQQTMLLGSTSPTLTASQAQMYLRAQMLIFTPATTVAAVQSDIPVVSSSSSSSCQSAATQVQNLTLRSQKLGVLSSSQNGPPKSTSQTQSLTICHNKTTVTSSKISQRDPSPESNKKGESPSLESRSTAVTRTSSIHQLIAPASYSPIQPHSLIKHQQIPLHSPPSKVSHHQLILQQQQQQIQPITLQNSTQDPPPSQHCIPLQNHGLPPAPSNAQSQHCSPIQSHPSPLTVSPNQSQSAQQSVVVSPPPPHSPSQSPTIIIHPQALIQPHPLVSSALQPGPNLQQSTANQVQATAQLNLPSHLPLPASPVVHIGPVQQSALVSPGQQIVSPSHQQYSSLQSSPIPIASPPQMSTSPPAQIPPLPLQSMQSLQVQPEILSQGQVLVQNALVSEEELPAAEALVQLPFQTLPPPQTVAVNLQVQPPAPVDPPVVYQVEDVCEEEMPEESDECVRMDRTPPPPTLSPAAITVGRGEDLTSEHPLLEQVELPAVASVSASVIKSPSDPSHVSVPPPPLLLPAATTRSNSTSMHSSIPSIENKPPQAIVKPQILTHVIEGFVIQEGLEPFPVSRSSLLIEQPVKKRPLLDNQVINSVCVQPELQNNTKHADNSSDTEMEDMIAEETLEEMDSELLKCEFCGKMGYANEFLRSKRFCTMSCAKRYNVSCSKKFALSRWNRKPDNQSLGHRGRRPSGPDGAAREHILRQLPITYPSAEEDLASHEDSVPSAMTTRLRRQSERERERELRDVRIRKMPENSDLLPVAQTEPSIWTVDDVWAFIHSLPGCQDIADEFRAQEIDGQALLLLKEDHLMSAMNIKLGPALKICARINSLKES

SEQ ID NO: 5363 - protein, 151 aa, Homo sapiens
MAEAEFKDHSTAMDTEPNPGTSSVSTTTSSTTTTTITTSSSRMQQPQISVYSGSDRHAVQVIQQALHRPPSSAAQYLQQMYAAQQQHLMLHTAALQQQHLSSSQLQSLAAVQASLSSGRPSTSPTGSVTQQSSMSQTSVSSLNFFFLDLKF

SEQ ID NO: 5364 - protein, 598 aa, Homo sapiens
MSASAQQLAEELQIFGLDCEEALIEKLVELCVQYGQNEEGMVGELIAFCTSTHKVGLTSEILNSFEHEFLSKRLSKARHSTCKDSGHAGARDIVSIQELIEVEEEEEILLNSYTTPSKGSQKRAISTPETPLTKRSVSTRSPHQLLSPSSFSPSATPSQKYNSRSNRGEVVTSFGLAQGVSWSGRGGAGNISLKVLGCPEALTGSYKSMFQKLPDIREVLTCKIEELGSELKEHYKIEAFTPLLAPAQEPVTLLGQIGCDSNGKLNNKSVILEGDREHSSGAQIPVDLSELKEYSLFPGQVVIMEGINTTGRKLVATKLYEGVPLPFYQPTEEDADFEQSMVLVACGPYTTSDSITYDPLLDLIAVINHDRPDVCILFGPFLDAKHEQVENCLLTSPFEDIFKQCLRTIIEGTRSSGSHLVFVPSLRDVHHEPVYPQPPFSYSDLSREDKKQVQFVSEPCSLSINGVIFGLTSTDLLFHLGAEEISSSSGTSDRFSRILKHILTQRSYYPLYPPQEDMAIDYESFYVYAQLPVTPDVLIIPSELRYFVKDVLGCVCVNPGRLTKGQVGGTFARLYLRRPAADGAERQSPCIAVQVVRI

SEQ ID NO: 5365 - protein, 361 aa, Homo sapiens
MFQKLPDIREVLTCKIEELGSELKEHYKIEAFTPLLAPAQEPVTLLGQIGCDSNGKLNNKSVILEGDREHSSGAQIPVDLSELKEYSLFPGQVVIMEGINTTGRKLVATKLYEGVPLPFYQPTEEDADFEQSMVLVACGPYTTSDSITYDPLLDLIAVINHDRPDVCILFGPFLDAKHEQVENCLLTSPFEDIFKQCLRTIIEGTRSSGSHLVFVPSLRDVHHEPVYPQPPFSYSDLSREDKKQVQFVSEPCSLSINGVIFGLTSTDLLFHLGAEEISSSSGTSDRFSRILKHILTQRSYYPLYPPQEDMAIDYESFYVYAQLPVTPDVLIIPSELRYFVKVGLNSAFSQKHQNPVFDFPF

SEQ ID NO: 5366 - protein, 494 aa, Homo sapiens
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSERYQTMKLFTQIFGVGVKTADRWYREGLRTLDDLREQPQKLTQQQKAGLQHHQDLSTPVLRSDVDALQQVVEEAVGQALPGATVTLTGGFRRGKLQGHDVDFLITHPKEGQEAGLLPRVMCRLQDQGLILYHQHQHSCCESPTRLAQQSHMDAFERSFCIFRLPQPPGAAVGGSTRPCPSWKAVRVDLVVAPVSQFPFALLGWTGSKLFQRELRRFSRKEKGLWLNSHGLFDPEQKTFFQAASEEDIFRHLGLEYLPPEQRNA

SEQ ID NO: 5367 - protein, 457 aa, Homo sapiens
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSERYQTMKLFTQIFGVGVKTADRWYREGLRTLDDLREQPQKLTQQQKAAPPGPEHPSPAVRCRCPAAGGGGSCGAGPAWGHRHADRRLPQGLILYHQHQHSCCESPTRLAQQSHMDAFERSFCIFRLPQPPGAAVGGSTRPCPSWKAVRVDLVVAPVSQFPFALLGWTGSKLFQRELRRFSRKEKGLWLNSHGLFDPEQKTFFQAASEEDIFRHLGLEYLPPEQRNA

SEQ ID NO: 5368 - protein, 508 aa, Homo sapiens
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSERAPAPPGPEHPSPAVRCRCPAAGGGGSCGAGPAWGHRHADRRLPQGLILYHQHQHSCCESPTRLAQQSHMDAFERSFCIFRLPQPPGAAVGGSTRPCPSWKAVRVDLVVAPVSQFPFALLGWTGSKLFQRELRRFSRKEKGLWLNSHGLFDPEQGSSSGKTPRSRKSCFCCRRHFSKRLQRKTSSDTWALSTFLQSRETPEPACVPHFHSGNWAAPNLATECLQADMLPPDPHLHPSPPRPGSSGGQLCLQDQLSPCWCAAGCDEVGALSASLITV

SEQ ID NO: 5369 - protein, 159 aa, Homo sapiens
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEEALEILAEAAGFEGSEGRLLTFCRAASVLKALPSP

SEQ ID NO: 5370 - protein, 242 aa, Homo sapiens
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSESSSPRSSGSV

SEQ ID NO: 5371 - protein, 270 aa, Homo sapiens
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSERYQTMKVRRAGLGPTPGMSCPGNDNTVHTMHGEANRGS

SEQ ID NO: 5372 - protein, 1720 aa, Homo sapiens
MLISKNMPWRRLQGISFGMYSAEELKKLSVKSITNPRYLDSLGNPSANGLYDLALGPADSKEVCSTCVQDFSNCSGHLGHIELPLTVYNPLLFDKLYLLLRGSCLNCHMLTCPRAVIHLLLCQLRVLEVGALQAVYELERILNRFLEENPDPSASEIREELEQYTTEIVQNNLLGSQGAHVKNVCESKSKLIALFWKAHMNAKRCPHCKTGRSVVRKEHNSKLTITFPAMVHRTAGQKDSEPLGIEEAQIGKRGYLTPTSAREHLSALWKNEGFFLNYLFSGMDDDGMESRFNPSVFFLDFLVVPPSRYRPVSRLGDQMFTNGQTVNLQAVMKDVVLIRKLLALMAQEQKLPEEVATPTTDEEKDSLIAIDRSFLSTLPGQSLIDKLYNIWIRLQSHVNIVFDSEMDKLMMDKYPGIRQILEKKEGLFRKHMMGKRVDYAARSVICPDMYINTNEIGIPMVFATKLTYPQPVTPWNVQELRQAVINGPNVHPGASMVINEDGSRTALSAVDMTQREAVAKQLLTPATGAPKPQGTKIVCRHVKNGDILLLNRQPTLHRPSIQAHRARILPEEKVLRLHYANCKAYNADFDGDEMNAHFPQSELGRAEAYVLACTDQQYLVPKDGQPLAGLIQDHMVSGASMTTRGCFFTREHYMELVYRGLTDKVGRVKLLSPSILKPFPLWTGKQVVSTLLINIIPEDHIPLNLSGKAKITGKAWVKETPRSVPGFNPDSMCESQVIIREGELLCGVLDKAHYGSSAYGLVHCCYEIYGGETSGKVLTCLARLFTAYLQLYRGFTLGVEDILVKPKADVKRQRIIEESTHCGPQAVRAALNLPEAASYDEVRGKWQDAHLGKDQRDFNMIDLKFKEEVNHYSNEINKACMPFGLHRQFPENSLQMMVQSGAKGSTVNTMQISCLLGQIELEGRRPPLMASGKSLPCFEPYEFTPRAGGFVTGRFLTGIKPPEFFFHCMAGREGLVDTAVKTSRSGYLQRCIIKHLEGLVVQYDLTVRDSDGSVVQFLYGEDGLDIPKTQFLQPKQFPFLASNYEVIMKSQHLHEVLSRADPKKALHHFRAIKKWQSKHPNTLLRRGAFLSYSQKIQEAVKALKLESENRNGRSPGTQEMLRMWYELDEESRRKYQKKAAACPDPSLSVWRPDIYFASVSETFETKVDDYSQEWAAQTEKSYEKSELSLDRLRTLLQLKWQRSLCEPGEAVGLLAAQSIGEPSTQMTLNTFHFAGRGEMNVTLGIPRLREILMVASANIKTPMMSVPVLNTKKALKRVKSLKKQLTRVCLGEVLQKIDVQESFCMEEKQNKFQVYQLRFQFLPHAYYQQEKCLRPEDILRFMETRFFKLLMESIKKKNNKASAFRNVNTRRATQRDLDNAGELGRSRGEQEGDEEEEGHIVDAEAEEGDADASDAKRKEKQEEEVDYESEEEEEREGEENDDEDMQEERNPHREGARKTQEQDEEVGLGTEEDPSLPALLTQPRKPTHSQEPQGPEAMERRVQAVREIHPFIDDYQYDTEESLWCQVTVKLPLMKINFDMSSLVVSLAHGAVIYATKGITRCLLNETTNNKNEKELVLNTEGINLPELFKYAEVLDLRRLYSNDIHAIANTYGIEAALRVIEKEIKDVFAVYGIAVDPRHLSLVADYMCFEGVYKPLNRFGIRSNSSPLQQMTFETSFQFLKQATMLGSHDELRSPSACLVVGKVVRGGTGLFELKQPLR

SEQ ID NO: 5373 - protein, 1659 aa, Homo sapiens
MLISKNMPWRRLQGISFGMYSAEELKKLSVKSITNPRYLDSLGNPSANGLYDLALGPADSKEVCSTCVQDFSNCSGHLGHIELPLTVYNPLLFDKLYLLLRGSCLNCHMLTCPRAVIHLLLCQLRVLEVGALQAVYELERILNRFLEENPDPSASEIREELEQYTTEIVQNNLLGSQGAHVKNVCESKSKLIALFWKAHMNAKRCPHCKTGRSVVRKEHNSKLTITFPAMVHRTAGQKDSEPLGIEEAQIGKRGYLTPTSAREHLSALWKNEGFFLNYLFSGMDDDGMESRFNPSVFFLDFLVVPPSRYRPVSRLGDQMFTNGQTVNLQAVMKDVVLIRKLLALMAQEQKLPEEVATPTTDEEKDSLIAIDRSFLSTLPGQSLIDKLYNIWIRLQSHVNIVFDSEMDKLMMDKYPGIRQILEKKEGLFRKHMMGKRVDYAARSVICPDMYINTNEIGIPMVFATKLTYPQPVTPWNVQELRQAVINGPNVHPGASMVINEDGSRTALSAVDMTQREAVAKQLLTPATGAPKPQGTKIVCRHVKNGDILLLNRQPTLHRPSIQAHRARILPEEKVLRLHYANCKAYNADFDGDEMNAHFPQSELGRAEAYVLACTDQQYLVPKDGQPLAGLIQDHMVSGASMTTRGCFFTREHYMELVYRGLTDKVGRVKLLSPSILKPFPLWTGKQVVSTLLINIIPEDHIPLNLSGKAKITGKAWVKETPRSVPGFNPDSMCESQVIIREGELLCGVLDKAHYGSSAYGLVHCCYEIYGGETSGKVLTCLARLFTAYLQLYRGFTLGVEDILVKPKADVKRQRIIEESTHCGPQAVRAALNLPEAASYDEVRGKWQDAHLGKDQRDFNMIDLKFKEEVNHYSNEINKACMPFGLHRQFPENSLQMMVQSGAKGSTVNTMQISCLLGQIELEGRRPPLMASGKSLPCFEPYEFTPRAGGFVTGRFLTGIKPPEFFFHCMAGREGLVDTAVKTSRSGYLQRCIIKHLEGLVVQYDLTVRDSDGSVVQFLYGEDGLDIPKTQFLQPKQFPFLASNYEVIMKSQHLHEVLSRADPKKALHHFRAIKKWQSKHPNTLLRRGAFLSYSQKIQEAVKALKLESENRNGRSPGTQEMLRMWYELDEESRRKYQKKAAACPDPSLSVWRPDIYFASVSETFETKVDDYSQEWAAQTEKSYEKSELSLDRLRTLLQLKWQRSLCEPGEAVGLLAAQSIGEPSTQMTLNTFHFAGRGEMNVTLGIPRLREILMVASANIKTPMMSVPVLNTKKALKRVKSLKKQLTRVCLGEVLQKIDVQESFCMEEKQNKFQVYQLRFQFLPHAYYQQEKCLRPEDILRFMETRFFKLLMESIKKKNNKASAFRNVNTRRATQRDLDNAGELGRSRGEQEGDEEEEGHIVDAEAEEGDADASDAKRKEKQEEEVDYESEEEEEREGEENDDEDMQEERNPHREGARKTQEQDEEVTVKLPLMKINFDMSSLVVSLAHGAVIYATKGITRCLLNETTNNKNEKELVLNTEGINLPELFKYAEVLDLRRLYSNDIHAIANTYGIEAALRVIEKEIKDVFAVYGIAVDPRHLSLVADYMCFEGVYKPLNRFGIRSNSSPLQQMTFETSFQFLKQATMLGSHDELRSPSACLVVGKVVRGGTGLFELKQPLR

SEQ ID NO: 5374 - protein, 1135 aa, Homo sapiens
MDPGSRWRNLPSGPSLKHLTDPSYGIPREQQKAALQELTRAHVESFNYAVHEGLGLAVQAIPPFEFAFKDERISFTILDAVISPPTVPKGTICKEANVYPAECRGRRSTYRGKLTADINWAVNGISKGIIKQFLGYVPIMVKSKLCNLRNLPPQALIEHHEEAEEMGGYFIINGIEKVIRMLIMPRRNFPIAMIRPKWKTRGPGYTQYGVSMHCVREEHSAVNMNLHYLENGTVMLNFIYRKELFFLPLGFALKALVSFSDYQIFQELIKGKEDDSFLRNSVSQMLRIVMEEGCSTQKQVLNYLGECFRVKLNVPDWYPNEQAAEFLFNQCICIHLKSNTEKFYMLCLMTRKLFALAKGECMEDNPDSLVNQEVLTPGQLFLMFLKEKLEGWLVSIKIAFDKKAQKTSVSMNTDNLMRIFTMGIDLTKPFEYLFATGNLRSKTGLGLLQDSGLCVVADKLNFIRYLSHFRCVHRGADFAKMRTTTVRRLLPESWGFLCPVHTPDGEPCGLMNHLTAVCEVVTQFVYTASIPALLCNLGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 5375 - protein, 1079 aa, Homo sapiens
MDPGSRWRNLPSGPSLKHLTDPSYGIPREQQKAALQELTRAHVESFNYAVHEGLGLAVQADINWAVNGISKGIIKQFLGYVPIMVKSKLCNLRNLPPQALIEHHEEAEEMGGYFIINGIEKVIRMLIMPRRNFPIAMIRPKWKTRGPGYTQYGVSMHCVREEHSAVNMNLHYLENGTVMLNFIYRKELFFLPLGFALKALVSFSDYQIFQELIKGKEDDSFLRNSVSQMLRIVMEEGCSTQKQVLNYLGECFRVKLNVPDWYPNEQAAEFLFNQCICIHLKSNTEKFYMLCLMTRKLFALAKGECMEDNPDSLVNQEVLTPGQLFLMFLKEKLEGWLVSIKIAFDKKAQKTSVSMNTDNLMRIFTMGIDLTKPFEYLFATGNLRSKTGLGLLQDSGLCVVADKLNFIRYLSHFRCVHRGADFAKMRTTTVRRLLPESWGFLCPVHTPDGEPCGLMNHLTAVCEVVTQFVYTASIPALLCNLGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 5376 - protein, 114 aa, Homo sapiens
MDPGSRWRNLPSGPSLKHLTDPSYGIPREQQKAALQELTRAHVESFNYAVHEGLGLAVQAIPPFEFAFKDERISFTILDAVISPPTVPKGTICKEANVYPAECRGRRSTYRGKL

SEQ ID NO: 5377 - protein, 128 aa, Homo sapiens
MDPGSRWRNLPSGPSLKHLTDPSYGIPREQQKAALQELTRAHVESFNYAVHEGLGLAVQAIPPFEFAFKDERISFTILDAVISPPTVPKGTICKEANVYPAECRGRRSTYRGKLTADINWAVNGISKG

SEQ ID NO: 5378 - protein, 459 aa, Homo sapiens [sequence omitted]

SEQ ID NO: 5379 - protein, 924 aa, Homo sapiens
MHCVREEHSAVNMNLHYLENGTVMLNFIYRKELFFLPLGFALKALVSFSDYQIFQELIKGKEDDSFLRNSVSQMLRIVMEEGCSTQKQVLNYLGECFRVKLNVPDWYPNEQAAEFLFNQCICIHLKSNTEKFYMLCLMTRKLFALAKGECMEDNPDSLVNQEVLTPGQLFLMFLKEKLEGWLVSIKIAFDKKAQKTSVSMNTDNLMRIFTMGIDLTKPFEYLFATGNLRSKTGLGLLQDSGLCVVADKLNFIRYLSHFRCVHRGADFAKMRTTTVRRLLPESWGFLCPVHTPDGEPCGLMNHLTAVCEVVTQFVYTASIPALLCNLGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 5380 - protein, 1173 aa, Homo sapiens
MRAKEAAETGLRPLLPACTERLASGVYRETGVRCAGGHMDPGSRWRNLPSGPSLKHLTDPSYGIPREQQKAALQELTRAHVESFNYAVHEGLGLAVQAIPPFEFAFKDERISFTILDAVISPPTVPKGTICKEANVYPAECRGRRSTYRGKLTADINWAVNGISKGIIKQFLGYVPIMVKSKLCNLRNLPPQALIEHHEEAEEMGGYFIINGIEKVIRMLIMPRRNFPIAMIRPKWKTRGPGYTQYGVSMHCVREEHSAVNMNLHYLENGTVMLNFIYRKELFFLPLGFALKALVSFSDYQIFQELIKGKEDDSFLRNSVSQMLRIVMEEGCSTQKQVLNYLGECFRVKLNVPDWYPNEQAAEFLFNQCICIHLKSNTEKFYMLCLMTRKLFALAKGECMEDNPDSLVNQEVLTPGQLFLMFLKEKLEGWLVSIKIAFDKKAQKTSVSMNTDNLMRIFTMGIDLTKPFEYLFATGNLRSKTGLGLLQDSGLCVVADKLNFIRYLSHFRCVHRGADFAKMRTTTVRRLLPESWGFLCPVHTPDGEPCGLMNHLTAVCEVVTQFVYTASIPALLCNLGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 5381 - protein, 1174 aa, Homo sapiens
MYDADEDMQYDEDDDEITPDLWQEACWIVISSYFDEKGLVRQQLDSFDEFIQMSVQRIVEDAPPIDLQAEAQHASGEVEEPPRYLLKFEQIYLSKPTHWERDGAPSPMMPNEARLRNLTYSAPLYVDITKTVIKEGEEQLQTQHQKTFIGKIPIMLRSTYCLLNGLTDRDLCELNECPLDPGGYFIINGSEKVLIAQEKMATNTVYVFAKKDSKYAYTGECRSCLENSSRPTSTIWVSMLARGGQGAKKSAIGQRIVATLPYIKQEVPIIIVFRALGFVSDRDILEHIIYDFEDPEMMEMVKPSLDEAFVIQEQNVALNFIGSRGAKPGVTKEKRIKYAKEVLQKEMLPHVGVSDFCETKKAYFLGYMVHRLLLAALGRRELDDRDHYGNKRLDLAGPLLAFLFRGMFKNLLKEVRIYAQKFIDRGKDFNLELAIKTRIISDGLKYSLATGNWGDQKKAHQARAGVSQVLNRLTFASTLSHLRRLNSPIGRDGKLAKPRQLHNTLWGMVCPAETPEGHAVGLVKNLALMAYISVGSQPSPILEFLEEWSMENLEEISPAAIADATKIFVNGCWVGIHKDPEQLMNTLRKLRRQMDIIVSEVSMIRDIREREIRIYTDAGRICRPLLIVEKQKLLLKKRHIDQLKEREYNNYSWQDLVASGVVEYIDTLEEETVMLAMTPDDLQEKEVAYCSTYTHCEIHPSMILGVCASIIPFPDHNQSPRNTYQSAMGKQAMGVYITNFHVRMDTLAHVLYYPQKPLVTTRSMEYLRFRELPAGINSIVAIASYTGYNQEDSVIMNRSAVDRGFFRSVFYRSYKEQESKKGFDQEEVFEKPTRETCQGMRHAIYDKLDDDGLIAPGVRVSGDDVIIGKTVTLPENEDELESTNRRYTKRDCSTFLRTSETGIVDQVMVTLNQEGYKFCKIRVRSVRIPQIGDKFASRHGQKGTCGIQYRQEDMPFTCEGITPDIIINPHAIPSRMTIGHLIECLQGKVSANKGEIGDATPFNDAVNVQKISNLLSDYGYHLRGNEVLYNGFTGRKITSQIFIGPTYYQRLKHMVDDKIHSRARGPIQILNRQPMEGRSRDGGLRFGEMERDCQIAHGAAQFLRERLFEASDPYQVHVCNLCGIMAIANTRTHTYECRGCRNKTQISLVRMPYACKLLFQELMSMSIAPRMMSV

SEQ ID NO: 5382 - protein, 1174 aa, Homo sapiens; identical to SEQ ID NO: 5381

SEQ ID NO: 5383 - protein, 142 aa, Homo sapiens
MAAGGSDPRAGDVEEDASQLIFPKEFETAETLLNSEVHMLLEHRKQQNESAEDEQELSEVFMKTLNYTARFSRFKNRETIASVRSLLLQKKLHKFELACLANLCPETAEESKALIPSLEGRFEDEELQQILDDIQTKRSFQY

SEQ ID NO: 5384 - protein, 115 aa, Homo sapiens
MNAPPAFESFLLFEGEKITINKDTKVPNACLFTINKEDHTLGNIIKSQLLKDPQVLFAGYKVPHPLEHKIIIRVQTTPDYSPQEAFTNAITDLISELSLLEERFRTCLLPLRLLP

SEQ ID NO: 5385 - protein, 115 aa, Homo sapiens; identical to SEQ ID NO: 5384

SEQ ID NO: 5386 - protein, 368 aa, Homo sapiens
MCSLPRGFEPQAPEDLAQRSLVELREMLKRQERLLRNEKFICKLPDKGKKIFDSFAKLKAAIAECEEVRRKSELFNPVSLDCKLRQKAIAEVDVGTDKAQNSDPILDTSSLVPGCSSVDNIKSSQTSQNQGLGRPTLEGDEETSEVEYTVNKGPASSNRDRVPPSSEASEHHPRHRVSSQAEDTSSSFDNLFIDRLQRITIADQGEQQSEENASTKNLTGLSSGTEKKPHYMEVLEMRAKNPVPQLRKFKTNVLPFRQNDSSSHCQKSGSPISSEERRRRDKQHLDDITAARLLPLHHMPTQLLSIEESLALQKQQKQNYEEMQAKLAAQKLAERLNIKMRSYNPEGESSGRYREVRDEDDDWSSDEF

SEQ ID NO: 5387 - protein, 211 aa, Homo sapiens
MCSLPRGFEPQAPEDLAQRSLVELREMLKRQERLLRNELQRITIADQGEQQSEENASTKNLTGLSSGTEKKPHYMEVLEMRAKNPVPQLRKFKTNVLPFRQNDSSSHCQKSGSPISSEERRRRDKQHLDDITAARLLPLHHMPTQLLSIEESLALQKQQKQNYEEMQAKLAAQKLAERLNIKMRSYNPEGESSGRYREVRDEDDDWSSDEF

SEQ ID NO: 5388 - protein, 363 aa, Homo sapiens
MCSLPRGFEPQAPEDLAQRSLVELREMLKRQERLLRNEKFICKLPDKGKKIFDSFAKLKAAIAECEEVRRKSELFNPVSLDCKLRQKAIAEVDVGTDKAQNSDPILDTSSLVPGCSSVDNIKSSQTSQNQGLGRPTLEGDEETSEVEYTVNKGPASSNRDRVPPSSEASEHHPRHRVSSQAEDTSSSFDNLFIDRLQRITIADQGEQQSEENASTKNLTGLSSGTEKKPHYMEVLEMRAKNPVPQLRKFKTNVLPFRQNDSSSHCQKSGSPISSEERRRRDKQHLDDITAARLLPLHHMPTQLLSIEESLALQKQQKQNYEERPFYSPQYRSSMNLLSLAAAAKDTRGSKSGKMGSLALLTKL

SEQ ID NO: 5389 - protein, 534 aa, Homo sapiens
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQEIPKTPDHAPSRTFYLYTVNILSAARMLLHRCYKSIANLIERRQFETKENKRLLEKSQRVEAIIASMQATGAEEAQLQEIEEMITAPERQQLETLKRNVNKLDASEIQVDETIFLLESYIECTMKRQ

SEQ ID NO: 5390 - protein, 411 aa, Homo sapiens
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQVGCQ

SEQ ID NO: 5391 - protein, 398 aa, Homo sapiens
MSEGNAAGEPSTPGGPRPLLTGARGLIGRRPAPPLTPGRLPSIRSRDLTLGGVKKKTFTPNIISRKIKEEPKEEVTVKKEKRERDRDRQREGHGRGRGRPEVIQSHSIFEQGPAEMMKKKGNWDKTVDVSDMGPSHIINIKKEKRETDEETKQILRMLEKDDFLDDPGLRNDTRNMPVQLPLAHSGWLFKEENDEPDVKPWLAGPKEEDMEVDIPAVKVKEEPRDEEEEAKMKAPPKAARKTPGLPKDVSVAELLRELSLTKEEELLFLQLPDTLPGQPPTQDIKPIKTEVQGEDGQVVLIKQEKDREAKLAENACTLADLTEGQVGKLLIRKSGRVQLLLGKVTLDVTMGTACSFLQELVSVGLGDSRTGEMTVLGHVKHKLVCSPDFESLLDHKHR

SEQ ID NO: 5392 - protein, 398 aa, Homo sapiens; identical to SEQ ID NO: 5391

SEQ ID NO: 5393 - protein, 708 aa, Homo sapiens
MANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTVQS

SEQ ID NO: 5394 - protein, 666 aa, Homo sapiens
MANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQDCCVSYGGMWYLKGTVQS

SEQ ID NO: 5395 - protein, 672 aa, Homo sapiens
MANEEDDPVVQEIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQHRQVLLEIFSKNYRVRRNMIQSRLTQECGEDLSKQEVDKVLKDCCVSYGGMWYLKGTVQS

SEQ ID NO: 5396 - protein, 687 aa, Homo sapiens
MANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQEEEKDKPVAPSNVLSMAQLRTLPLADQIKILMKNVKVMPFANLMSLLGPSIDSVAVLRGIQKVAMLVQGNWVVKSDILYPKDSSSPHSGVPAEVLCRGRDFVMWKFTQSRWVVRKEVATVTKLCAEDVKDFLEHMAVVRINKGWEFILPYDGEFIKKHPDVVQRQHMLWTGIQAKLEKVYNLVKETMPKKPDAQSGPAGLVCGDQRIQVAKTKAQQNHALLERELQRRKEQLRVPAVPPGVRIKEEPVSEEGEEDEEQEAEEEPMDTSPSGLHSKLANGLPLGRAAGTDSFNGHPPQGCASTPVARELKAFVEATFQRQFVLTLSELKRLFNLHLASLPPGHTLFSGISDRMLQDTVLAAGCKQILVPFPPQTAASPDEQKVFALWESGDMSDQSRLTQECGEDLSKQEVDKVLKDCCVSYGGMWYLKGTVQS

SEQ ID NO: 5397 - protein, 316 aa, Homo sapiens
MAEVKVKVQPPDADPVEIENRIIELCHQFPHGITDQVIQNEMPHIEAQQRAVAINRLLSMGQLDLLRSNTGLLYRIKDSQNAGKMKGSDNQEKLVYQIIEDAGNKGIWSRDIRYKSNLPLTEINKILKNLESKKLIKAVKSVAASKKKVYMLYNLQPDRSVTGGAWYSDQDFESEFVEVLNQQCFKFLQSKAETARESKQNPMIQRNSSFASSHEVWKYICELGISKVELSMEDIETILNTLIYDGKVEMTIIAAKEGTVGSVDGHMKLYRAVNPIIPPTGLVRAPCGLCPVFDDCHEGGEISPSNCIYMTEWLEF

SEQ ID NO: 5398 - protein, 223 aa, Homo sapiens
MAGNKGRGRAAYTFNIEAVGFSKGEKLPDVVLKPPPLFPDTDYKPVPLKTGEGEEYMLALKQELRETMKRMPYFIETPEERQDIERYSKRYMKVYKEEWIPDWRRLPREMMPRNKCKKAGPKPKKAKDAGKGTPLTNTEDVLKKMEELEKRGDGEKSDEENEEKEGSKEKSKEGDDDDDDDAAEQEEYDEEEQEEENDYINSYFEDGDDFGADSDDNMDEATY

SEQ ID NO: 5399 - protein, 223 aa, Homo sapiens; identical to SEQ ID NO: 5398

SEQ ID NO: 5400 - protein, 175 aa, Homo sapiens
MFVLVEMVDTVRIPPWQFERKLNDSIAEELNKKLANKVVYNVGLCICLFDITKLEDAYVFPGDGASHTKVSLGFFDDILIPPESLQQPAKFDEAEQVWVWEYETEEGAHDLYMDTGEEIRFRVVDESFVDTSPTGPSSADATTSSEELPKKEAPYTLVGSISEPGLGLLSWWTSN

SEQ ID NO: 5401 - protein, 204 aa, Homo sapiens
MFVLVEMVDTVRIPPWQFERKLNDSIAEELNKKLANKVVYNVGLCICLFDITKLEDAYVFPGDGASHTKVHFRCVVFHPFLDEILIGKIKGCSPEGVHVSLGFFDDILIPPESLQQPAKFDEAEQVWVWEYETEEGAHDLYMDTGEEIRFRVVDESFVDTSPTGPSSADATTSSEELPKKEAPYTLVGSISEPGLGLLSWWTSN

SEQ ID NO: 5402 - protein, 204 aa, Homo sapiens; identical to SEQ ID NO: 5401

SEQ ID NO: 5403 - protein, 204 aa, Homo sapiens; identical to SEQ ID NO: 5401

SEQ ID NO: 5404 - protein, 108 aa, Homo sapiens
MLLFCPGCGNGLIVEEGQRCHRFSCNTCPYVHNITRKVTNRKYPKLKEVDDVLGGAAAWENVDSTAESCPKCEHPRAYFMQLQTRSADEPMTTFYKCCNAQCGHRWRD

SEQ ID NO: 5405 - protein, 183 aa, Homo sapiens
MDASPSPFSLPKKLNELSARRGSDELLSSGIINGPFTMNSSTPSTANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARAQAALQAVSAVQSGSLALSGGPSNEGTVLPG

SEQ ID NO: 5406 - protein, 555 aa, Homo sapiens
MDGVVTDLITVGLKRGSDELLSSGIINGPFTMNSSTPSTGVYANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGLSVPAVPGALGPLTITSSAVTGRMAIPGASGIPGNSVLLVTNLNPDLITPHGLFILFGVYGDVHRVKIMFNKKENALVQMADANQAQLAMNHLSGQRLYGKVLRATLSKHQAVQLPREGQEDQGLTKDFSNSPLHRFKKPGSKNFQNIFPPSATLHLSNIPPSVTVDDLKNLFIEAGCSVKAFKFFQKDRKMALIQLGSVEEAIQALIELHNHDLGENHHLRVSFSKSTI

SEQ ID NO: 5407 - protein, 457 aa, Homo sapiens
MAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGLSVPAVPGALGPLTITSSAVTGRMAIPGASGIPGNSVLLVTNLNPDLITPHGLFILFGVYGDVHRVKIMFNKKENALVQMADANQAQLAMNHLSGQRLYGKVLRATLSKHQAVQLPREGQEDQGLTKDFSNSPLHRFKKPGSKNFQNIFPPSATLHLSNIPPSVTVDDLKNLFIEAGCSVKAFKFFQKDRKMALIQLGSVEEAIQALIELHNHDLGENHHLRVSFSKSTI

SEQ ID NO: 5408 - protein, 552 aa, Homo sapiens
MDGVVTDLITVGLKRGSDELLSSGIINGPFTMNSSTPSTANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGLSVPAVPGALGPLTITSSAVTGRMAIPGASGIPGNSVLLVTNLNPDLITPHGLFILFGVYGDVHRVKIMFNKKENALVQMADANQAQLAMNHLSGQRLYGKVLRATLSKHQAVQLPREGQEDQGLTKDFSNSPLHRFKKPGSKNFQNIFPPSATLHLSNIPPSVTVDDLKNLFIEAGCSVKAFKFFQKDRKMALIQLGSVEEAIQALIELHNHDLGENHHLRVSFSKSTI

SEQ ID NO: 5409 - protein, 524 aa, Homo sapiens
MNSSTPSTGVYANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGLSVPAVPGALGPLTITSSAVTGRMAIPGASGIPGNSVLLVTNLNPDLITPHGLFILFGVYGDVHRVKIMFNKKENALVQMADANQAQLAMNHLSGQRLYGKVLRATLSKHQAVQLPREGQEDQGLTKDFSNSPLHRFKKPGSKNFQNIFPPSATLHLSNIPPSVTVDDLKNLFIEAGCSVKAFKFFQKDRKMALIQLGSVEEAIQALIELHNHDLGENHHLRVSFSKSTI

SEQ ID NO: 5410 - protein, 77 aa, Homo sapiens
MDGVVTDLITVGLKRGSDELLSSGIINGPFTMNSSTPSTGVYANGNDSKKFKRDRPPCSPSRVLHLRKIPCDVTEAE

SEQ ID NO: 5411 - protein, 558 aa, Homo sapiens
MDASPSPFSLPKKLNELSARRGSDELLSSGIINGPFTMNSSTPSTANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGLSVPAVPGALGPLTITSSAVTGRMAIPGASGIPGNSVLLVTNLNPDLITPHGLFILFGVYGDVHRVKIMFNKKENALVQMADANQAQLAMNHLSGQRLYGKVLRATLSKHQAVQLPREGQEDQGLTKDFSNSPLHRFKKPGSKNFQNIFPPSATLHLSNIPPSVTVDDLKNLFIEAGCSVKAFKFFQKDRKMALIQLGSVEEAIQALIELHNHDLGENHHLRVSFSKSTI

SEQ ID NO: 5412 - protein, 499 aa, Homo sapiens
MENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 5413 - protein, 542 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 5414 - protein, 516 aa, Homo sapiens
MENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 5415 - protein, 559 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 5416 - protein, 743 aa, Homo sapiens
MNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 5417 - protein, 755 aa, Homo sapiens
MLDCSDYVLDSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 5418 - protein, 741 aa, Homo sapiens
MKTRMKIFVMIHFHLMNSTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 5419 - protein, 766 aa, Homo sapiens
MADGGAASQDESSAAAAAAADSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 5420 - protein, 653 aa, Homo sapiens
MNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQGLLHGLENFLTKN

SEQ ID NO: 5421 - protein, 703 aa, Homo sapiens
MADGGAASQDESSAAAAAAADSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 5422 - protein, 92 aa, Homo sapiens
MNNPSETSKPSMESGDGNTGTQTNGLDFQKQPVPVGGAISTAQAQAFLGHLHQVQLAGTSLQAAAQSLNVQSKSNEESGDSQQPSQPSQQPS

SEQ ID NO: 5423 - protein, 254 aa, Homo sapiens [sequence omitted]

SEQ ID NO: 5424 - protein, 113 aa, Homo sapiens
MNNPSETSKPSMESGDGNTGTGTAAGCCSAAALRQPAAQCCWSHHLRLCCHAHDADPPVSAHTDRTGSSTTATASTAESQPATVCVGASNHQFAASAVYHLTDAPGPAGSPAS

SEQ ID NO: 5425 - protein, 743 aa, Homo sapiens; identical to SEQ ID NO: 5416

SEQ ID NO: 5426 - protein, 136 aa, Homo sapiens
MNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAA

SEQ ID NO: 5427 - protein, 528 aa, Homo sapiens
MADGGAASQDESSAAAAAAADSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSALQTPPPTTQQP

SEQ ID NO: 5428 - protein, 54 aa, Homo sapiens
MNNPSETSKPSMESGDGNTGTQTNGLDFQKQPVPVGGAISTAQAQAFLGHLHQV

SEQ ID NO: 5429 - protein, 755 aa, Homo sapiens; identical to SEQ ID NO: 5417

SEQ ID NO: 5430 - protein, 409 aa, Homo sapiens
MMMMSLNSKQAFSMPHGGSLHVEPKYSALHSTSPGSSAPIAPSASSPSSSSNAGGGGGGGGGGGGGGGRSSSSSSSGSSGGGGSEAMRRACLPTPPSNIFGGLDESLLARAEALAAVDIVSQSKSHHHHPPHHSPFKPDATYHTMNTIPCTSAASSSSVPISHPSALAGTHHHHHHHHHHHHQPHQALEGELLEHLSPGLALGAMAGPDGAVVSTPAHAPHMATMNPMHQAALSMAHAHGLPSHMGCMSDVDADPRDLEAFAERFKQRRIKLGVTQADVGSALANLKIPGVGSLSQSTICRFESLTLSHNNMIALKPILQAWLEEAEKSHREKLTKPELFNGAEKKRKRTSIAAPEKRSLEAYFAIQPRPSSEKIAAIAEKLDLKKNVVRVWFCNQRQKQKRMKYSAGI

SEQ ID NO: 5431 - protein, 301 aa, Homo sapiens
MPGISSQILTNAQGQVIGTLPWVVNSASVAAPAPAQSLQVQAVTPQLLLNAQGQVIATLASSPLPPPVAVRKPSTPESPAKSEVQPIQPTPTVPQPAVVIASPAPAAKPSASAPIPITCSETPTVSQLVSKPHTPSLDEDGINLEEIREFAKNFKIRRLSLGLTQTQVGQALTATEGPAYSQSAICRFEKLDITPKSAQKLKPVLEKWLNEAELRNQEGQQNLMEFVGGEPSKKRKRRTSFTPQAIEALNAYFEKNPLPTGQEITEIAKELNYDREVVRVWFCNRRQTLKNTSKLNVFQIP

SEQ ID NO: 5432 - protein, 301 aa, Homo sapiens; identical to SEQ ID NO: 5431

SEQ ID NO: 5433 - protein, 29 aa, Homo sapiens
MPGISSQILTNAQGQVIGTLPWVVNSASV

SEQ ID NO: 5434 - protein, 301 aa, Homo sapiens; identical to SEQ ID NO: 5431

SEQ ID NO: 5435 - protein, 537 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQVWVGSSSGLPPLEPLPSDLPSWDFAQPALWRSSHSVPDTAFSLSLKKSFPALENLGPAHSSNTLFCPAPPGYLRQGWTTPEGSRAFTQWPVG

SEQ ID NO: 5436 - protein, 687 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGFSSASYLKVHVKTHHGVPLPQVSRHQEPILNGGAAFHCARTYGNKEGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 5437 - protein, 641 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNREGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 5438 - protein, 537 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGLQAPGAHPEWGSSVPLRQDLWQQRRPEMLTSGSD

SEQ ID NO: 5439 - protein, 367 aa, Homo sapiens
MMGSVLPAEALVLKTGLKAPGLALAEVITSDILHSFLYGRWRNVLGEQLFEDKSHHASPKTAFTAEVLAQSFSGEVQKLSSLVLPAEVIIAQSSIPGEGLGIFSKTWIKAGTEMGPFTGRVIAPEHVDICKNNNLMWEVFNEDGTVRYFIDASQEDHRSWMTYIKCARNEQEQNLEVVQIGTSIFYKAIEMIPPDQELLVWYGNSHNTFLGIPGVPGLEEDQKKNKHEDFHPADSAAGPAGRMRCVICHRGFNSRSNLRSHMRIHTLDKPFVCRFCNRRFSQSSTLRNHVRLHTGERPYKCQVCQSAYSQLAGLRAHQKSARHRPPSTALQAHSPALPAPHAHAPALAAAAAAAAAAAAHHLPAMVL

SEQ ID NO: 5440 - protein, 717 aa, Homo sapiens
MHGAARAPATSVSADCCIPAGLRLGPVPGTFKLGKYLSDRREPGPKKKVLTIQTSAHQVRMVRGELVDESGGSPLEWIGLIRAARNSQEQTLEAIADLPGGQIFYRALRDVQPGEELTVWYSNSLAQWFDIPTTATPTHDEKGEERYICWYCWRTFRYPNSLKAHLRFHCVFSGGGGGAFLHHEHAARQGAVPAADGLGLSPKPPAPDFAAPSQAGTLRPHPLGPPPVQACGAREGIKREASSAPSATSPTPGKWGQPKKGKEQLDRALDMSGAARGQGHFLGIVGGSSAGVGSLAFYPGVRSAFKPAGLARAAAAAHGDPYREESSSKQGAGLALGRLLGGGRACGRPGSGENSAAGGAGHHHHHHAHHHHHPKCLLAGDPPPPPPPGLPCSGALRGFPLLSVPPEEASAFKHVERAPPAAAALPGARYAQLPPAPGLPLERCALPPLDPGGLKAYPGGECSHLPAVMPAFTVYNGELLYGSPATTAYYPLKLHFGGLLKYPESISYFSGPAAAALSPAELGSLASIDREIAMHNQQLSEMAAGKGRGRLDSGTLPPAVAAAGGTGGGGSGGSGAGKPKTGHLCLYCGKLYSRKYGLKIHMRTHTGYKPLKCKVCLRPFGDPSNLNKHIRLHAEGNTPYRCEFCGKVLVRRRDLERHVKSRHPGQSLLAKAGDGPGAEPGYPPEPGDPKSDDSDVDVCFTDDQSDPEVGGGGERDL

SEQ ID NO: 5441 - protein, 707 aa, Homo sapiens
MHGAARAPATSVSADCCIPAGLRLGPVPGTFKLGKYLSDRREPGPKKKVRMVRGELVDESGGSPLEWIGLIRAARNSQEQTLEAIADLPGGQIFYRALRDVQPGEELTVWYSNSLAQWFDIPTTATPTHDEKGEERYICWYCWRTFRYPNSLKAHLRFHCVFSGGGGGAFLHHEHAARQGAVPAADGLGLSPKPPAPDFAAPSQAGTLRPHPLGPPPVQACGAREGIKREASSAPSATSPTPGKWGQPKKGKEQLDRALDMSGAARGQGHFLGIVGGSSAGVGSLAFYPGVRSAFKPAGLARAAAAAHGDPYREESSSKQGAGLALGRLLGGGRACGRPGSGENSAAGGAGHHHHHHAHHHHHPKCLLAGDPPPPPPPGLPCSGALRGFPLLSVPPEEASAFKHVERAPPAAAALPGARYAQLPPAPGLPLERCALPPLDPGGLKAYPGGECSHLPAVMPAFTVYNGELLYGSPATTAYYPLKLHFGGLLKYPESISYFSGPAAAALSPAELGSLASIDREIAMHNQQLSEMAAGKGRGRLDSGTLPPAVAAAGGTGGGGSGGSGAGKPKTGHLCLYCGKLYSRKYGLKIHMRTHTGYKPLKCKVCLRPFGDPSNLNKHIRLHAEGNTPYRCEFCGKVLVRRRDLERHVKSRHPGQSLLAKAGDGPGAEPGYPPEPGDPKSDDSDVDVCFTDDQSDPEVGGGGERDL

SEQ ID NO: 5442 - protein, 1507 aa, Homo sapiens
MPRRRPPASGAAQFPERIATRSPDPIPLCTFQRQPRAAPVQPPCRLFFVTFAGCGHRWRSESKPGWISRSRSGIALRAARPPGSSPPRPAAPRPPPPGGVVAEAPGDVVIPRPRVQPMRVARGGPWTPNPAFREAESWSQIGNQRVSEQLLETSLGNEVSDTEPLSPASAGLRRNPALPPGPFAQNFSWGNQENLPPALGKIANGGGTGAGKAECGYETESHLLEPHEIPLNVNTHKFSDCEFPYEFCTVCFSPFKLLGMSGVEGVWNQHSRSASMHTFLNHSATGIREAGCRKDMPVSEMAEDGSEEIMFIWCEDCSQYHDSECPELGPVVMVKDSFVLSRARSWPASGHVHTQAGQGMRGYEDRDRADPQQLPEAVPAGLVRRLSGQQLPCRSTLTWGRLCHLVAQGRSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVHFKDIALMDDHQREEFIGKIGISSEENDDNSDESADSEPHKYSCKRCQLTFGRGKEYLKHIMEVHKEKGYGCSICNRRFALKATYHAHMVIHRENLPDPNVQKYIHPCEICGRIFNSIGNLERHKLIHTGVKSHACEQCGKSFARKDMLKEHMRVHDNVREYLCAECGKGMKTKHALRHHMKLHKGIKEYECKECHRRFAQKVNMLKHCKRHTGIKDFMCELCGKTFSERNTMETHKLIHTVGKQWTCSVCDKKYVTEYMLQKHVQLTHDKVEAQSCQLCGTKVSTRASMSRHMRRKHPEVLAVRIDDLDHLPETTTIDASSIGIVQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPSQPQAPPQQAAQPQVQAEQQQQQMYSY

SEQ ID NO: 5443 - protein, 518 aa, Homo sapiens
MAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTGLIAHPGEGGPGGSRLRDLPATSPSTRRSTATRSLPVRSAARCSTARTSCWTTSAGTWKTCAA

SEQ ID NO: 5444 - protein, 1178 aa, Homo sapiens
MPRRRPPASGAAQFPERIATRSPDPIPLCTFQRQVSEMAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVHFKDIALMDDHQREEFIGKIGISSEENDDNSDESADSEPHKYSCKRCQLTFGRGKEYLKHIMEVHKEKGYGCSICNRRFALKATYHAHMVIHRENLPDPNVQKYIHPCEICGRIFNSIGNLERHKLIHTGVKSHACEQCGKSFARKDMLKEHMRVHDNVREYLCAECGKGMKTKHALRHHMKLHKGIKEYECKECHRRFAQKVNMLKHCKRHTGIKDFMCELCGKTFSERNTMETHKLIHTVGKQWTCSVCDKKYVTEYMLQKHVQLTHDKVEAQSCQLCGTKVSTRASMSRHMRRKHPEVLAVRIDDLDHLPETTTIDASSIGIVQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPSQPQAPPQQAAQPQVQAEQQQQQMYSY

SEQ ID NO: 5445 - protein, 1507 aa, Homo sapiens; identical to SEQ ID NO: 5442

SEQ ID NO: 5446 - protein, 478 aa, Homo sapiens
MAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTATSPSTRRSTATRSLPVRSAARCSTARTSCWTTSAGTWKECGE

SEQ ID NO: 5447 - protein, 1141 aa, Homo sapiens
MAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVHFKDIALMDDHQREEFIGKIGISSEENDDNSDESADSEPHKYSCKRCQLTFGRGKEYLKHIMEVHKEKGYGCSICNRRFALKATYHAHMVIHRENLPDPNVQKYIHPCEICGRIFNSIGNLERHKLIHTGVKSHACEQCGKSFARKDMLKEHMRVHDNVREYLCAECGKGMKTKHALRHHMKLHKGIKEYECKECHRRFAQKVNMLKHCKRHTGIKDFMCELCGKTFSERNTMETHKLIHTVGKQWTCSVCDKKYVTEYMLQKHVQLTHDKVEAQSCQLCGTKVSTRASMSRHMRRKHPEVLAVRIDDLDHLPETTTIDASSIGIVQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPSQPQAPPQQAAQPQVQAEQQQQQMYSY

SEQ ID NO: 5448 - protein, 555 aa, Homo sapiens
MPRRRPPASGAAQFPERIATRSPDPIPLCTFQRQVSEMAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTGLIAHPGEGGPGGSRLRDLPATSPSTRRSTATRSLPVRSAARCSTARTSCWTTSAGTWKECGE

SEQ ID NO: 5449 - protein, 1161 aa, Homo sapiens
MAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTGLIAHPGEGGPGGSRLRDLPDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVHFKDIALMDDHQREEFIGKIGISSEENDDNSDESADSEPHKYSCKRCQLTFGRGKEYLKHIMEVHKEKGYGCSICNRRFALKATYHAHMVIHRENLPDPNVQKYIHPCEICGRIFNSIGNLERHKLIHTGVKSHACEQCGKSFARKDMLKEHMRVHDNVREYLCAECGKGMKTKHALRHHMKLHKGIKEYECKECHRRFAQKVNMLKHCKRHTGIKDFMCELCGKTFSERNTMETHKLIHTVGKQWTCSVCDKKYVTEYMLQKHVQLTHDKVEAQSCQLCGTKVSTRASMSRHMRRKHPEVLAVRIDDLDHLPETTTIDASSIGIVQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPSQPQAPPQQAAQPQVQAEQQQQQMYSY

SEQ ID NO: 5450 - protein, 595 aa, Homo sapiens
MLKPGDPGGSAFLKVDPAYLQHWQQLFPHGGAGPLKGSGAAGLLSAPQPLQPPPPPPPPERAEPPPDSLRPRPASLSSASSTPASSSTSASSASSCAAAAAAAALAGLSALPVSQLPVFAPLAAAAVAAEPLPPKELCLGATSGPGPVKCGGGGGGGGEGRGAPRFRCSAEELDYYLYGQQRMEIIPLNQHTSDPNNRCDMCADNRNGECPMHGPLHSLRRLVGTSSAAAAAPPPELPEWLRDLPREVCLCTSTVPGLAYGICAAQRIQQGTWIGPFQGVLLPPEKVQAGAVRNTQHLWEIYDQDGTLQHFIDGGEPSKSSWMRYIRCARHCGEQNLTVVQYRSNIFYRACIDIPRGTELLVWYNDSYTSFFGIPLQCIAQDENLNVPSTVMEAMCRQDALQPFNKSSKLAPTTQQRSVVFPQTPCSRNFSLLDKSGPIESGFNQINVKNQRVLASPTSTSQLHSEFSDWHLWKCGQCFKTFTQRILLQMHVCTQNPDRPYQCGHCSQSFSQPSELRNHVVTHSSDRPFKCGYCGRAFAGATTLNNHIRTHTGEKPFKCERCERSFTQATQLSRHQRMPNECKPITESPESIEVD

SEQ ID NO: 5451 - protein, 171 aa, Homo sapiens
MCQNFFIDSCAAHGPPTFVKDSAVDKGHPNRSALSLPPGLRIGPSGIPQAGLGVWNEASDLPLGLHFGPYEGRITEDEEAANSGYSWLITKGRNCYEYVDGKDKSSANWMRTKARDPSMSLMLSGLFKSKISQSTCGTQSLLSELPRTICKKTSPTRESLPRGSESGAAIF

SEQ ID NO: 5452 - protein, 171 aa, Homo sapiens; identical to SEQ ID NO: 5451

SEQ ID NO: 5453 - protein, 138 aa, Homo sapiens
MSPERSQEESPEGDTERTERKPMVKDAFKDISIYFTKEEWAEMGDWEKTRYRNVKMNYNALITVGLRATRPAFMCHRRQAIKLQVDDTEDSDEEWTPRQQVKPPWMAFRGEQSKHQKIVRCVRTSSLTAVLLMGPLHL

SEQ ID NO: 5454 - protein, 492 aa, Homo sapiens
MSPERSQEESPEGDTERTERKPMVKDAFKDISIYFTKEEWAEMGDWEKTRYRNVKMNYNALITVGLRATRPAFMCHRRQAIKLQVDDTEDSDEEWTPRQQVKPPWMAFRGEQSKHQKGMPKASFNNESSLRELSGTPNLLNTSDSEQAQKPVSPPGEASTSGQHSRLKLELRRKETEGKMYSLRERKGHAYKEISEPQDDDYLYCEMCQNFFIDSCAAHGPPTFVKDSAVDKGHPNRSALSLPPGLRIGPSGIPQAGLGVWNEASDLPLGLHFGPYEGRITEDEEAANSGYSWLITKGRNCYEYVDGKDKSSANWMRYVNCARDDEEQNLVAFQYHRQIFYRTCRVIRPGCELLVWSGDEYGQELGIRSSIEPAESLGQAVNCWSGMGMSMARNWASSGAASGRKSSWQGENQSQRSIHVPHAVWPFQVKNFSVNMWNAITPLRTSQDHLQENFSNQRIPAQGIRIRSGNILIHAAVMTKPKVKRSKKGPNS

SEQ ID NO: 5455 - protein, 689 aa, Homo sapiens
MEDTGIQRGIWDGDAKAVQQCLTDIFTSVYTTCDIPENAIFGPCVLSHTSLYDSIAFIALKSTDKRTVPYIFRVDTSAANGSSEGLMWLRLVQSARDKEEQNLEAYIKNGQLFYRSLRRIAKDEELLVWYGKELTELLLLCPSRSHNKMNGSSPYTCLECSQRFQFEFPYVAHLRFRCPKRLHSADISPQDEQGGGVGTKDHGGGGGGGKDQQQQQQEAPLGPGPKFCKAGPLHHYPSPSPESSNPSAAAGGSSAKPSTDFHNLARELENSRGGSSCSPAQSLSSGSGSGGGGGHQEAELSPDGIATGGGKGKRKFPEEAAEGGGGAGLVGGRGRFVERPLPASKEDLVCTPQQYRASGSYFGLEENGRLFAPPSPETGEAKRSAFVEVKKAARAASLQEEGTADGAGVASEDQDAGGGGGSSTPAAASPVGAEKLLAPRPGGPLPSRLEGGSPARGSAFTSVPQLGSAGSTSGGGGTGAGAAGGAGGGQGAASDERKSAFSQPARSFSQLSPLVLGQKLGALEPCHPADGVGPTRLYPAAADPLAVKLQGAADLNGGCGSLPSGGGGLPKQSPFLYATAFWPKSSAAAAAAAAAAAAGPLQLQLPSALTLLPPSFTSLCLPAQNWCAKCNASFRMTSDLVYHMRSHHKKEYAMEPLVKRRREEKLKCPICNESFRERHHLSRHMTSHN

SEQ ID NO: 5456 - protein, 689 aa, Homo sapiens; identical to SEQ ID NO: 5455

SEQ ID NO: 5457 - protein, 689 aa, Homo sapiens; identical to SEQ ID NO: 5455

SEQ ID NO: 5458 - protein, 428 aa, Homo sapiens
MEDTGIQRGIWDGDAKAVQQCLTDIFTSVYTTCDIPENAIFGPCVLSHTSLYDSIAFIALKSTDKRTVPYIFRVDTSAANGSSEGLMWLRLVQSARDKEEQNLEAYIKNGQLFYRSLRRIAKDEELLVWYGKELTELLLLCPSRSHNKMNGSSPYTCLECSQRFQFEFPYVAHLRFRCPKRLHSADISPQDEQGGGVGTKDHGGGGGGGKDQQQQQQEAPLGPGPKFCKAGPLHHYPSPSPESSNPSAAAGGSSAKPSTDFHNLARELENSRGGSSCSPAQSLSSGSGSGGGGGHQEAELSPDGIATGGGKGKRKFPEEAAEGGGGAGLVGGRGRFVERPLPASKEDLVCTPQQYRASGSYFGLEENGRLFAPPSPETGEAKRSAFVEVKKAARAASLQEEGTADGAGVASEDQDAGGGGGSSTPAAA

SEQ ID NO: 5459 - protein, 374 aa, Homo sapiens
MAAPPRPAPSPPAPRRLDTSDVLQQIMAITDQSLDEAQARKHALNCHRMKPALFSVLCEIKEKTVVSIRGIQDEDPPDAQLLRLDNMLLAEGVCRPEKRGRGGAVARAGTATPGGCPNDNSIEHSDYRAKLSQIRQIYHSELEKYEQACREFTTHVTNLLQEQSRMRPVSPKEIERMVGAIHGKFSAIQMQLKQSTCEAVMTLRSRLLDARRKRRNFSKQATEVLNEYFYSHLNNPYPSEEAKEELARKGGLTISQVSNWFGNKRIRYKKNMGKFQEEATIYTGKTAVDTTEVGVPGNHASCLSTPSSGSSGPFPLPSAGDAFLTLRTLASLQPPPGGGCLQSQAQGSWQGATPQPATASPAGDPGSINSSTSN

SEQ ID NO: 5460 - protein, 125 aa, Homo sapiens
MAMQAAKRANIRLPPEVNRILYIRNLPYKITAEEMYDIFGKYGPIRQIRVGNTPETRGTAYVVYEDIFDAKNACDHLSGFNVCNRYLVVLYYNANRAFQKMDTKKKEEQLKLLKEKYGINTDPPK

SEQ ID NO: 5461 - protein, 352 aa, Homo sapiens
MSVQNSGWPHQEDSPKPQDPGPPANSDSDSGHLPGEDPEDTHAQGPAVLSLGSLCLDTNQAPNWTGLQTLLQQLPPQDIDERYCLALGEEERAELQLFCARRKQEALGQGVARLVLPKLEGHTCEKCRELLKPGEYGVFAARAGEQRCWHQPCFACQACGQALINLIYFYHDGQLYCGRHHAELLRPRCPACDQLIFSWRCTEAEGQRWHENHFCCQDCAGPLGGGRYALPGGSPCCPSCFENRYSDAGSSWAGALEGQAFLGAPPPHPPDPSLGARSSHRASLAGAFQGPPEPTPRRGRGCGARLPPRRGRRTPSGGGGGPWRGLSAAAAARTAQGLGGAGGWASPPLAAV

SEQ ID NO: 5462 - protein, 312 aa, Homo sapiens
MSPQGPAVLSLGSLCLDTNQAPNWTGLQTLLQQLPPQDIDERYCLALGEEERAELQLFCARRKQEALGQGVARLVLPKLEGHTCEKCRELLKPGEYGVFAARAGEQRCWHQPCFACQACGQALINLIYFYHDGQLYCGRHHAELLRPRCPACDQLIFSWRCTEAEGQRWHENHFCCQDCAGPLGGGRYALPGGSPCCPSCFENRYSDAGSSWAGALEGQAFLGAPPPHPPDPSLGARSSHRASLAGAFQGPPEPTPRRGRGCGARLPPRRGRRTPSGGGGGPWRGLSAAAAARTAQGLGGAGGWASPPLAAV

SEQ ID NO: 5463 - protein, 344 aa, Homo sapiens
MSPQGPAVLSLGSLCLDTNQAPNWTGLQTLLQQLPPQDIDERYCLALGEEERAELQLFCARRKQEALGQGVARLVLPKLEGHTCEKCRELLKPGEYGVFAARAGEQRCWHQPCFACQACGQALINLIYFYHDGQLYCGRHHAELLRPRCPACDQLIFSWRCTEAEGQRWHENHFCCQDCAGPLGGGRYALPGGSPCCPSCFENRYSDAGSSWAGALEGQAFLGETGLDRTEGRDQTSVNSATLSRTLLAAAGGSSLQTQRGLPGSSPQQENRPGDKAEAPKGQEQCRLETIRDPKDTPFSTCSSSSDSEPEGFFLGERLPQSWKTPGSLQAEDSNASKTHCTMC

SEQ ID NO: 5464 - protein, 384 aa, Homo sapiens
MSVQNSGWPHQEDSPKPQDPGPPANSDSDSGHLPGEDPEDTHAQGPAVLSLGSLCLDTNQAPNWTGLQTLLQQLPPQDIDERYCLALGEEERAELQLFCARRKQEALGQGVARLVLPKLEGHTCEKCRELLKPGEYGVFAARAGEQRCWHQPCFACQACGQALINLIYFYHDGQLYCGRHHAELLRPRCPACDQLIFSWRCTEAEGQRWHENHFCCQDCAGPLGGGRYALPGGSPCCPSCFENRYSDAGSSWAGALEGQAFLGETGLDRTEGRDQTSVNSATLSRTLLAAAGGSSLQTQRGLPGSSPQQENRPGDKAEAPKGQEQCRLETIRDPKDTPFSTCSSSSDSEPEGFFLGERLPQSWKTPGSLQAEDSNASKTHCTMC

SEQ ID NO: 5465 - protein, 70 aa, Homo sapiens
MSVQNSGWPHQEDSPKPQDPGPPANSDSDSGHLPGEDPEDTHAQEFLSLHLLRTWGFDFKLIHMSIHYLS

SEQ ID NO: 5466 - protein, 157 aa, Homo sapiens
MKNPDKAVPIPEKMSEWAPRPPPEFVRDVMGSSAGAGSGEFHVYRHLRRREYQRQDYMDAMAEKQKLDAEFQKRLEKNKIAAEEQTAKRRKKRTRSAQGAGVQQLCGGIWNRGGGGSAQFHHGAMTMFATASAWNLARAVTRRERRLFGSFSPARTR

SEQ ID NO: 5467 - protein, 184 aa, Homo sapiens
MASPAASSVRPPRPKKEPQTLVIPKNAAEEQKLKLERLMKNPDKAVPIPEKMSEWAPRPPPEFVRDVMGSSAGAGSGEFHVYRHLRRREYQRQDYMDAMAEKQKLDAEFQKRLEKNKIAAEEQTAKRRKKRQKLKEKKLLAKKMKLEQKKQEGPGQPKEQGSSSSAEASGTEEEEEVPSFTMGR

SEQ ID NO: 5468 - protein, 184 aa, Homo sapiens; identical to SEQ ID NO: 5467

SEQ ID NO: 5469 - protein, 1024 aa, Homo sapiens
MSNAKERKHAKKMRNQPTNVTLSSGFVADRGVKHHSGGEKPFQAQKQEPHPGTSRQRQTRVNPHSLPDPEVNEQSSSKGMFRKKGGWKAGPEGTSQEIPKYITASTFAQARAAEISAMLKAVTQKSSNSLVFQTLPRHMRRRAMSHNVKRLPRRLQEIAQKEAEKAVHQKKEHSKNKCHKARRCHMNRTLEFNRRQKKNIWLETHIWHAKRFHMVKKWGYCLGERPTVKSHRACYRAMTNRCLLQDLSYYCCLELKGKEEEILKALSGMCNIDTGLTFAAVHCLSGKRQGSLVLYRVNKYPREMLGPVTFIWKSQRTPGDPSESRQLWIWLHPTLKQDILEEIKAACQCVEPIKSAVCIADPLPTPSQEKSQTELPDEKIGKKRKRKDDGENAKPIKKIIGDGTRDPCLPYSWISPTTGIIISDLTMEMNRFRLIGPLSHSILTEAIKAASVHTVGEDTEETPHRWWIETCKKPDSVSLHCRQEAIFELLGGITSPAEIPAGTILGLTVGDPRINLPQKKSKALPNPEKCQDNEKVRQLLLEGVPVECTHSFIWNQDICKSVTENKISDQDLNRMRSELLVPGSQLILGPHESKIPILLIQQPGKVTGEDRLGWGSGWDVLLPKGWGMAFWIPFIYRGVRVGGLKESAVHSQYKRSPNVPGDFPDCPAGMLFAEEQAKNLLEKYKRRPPAKRPNYVKLGTLAPFCCPWEQLTQDWESRVQAYEEPSVASSPNGKESDLRRSEVPCAPMPKKTHQPSDEVGTSIEHPREAEEVMDAGCQESAGPERITDQEASENHVAATGSHLCVLRSRKLLKQLSAWCGPSSEDSRGGRRAPGRGQQGLTREACLSILGHFPRALVWVSLSLLSKGSPEPHTMICVPAKEDFLQLHEDWHYCGPQESKHSDPFRSKILKQKEKKKREKRQKPGRASSDGPAGEEPVAGQEALTLGLWSGPLPRVTLHCSRTLLGFVTQGDFSMAVGCGEALGFVSLTGLLDMLSSQPAAQRGLVLLRPPASLQYRFARIAIEV

SEQ ID NO: 5470 - protein, 1024 aa, Homo sapiens; identical to SEQ ID NO: 5469

SEQ ID NO: 5471 - protein, 183 aa, Homo sapiens
MSNAKERKHAKKMRNQPTNVTLSSGFVADRGVKHHSGGEKPFQAQKQEPHPGTSRQRQTRVNPHSLPDPEVNEQSSSKGMFRKKGGWKAGPEGTSQEIPKYITASTFAQARAAEISAMLKAVTQKSSNSLVFQTLPRHMRRRAMSHNVKRLPRRLQEIAQKEAEKAVHQKKEHSKNKCHKARR

SEQ ID NO: 5472 - protein, 98 aa, Homo sapiens
MWNPNAGGPPHPVPQPGYPGCQPLGPYPPPYPPPAPGIPPVNPLAPGMVGPAVIVDKKMQKKMKKAHKKMHKHQKHHKYHKHGKHSSSSSSSSSSDSD

SEQ ID NO: 5473 - protein, 148 aa, Homo sapiens
MWNPNAGQPGPNPYPPNIGCPGGSNPAHPPPINPPFPPGPCPPPPGAPHGNPAFPPGGPPHPVPQPGYPGCQPLGPYPPPYPPPAPGIPPVNPLAPGMVGPAVIVDKKMQKKMKKAHKKMHKHQKHHKYHKHGKHSSSSSSSSSSDSD

SEQ ID NO: 5474 - protein, 162 aa, Homo sapiens
MGYLDSIGWRTHLNMWNPNAGQPGPNPYPPNIGCPGGSNPAHPPPINPPFPPGPCPPPPGAPHGNPAFPPGGPPHPVPQPGYPGCQPLGPYPPPYPPPAPGIPPVNPLAPGMVGPAVIVDKKMQKKMKKAHKKMHKHQKHHKYHKHGKHSSSSSSSSSSDSD

SEQ ID NO: 5475 - protein, 148 aa, Homo sapiens; identical to SEQ ID NO: 5473

SEQ ID NO: 5476 - protein, 148 aa, Homo sapiens; identical to SEQ ID NO: 5473

SEQ ID NO: 5477 - protein, 592 aa, Homo sapiens
MDPNSILLSPQPQICSHLAEACTEGERSSSPPELDRDSPFPWSQVPSSSPTDPEWFGDEHIQAKRARVETIVRGMCLSPNPLVPGNAQAGVSPRCPKKARERKRKQNLPTPQGLLMPAPAWDQGNRKGGPRVREQLHLLKQQLRHLQEHILQAAKPRDTAQGPGGCGTGKGPLSAKQGNGCGPRPWVVDGDHQQGTSKDLSGAEKHQESEKPSFLPSGAPASLEILRKELTRAVSQAVDSVLQKVLLDPPGHLTQLGRSFQGQVAEGRSEPSPPVGGACKDPLALAALPRRVQLQAGVPVGNLSLAKRLDSPRYPIPPRMTPKPCQDPPANFPLTAPSHIQENQILSQLLGHRYNNGHWSSSPPQDSSSQRHPSSEPALRPWRTTKPQPLVLSQQQCPLPFTSAHLESLPLLPSVKMEQRGLHAVMEALPFSLVHISEGLNPGHLKKAKLMFFFTRYPSSNLLKVYFPDVQFNRCITSQMIKWFSNFREFYYIQMEKSARQAISDGVTNPKMLVVLRNSELFQALNMHYNKGNDFEVPDCFLEIASLTLQEFFRAVSAGRDSDPSWKKPIYKIISKLDSDIPEIFKSSSYPQ

SEQ ID NO: 5478 - protein, 592 aa, Homo sapiens
MDPNSILLSPQPQICSHLAEACTEGERSSSPPELDRDSPFPWSQVPSSSPTDPEWFGDEHIQAKRARVETIVRGMCLSPNPLVPGNAQAGVSPRCPKKARERKRKQNLPTPQGLLMPAPAWDQGNRKGGPRVREQLHLLKQQLRHLQEHILQAAKPRDTAQGPGGCGTGKGPLSAKQGNGCGPRPWVVDGDHQQGTSKDLSGAEKHQESEKPSFLPSGAPASLEILRKELTRAVSQAVDSVLQKVLLDPPGHLTQLGRSFQGQVAEGRSEPSPPVGGACKDPLALAALPRRVQLQAGVPVGNLSLAKRLDSPRYPIPPRMTPKPCQDPPANFPLTAPSHIQENQILSQLLGHRYNNGHWSSSPPQDSSSQRHPSSEPALRPWRTTKPQPLVLSQQQCPLPFTSAHLESLPLLPSVKMEQRGLHAVMEALPFSLLHIQEGLNPGHLKKAKLMFFFTRYPSSNLLKVYFPDVQFNRCITSQMIKWFSNFREFYYIQMEKSARQAISDGVTNPKMLVVLRNSELFQALNMHYNKGNDFEVPDCFLEIASLTLQEFFRAVSAGRDSDPSWKKPIYKIISKLDSDIPEIFKSSSYPQ

SEQ ID NO: 5479 - protein, 592 aa, Homo sapiens
MDPNSILLSPQPQICSHLAEACTEGERSSSPPELDRDSPFPWSQVPSSSPTDPEWFGDEHIQAKRARVETIVRGMCLSPNPLVPGNAQAGVSPRCPKKARERKRKQNLPTPQGLLMPAPAWDQGNRKGGPRVREQLHLLKQQLRHLQEHILQAAKPRDTAQGPGGCGTGKGPLSAKQGNGCGPRPWVVDGDHQQGTSKDLSGAEKHQESEKPSFLPSGAPASLEILRKELTRAVSQAVDSVLQKVLLDPPGHLTQLGRSFQGQVAEGRSEPSPPVGGACKDPLALAALPRRVQLQAGVPVGNLSLAKRLDSPRYPIPPRMTPKPCQDPPANFPLTAPSHIQENQILSQLLGHRYNNGHWSSSPPQDSSSQRHPSSEPALRPWRTTKPQPLVLSQQQCPLPFTSAHLESLPLLPSVKMEQRGLHAVMEALPFSLVHIQEGLNPGHLKKAKLMFFFTRYPSSNLLKVYFPDVQFNRCITSQMIKWFSNFREFYYIQMEKSARQAISDGVTNPKMLVVLRNSELFQALNMHYNKGNDFEVPDCFLEIASLTLQEFFRAVSAGRDSDPSWKKPIYKIISKLDSDIPEIFKSSSYPQ

SEQ ID NO: 5480 - protein, 57 aa, Homo sapiens
MLCAHFSDQGPAHLTTSKSAFLSNKKTSTLKHLLGETRSDGSACNSGISGGRGRKIP

SEQ ID NO: 5481 - protein, 1812 aa, Homo sapiens
MAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQSTSEDKEKQYTSQTTRLLALLDALASHKACKLAILHLINGTIKGDERYAEIFQDLLALVRSPGDSVIRQQCVEYVTSILQSLCDQDIALILPSSSEGSISELEQLSNSLPNKELMTSICDCLLATLANSESSYNCLLTCVRTMMFLAEHDYGLFHLKSSLRKNSSALHSLLKRVVSTFSKDTGELASSFLEFMRQILNSDTIGCCGDDNGLMEVEGAHTSRTMSINAAELKQLLQSKEESPENLFLELEKLVLEHSKDDDNLDSLLDSVVGLKQMLESSGDPLPLSDQDVEPVLSAPESLQNLFNNRTAYVLADVMDDQLKSMWFTPFQAEEIDTDLDLVKVDLIELSEKCCSDFDLHSELERSFLSEPSSPGRTKTTKGFKLGKHKHETFITSSGKSEYIEPAKRAHVVPPPRGRGRGGFGQGIRPHDIFRQRKQNTSRPPSMHVDDFVAAESKEVVPQDGIPPPKRPLKVSQKISSRGGFSGNRGGRGAFHSQNRFFTPPASKGNYSRREGTRGSSWSAQNTPRGNYNESRGGQSNFNRGPLPPLRPLSSTGYRPSPRDRASRGRGGLGPSWASANSGSGGSRGKFVSGGSGRGRHVRSFTR

SEQ ID NO: 5482 - protein, 345 aa, Homo sapiens
MKQLKRKRKSNFSVQETQTLLKEITKRKEVIFSKQLNTTINVMKRMAWEEIAQCVNAVGEGEQRTGTEVKRRYLDWRALMKRKRMKANIKLVGSGFPLPSSDLDDSLTEEIDEKIGFRNDANFDWQNVADFRDAGGSLTEVKVEEEERDPQSPEFEIEEEEEMLSSVIPDSRRENELPDFPHIDEFFTLNSTPSRSAYDEPHLLVNIEKQKLELEKRRLDIEAERLQVEKERLQIEKERLRHLDMEHERLQLEKERLQIEREKLRLQIVNSEKPSLENELGQGEKSMLQPQDIETEKLKLERERLQLEKDRLQFLKFESEKLQIEKERLQVEKDRLRIQKEGHLQ

SEQ ID NO: 5483 - protein, 2245 aa, Homo sapiens
MPEMTENETPTKKQHRKKNRETHNAVERHRKKKINAGINRIGELIPCSPALKQSKNMILDQAFKYITELKRQNDELLLNGGNNEQAEEIKKLRKQLEEIQKENGRYIELLKANDICLYDDPTIHWKGNLKNSKVSVVIPSDQVQKKIIVYSNGNQPGGNSQGTAVQGITFNVSHNLQKQTANVVPVQRTCNLVTPVSISGVYPSENKPWHQTTVPALATNQPVPLCLPAAISAQSILELPTSESESNVLGATSGSLIAVSIESEPHQHHSLHTCLNDQNSSENKNGQENPKVLKKMTPCVTNIPHSSSATATKVHHGNKSCLSIQDFRGDFQNTFVVSVTTTVCSQPPRTAGDSSPMSISKSADLTSTATVVASSAPGVGKATIPISTLSGNPLDNGWTLSCSLPSSSVSTSDLKNINSLTRISSAGNTQTTWTTLQLAGNTIQPLSQTPSSAVTPVLNESGTSPTTSNHSRYVATDINLNNSFPADGQPVEQVVVTLPSCPSLPMQPLIAQPQVKSQPPKNILPLNSAMQVIQMAQPVGSAVNSAPTNQNVIILQPPSTTPCPTVMRAEVSNQTVGQQIVIIQAANQNPLPLLPAPPPGSVRLPINGANTVIGSNNSVQNVPTPQTFGGKHLVHILPRPSSLSASNSTQTFSVTMSNQQPQTISLNGQLFALQPVMSSSGTTNQTPMQIIQPTTSEDPNTNVALNTFGALASLNQSISQMAGQSCVQLSISQPANSQTAANSQTTTANCVSLTTTAAPPVTTDSSATLASTYNLVSTSSMNTVACLPNMKSKRLNKKPGGRKHLAANKSACPLNSVRDVSKLDCPNTEGSAEPPCNDGLLESFPAVLPSVSVSQANSVSVSASHSLGVLSSESLIPESVSKSKSAEKSSPPSQESVTSEHFAMAAAKSKDSTPNLQQETSQDKPPSSLALSDAAKPCASANVLIPSPSDPHILVSQVPGLSSTTSTTSTDCVSEVEIIAEPCRVEQDSSDTMQTTGLLKGQGLTTLLSDLAKKKNPQKSSLSDQMDHPDFSSENPKIVDSSVNLHPKQELLLMNNDDRDPPQHHSCLPDQEVINGSLINGRQADSPMSTSSGSSRSFSVASMLPETTREDVTSNATTNTCDSCTFVEQTDIVALAARAIFDQENLEKGRVGLQADIREVASKPSEASLLEGDPPFKSQIPKESGTGQAEATPNEFNSQGSIEATMERPLEKPSCSLGIKTSNASLQDSTSQPPSITSLSVNNLIHQSSISHPLASCAGLSPTSEQTTVPATVNLTVSSSSYGSQPPGPSLMTEYSQEQLNTMTSTIPNSQIQEPLLKPSHESRKDSAKRAVQDDLLLSSAKRQKHCQPAPLRLESMSLMSRTPDTISDQTQMMVSQIPPNSSNSVVPVSNPAHGDGLTRLFPPSNNFVTPALRQTEVQCGSQPSVAEQQQTQASQHLQALQQHVPAQGVSHLHSNHLYIKQQQQQQQQQQQQQQQQQAGQLRERHHLYQMQHHVPHAESSVHSQPHNVHQQRTLQQEVQMQKKRNLVQGTQTSQLSLQPKHHGTDQSRSKTGQPHPHHQQMQQQMQQHFGSSQTEKSCENPSTSRNHHNHPQNHLNQDIMHQQQDVGSRQQGSGVSSEHVSGHNPMQRLLTSRGLEQQMVSQPSIVTRSSDMTCTPHRPERNRVSSYSAEALIGKTSSNSEQRMGISIQGSRVSDQLEMRSYLDVPRNKSLAIHNMQGRVDHTVASDIRLSDCQTFKPSGASQQPQSNFEVQSSRNNEIGNPVSSLRSMQSQAFRISQNTGPPPIDRQKRLSYPPVQSIPTGNGIPSRDSENTCHQSFMQSLLAPHLSDQVIGSQRSLSEHQRNTQCGPSSAIEYNCPPTHENVHIRRESESQNRESCDMSLGAINTRNSTLNIPFSSSSSSGDIQGRNTSPNVSVQKSNPMRITESHATKGHMNPPVTTNMHGVARPALPHPSVSHGNGDQGPAVRQANSSVPQRSRHPLQDSSGSKIRQPERNRSGNQRQSTVFDPSLPHLPLSTGGSMILGRQQPATEKRGSIVRFMPDSPQVPNDNSGPDQHTLSQNFGFSFIPEGGMNPPINANASFIPQVTQPSATRTPALIPVDPQNTLPSFYPPYSPAHPTLSNDISIPYFPNQMFSNPSTEKVNSGSLNNRFGSILSPPRPVGFAQPSFPLLPDMPPMHMTNSHLSNFNMTSLFPEIATVLPDGSAMSPLLTIANSSASDSSKQSSNRPAHNISHILGHDCSSAV

SEQ ID NO: 5484 - protein, 1147 aa, Homo sapiens
MAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVSLPYNMHLINDCSNTF

SEQ ID NO: 5485 - protein, 1377 aa, Homo sapiens
MAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQSTSEDKEKQYTSQTTRLLALLDALASHKACKLAILHLINGTIKGDERYAEIFQDLLALVRSPGDSVIRQQCVEYVTSILQSLCDQDIALILPSSSEGSISELEQLSNSLPNKELMTSICDCLLATLANSESSYNCLLTCVRTMMFLAEHDYGLFHLKRDAVEMIMVSWK

SEQ ID NO: 5486 - protein, 95 aa, Homo sapiens [sequence omitted]

SEQ ID NO: 5487 - protein, 2245 aa, Homo sapiens; identical to SEQ ID NO: 5483

SEQ ID NO: 5488 - protein, 71 aa, Homo sapiens
MKQLKRKRKSNFSVQETQTLLKEITKRKEVIFSKQLNTTINVMKRMAWEEIAQCVNAVGEGEQRTGTEVKR

SEQ ID NO: 5489 - protein, 196 aa, Homo sapiens
MKQLKRKRKSNFSVQETQTLLKEITKRKEVIFSKQLNTTINVMKRMAWEEIAQCVNAVGEGEQRTGTEVKRRYLDWRALMKRKRMKANIKLVGSGFPLPSSDLDDSLTEEIDEKIGFRNDANFDWQNVADFRDAGGSLTEVKVEEEERDPQSPEFEIEEEEEMLSSVIPDSRRENELPDFPHIDEFFTLNSTPSRS

SEQ ID NO: 5490 - protein, 111 aa, Homo sapiens
MKQLKRKRKSNFSVQETQTLLKEITKRKEVIFSKQLNTTINVMKRMAWEEIAQCVNAVGEGEQRTGTEVKRRYLDWRALMKRKRMKANIKLVGSGFPLPSSDLDDSLTEEI

SEQ ID NO: 5491 - protein, 385 aa, Homo sapiens
MQACGGGAAGRRAFDSICPNRMLALPGRALLCKPGKPERKFAPPRKFFPGCTGGSPVSVYEDPPDAEPTALPALTTIDLQDLADCSSLLGSDAPPGGDLAASQNHSHQTEADFNLQDFRDTVDDLISDSSSMMSPTLASGDFPFSPCDISPFGPCLSPPLDPRALQSPPLRPPDVPPPEQYWKEVADQNQRALGDALVENNQLHVTLTQKQEEIASLKERNVQLKELASRTRHLASVLDKLMITQSRDCGAAAEPFLLKAKAKRSLEELVSAAGQDCAEVDAILREISERCDEALQSRDPKRPRLLPEPANTDTRPGNLHGAFRGLRTDCSRSALNLSHSELEEGGSFSTRIRSHSTIRTLAFPQGNAFTIRTANGGYKFRWVPS

SEQ ID NO: 5492 - protein, 621 aa, Homo sapiens
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGLDFLSLIPVDPQYCPPMFLDSLTSPLTASSTSVTTTSSHESSTHVSSSSSRSETGVITSSGSNIPDIISLD

SEQ ID NO: 5493 - protein, 621 aa, Homo sapiens
MANFEEIINMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGLDFLSLIPVDPQYCPPMFLDSLTSPLTASSTSVTTTSSHESSTHVSSSSSRSETGVITSSGSNIPDIISLD

SEQ ID NO: 5494 - protein, 572 aa, Homo sapiens
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGEQRRNDINNELKLGTSSDTVQQ

SEQ ID NO: 5495 - protein, 396 aa, Homo sapiens
RNLNNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILD

SEQ ID NO: 5496 - protein, 621 aa, Homo sapiens; identical to SEQ ID NO: 5492

SEQ ID NO: 5497 - protein, 282 aa, Homo sapiens
MSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGEQRRNDINNELKLGTSSDTVQQ

SEQ ID NO: 5498 - protein, 340 aa, Homo sapiens
METVISSDSSPAVENEHPQETPESNNSVYTSFMKSHRCYDLIPTSSKLVVFDTSLQVKKAFFALVTNGVRAAPLWDSKKQSFVVLRALSCPLGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 5499 - protein, 299 aa, Homo sapiens
MKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 5500 - protein, 940 aa, Homo sapiens
MGSGPIDPKELLKGLDSFLNRDGEVKSVDGISKIFSLMKEARKMVSRCTYLNILLQTRSPEILVKFIDVGGYKLLNNWLTYSKTTNNIPLLQQILLTLQHLPLTVDHLKQNNTAKLVKQLSKSSEDEELRKLASVLVSDWMAVIRSQSSTQPAEKDKKKRKDEGKSRTTLPERPLTEVKAETRAEEAPEKKREKPKSLRTTAPSHAKFRSTGLELETPSLVPVKKNASTVVVSDKYNLKPIPLKRQSNVAAPGDATPPAEKKYKPLNTTPNATKEIKVKIIPPQPMEGLGFLDALNSAPVPGIKIKKKKKVLSPTAAKPSPFEGKTSTEPSTAKPSSPEPAPPSEAMDADRPGTPVPPVEVPELMDTASLEPGALDAKPVESPGDPNQLTRKGRKRKSVTWPEEGKLREYFYFELDETERVNVNKIKDFGEAAKREILSDRHAFETARRLSHDNMEEKVPWVCPRPLVLPSPLVTPGSNSQERYIQAEREKGILQELFLNKESPHEPDPEPYEPIPPKLIPLDEECSMDETPYVETLEPGGSGGSPDGAGGSKLPPVLANLMGSMGAGKGPQGPGGGGINVQEILTSIMGSPNSHPSEELLKQPDYSDKIKQMLVPHGLLGPGPIANGFPPGGPGGPKGMQHFPPGPGGPMPGPHGGPGGPVGPRLLGPPPPPRGGDPFWDGPGDPMRGGPMRGGPGPGPGPYHRGRGGRGGNEPPPPPPPFRGARGGRSGGGPPNGRGGPGGGMVGGGGHRPHEGPGGGMGNSSGHRPHEGPGGGMGSGHRPHEGPGGSMGGGGGHRPHEGPGGGISGGSGHRPHEGPGGGMGAGGGHRPHEGPGGSMGGSGGHRPHEGPGHGGPHGHRPHDVPGHRGHDHRGPPPHEHRGHDGPGHGGGGHRGHDGGHSHGGDMSNRPVCRHFMMKGNCRYENNCAFYHPGVNGPPLP

SEQ ID NO: 5501 - protein, 940 aa, Homo sapiens; identical to SEQ ID NO: 5500

SEQ ID NO: 5502 - protein, 940 aa, Homo sapiens; identical to SEQ ID NO: 5500

SEQ ID NO: 5503 - protein, 940 aa, Homo sapiens; identical to SEQ ID NO: 5500

SEQ ID NO: 5504 - protein, 940 aa, Homo sapiens; identical to SEQ ID NO: 5500

SEQ ID NO: 5505 - protein, 940 aa, Homo sapiens; identical to SEQ ID NO: 5500

SEQ ID NO: 5506 - protein, 940 aa, Homo sapiens; identical to SEQ ID NO: 5500

SEQ ID NO: 5507 - protein, 312 aa, Homo sapiens
MGSGPIDPKELLKGLDSFLNRDGEVKSVDGISKIFSLMKEARKMVSRCTYLNILLQTRSPEILVKFIDVGGYKLLNNWLTYSKTTNNIPLLQQILLTLQHLPLTVDHLKQNNTAKLVKQLSKSSEDEELRKLASVLVSDWMAVIRSQSSTQPAEKDKKKRKDEGKSRTTLPERPLTEVKAETRAEEAPEKKREKPKSLRTTAPSHAKFRSTGLELETPSLVPVKKNASTVVVSDKYNLKPIPLKRQSNVAAPGDATPPAEKKYKPLNTTPNATKEIKVKIIPPQPMEGLGFLDALNSAPVPGIKIKKKKKKK

SEQ ID NO: 5508 - protein, 312 aa, Homo sapiens; identical to SEQ ID NO: 5507

SEQ ID NO: 5509 - protein, 312 aa, Homo sapiens; identical to SEQ ID NO: 5507

SEQ ID NO: 5510 - protein, 312 aa, Homo sapiens; identical to SEQ ID NO: 5507

SEQ ID NO: 5511 - protein, 312 aa, Homo sapiens; identical to SEQ ID NO: 5507

SEQ ID NO: 5512 - protein, 312 aa, Homo sapiens; identical to SEQ ID NO: 5507

SEQ ID NO: 5513 - protein, 312 aa, Homo sapiens; identical to SEQ ID NO: 5507

SEQ ID NO: 5514 - protein, 1209 aa, Homo sapiens
MFLMNASPVVALQSKWEAFGPPGSCRFPRCFSEADEGVESASVSARVQMLISTLQRDGAARGTSDERAAQRGHRAEGCHDARPAAKPTVHKEPPALAVCGLVADFDPMGEEETTDFGPLVLDSDSDDSVDRDIEEAIQEYLKAKSGAAQPGAGGAQPGAAQPSRAAGGGSRCKPEPAHGSAPTALCPPKLVPGSGGGPGSQVGSSKDQGSASPVSVSSDDSFEQSIRAEIEQFLNEKRQHETQKCDGSVEKKPDTNENSAKSLLKSHQEPPTKVVHRQGLLGVQKEFAFRKPPRLAKMNVQPRSLRSKVTTTQENEGSTKPATPCRPSEAAQNKGGIKRSASAARRGKRVMSAAQASEASDSSSDDGIEEAIQLYQLQKTRKEADGDLPQRVQLREERAPDPPAHSTSSATKSALPETHRKTPSKKKLVATKTMDPGPGGLDTDHAPKLLKETKAPPPASPASRSEFVERSSCRADTSAELMCAEAILDISKTILPAPVEGSDGSLSASPLFYSPNVPSRSDGDSSSVDSDDSIEQEIRTFLALKAQSGSLLARGESCPQAAQGPLLPPGLNSQTGGHKTPLSKTPDPLLGCKRKRRGGGHVRPSTPKKMQEVVKDGSQDADHSQGRAEPGHERRDLPIQGKASEALGGEGTARGPGDTRMSQGQGKTDEARRLDEKESSEDKSSSLDSDEDLDTAIKDLLRSKRKLKKRCREPRAACRKKVRFSTAQTHFLEQLGGLRRDWKDRGPPVLKSCLSKSKRDSGEGPGKKPPSVFGSTAERMRQEGAASQDAALAFRVRRPASASASEGNPFPRESQGPAPSPGSLSDDSSSVDSNDSIELEIRKFLAEKAKESVSSSEVQAEGPTALGTGGPARPEVLCRKEPAPPPGVCTRSQRARGVPHLAEGLRGTESAGAQGTAGLFSQGGKGLPAAPARGDPVPPRSTSGGVSAKGLSVSRRNVYVHKDQSPRGAEPAAKSAFGQLPSCATAGTEAGGARGTFHMGCGSPSFLTPSPGAERDAGAQADRTPPWSDFAHQSRLPSPWVLRSEGRDAVWRGGVGSERDKGSEGPARGLPSLPLAGFSPLLSTQLFHFGKGVSWGGRQAGLFSPHLGLPLQGPSFSAFREAQAGPSPVFGSPHLLAKKDGGPWPTRKAQAGLSLHDRRSSGSEESILDLRYRRRVNRDDQEQDALGSDASDFSDTSTEDSGGSSVVKV

SEQ ID NO: 5515 - protein, 108 aa, Homo sapiens
MFLMNASPVVALQSKWEAFGPPGSCRFPRCFSEADEGVESASVSARVQMLISTLQRDGAARGTSDERAAQRGHRAEGCHDARPAAKPTVHKEPPALAVCGLVADFDPM

SEQ ID NO: 5516 - protein, 575 aa, Homo sapiens
MPPGKVLQPVLKMKVDELFLYWLSEASTQRMLQDCLRRIKAPGRDQPTPGDGEQPGAWPTAPLAAPRPSGLEPPGTPGPGPALPLGAASSPRNAPHVRGTRRSAGTRVVQTRKEEPLPPATSQSIPTFYFPRGRPQDSVNVDAVISKIESTFARFPHERATMDDMGLVAKACGCPLYWKGPLFYGAGGERTGSVSVHKFVAMWRKILQNCHDDAAKFVHLLMSPGCNYLVQEDFVPFLQDVVNTHPGLSFLKEASEFHSRYITTVIQRIFYAVNRSWSGRITCAELRRSSFLQNVALLEEEADINQLTEFFSYEHFYVIYCKFWELDTDHDLLIDADDLARHNDHALSTKMIDRIFSGAVTRGRKVQKEGKISYADFVWFLISEEDKKTPTSIEYWFRCMDLDGDGALSMFELEYFYEEQCRRLDSMAIEALPFQDCLCQMLDLVKPRTEGKITLQDLKRCKLANVFFDTFFNIEKYLDHEQKEQISLLRDGDSGGPELSDWEKYAAEEYDILVAEETAGEPWEDGFEAELSPVEQKLSALRSPLAQRPFFEAPSPLGAVDLYEYACGDEDLEPL

SEQ ID NO: 5517 - protein, 761 aa, Homo sapiens
MPNFCAAPNCTRKSTQSDLAFFRFPRDPARCQKWVENCRRADLEDKTPDQLNKHYRLCAKHFETSMICRTSPYRTVLRDNAIPTIFDLTSHLNNPHSRHRKRIKELSEDEIRTLKQKKIDETSEQEQKHKETNNSNAQNPSEEEGEGQDEDILPLTLEEKENKEYLKSLFEILILMGKQNIPLDGHEADEIPEGLFTPDNFQALLECRINSGEEVLRKRFETTAVNTLFCSKTQQRQMLEICESCIREETLREVRDSHFFSIITDDVVDIAGEEHLPVLVRFVDESHNLREEFIGFLPYEADAEILAVKFHTMITEKWGLNMEYCRGQAYIVSSGFSSKMKVVASRLLEKYPQAIYTLCSSCALNMWLAKSVPVMGVSVALGTIEEVCSFFHRSPQLLLELDNVISVLFQNSKERGKELKEICHSQWTGRHDAFEILVELLQALVLCLDGINSDTNIRWNNYIAGRAFVLCSAVSDFDFIVTIVVLKNVLSFTRAFGKNLQGQTSDVFFAAGSLTAVLHSLNEVMENIEVYHEFWFEEATNLATKLDIQMKLPGKFRRAHQGNLESQLTSESYYKETLSVPTVEHIIQELKDIFSEQHLKALKCLSLVPSVMGQLKFNTSEEHHADMYRSDLPNPDTLSAELHCWRIKWKHRGKDIELPSTIYEALHLPDIKFFPNVYALLKVLCILPVMKVENERYENGRKRLKAYLRNTLTDQRSSNLALLNINFDIKHDLDLMVDTYIKLYTSKSELPTDNSETVENT

SEQ ID NO: 5518 - protein, 586 aa, Homo sapiens
MGKQNIPLDGHEADEIPEGLFTPDNFQALLECRINSGEEVLRKRFETTAVNTLFCSKTQQRQMLEICESCIREETLREVRDSHFFSIITDDVVDIAGEEHLPVLVRFVDESHNLREEFIGFLPYEADAEILAVKFHTMITEKWGLNMEYCRGQAYIVSSGFSSKMKVVASRLLEKYPQAIYTLCSSCALNMWLAKSVPVMGVSVALGTIEEVCSFFHRSPQLLLELDNVISVLFQNSKERGKELKEICHSQWTGRHDAFEILVELLQALVLCLDGINSDTNIRWNNYIAGRAFVLCSAVSDFDFIVTIVVLKNVLSFTRAFGKNLQGQTSDVFFAAGSLTAVLHSLNEVMENIEVYHEFWFEEATNLATKLDIQMKLPGKFRRAHQGNLESQLTSESYYKETLSVPTVEHIIQELKDIFSEQHLKALKCLSLVPSVMGQLKFNTSEEHHADMYRSDLPNPDTLSAELHCWRIKWKHRGKDIELPSTIYEALHLPDIKFFPNVYALLKVLCILPVMKVENERYENGRKRLKAYLRNTLTDQRSSNLALLNINFDIKHDLDLMVDTYIKLYTSKSELPTDNSETVENT

SEQ ID NO: 5519 - protein, 312 aa, Homo sapiens
MANRTVKDAHSIHGTNPQYLVEKIIRTRIYESKYWKEECFGLTAELVVDKAMELRFVGGVYGGNIKPTPFLCLTLKMLQIQPEKDIIVEFIKNEDFKYVRMLGALYMRLTGTAIDCYKYLEPLYNDYRKIKSQNRNGEFELMHVDEFIDELLHSERVCDIILPRLQKRYVLEEAEQLEPRVSALEEDMDDVESSEEEEEEDEKLERVPSPDHRRRSYRDLDKPRRSPTLRYRRSRSRSPRRRSRSPKRRSPSPRRERHRSKSPRRHRSRSRDRRHRSRSKSPGHHRSHRHRSHSKSPERSKKSHKKSRRGNE

SEQ ID NO: 5520 - protein, 435 aa, Homo sapiens
MCGGVRGVGTGGIVSTAFCLLYKLFTLKLTRKQVMGLITHTDSPYIRALGFMYIRYTQPPTDLWDWFESFLDDEEDLDVKAGGGCVMTIGEMLRSFLTKLEWFSTLFPRIPVPVQKNIDQQIKTRPRKIKKDGKEGAEEIDRHVERRRSRSPRRSLSPRRSPRRSRSRSHHREGHGSSSFDRELEREKERQRLEREAKEREKERRRSRSIDRGLERRRSRSRERHRSRSRSRDRKGDRRDRDREREKENERGRRRDRDYDKERGNEREKERERSRERSKEQRSRGEVEEKKHKEDKDDRRHRDDKRDSKKEKKHSRSRSRERKHRSRSRSRNAGKRSRSRSKEKSSKHKNESKEKSNKRSRSGSQGRTDSVEKSKKREHSPSKEKSRKRSRSKERSHKRDHSDSKDQSDKHDRRRSQSIEQESQEKQHKNKDETV

SEQ ID NO: 5521 - protein, 190 aa, Homo sapiens
MANNSPALTGNSQPQHQAAAAAAQQQQQCGGGGATKPAVSGKQGNVLPLWGNEKTMNLNPMILTNILSSPYFKVQLYELKTYHEVVDEIYFKVTHVEPWEKGSRKTAGQTGMCGGVRGVGTGGIVSTAFCLLYKLFTLKLTRKQVMGLITHTDSPYIRALGFMYIRYTQPPTDLWDWFESFLDDEEFFTL

SEQ ID NO: 5522 - protein, 546 aa, Homo sapiens
MANNSPALTGNSQPQHQAAAAAAQQQQQCGGGGATKPAVSGKQGNVLPLWGNEKTMNLNPMILTNILSSPYFKVQLYELKTYHEVVDEIYFKVTHVEPWEKGSRKTAGQTGMCGGVRGVGTGGIVSTAFCLLYKLFTLKLTRKQVMGLITHTDSPYIRALGFMYIRYTQPPTDLWDWFESFLDDEEDLDVKAGGGCVMTIGEMLRSFLTKLEWFSTLFPRIPVPVQKNIDQQIKTRPRKIKKDGKEGAEEIDRHVERRRSRSPRRSLSPRRSPRRSRSRSHHREGHGSSSFDRELEREKERQRLEREAKEREKERRRSRSIDRGLERRRSRSRERHRSRSRSRDRKGDRRDRDREREKENERGRRRDRDYDKERGNEREKERERSRERSKEQRSRGEVEEKKHKEDKDDRRHRDDKRDSKKEKKHSRSRSRERKHRSRSRSRNAGKRSRSRSKEKSSKHKNESKEKSNKRSRSGSQGRTDSVEKSKKREHSPSKEKSRKRSRSKERSHKRDHSDSKDQSDKHDRRRSQSIEQESQEKQHKNKDETV

SEQ ID NO: 5523 - protein, 669 aa, Homo sapiens
MQNSHMDEYRNSSNGSTGNSSEVVVEHPTDFSTEIMNVTEMEQSPDDSPNVNASTEETEMASAVDLPVTLTETEANFPPEYEKFWKTVENNPQDFTGWVYLLQYVEQENHLMAARKAFDRFFIHYPYCYGYWKKYADLEKRHDNIKPSDEVYRRGLQAIPLSVDLWIHYINFLKETLDPGDPETNNTIRGTFEHAVLAAGTDFRSDRLWEMYINWENEQGNLREVTAIYDRILGIPTQLYSHHFQRFKEHVQNNLPRDLLTGEQFIQLRRELASVNGHSGDDGPPGDDLPSGIEDITDPAKLITEIENMRHRIIEIHQEMFNYNEHEVSKRWTFEEGIKRPYFHVKPLEKAQLKNWKEYLEFEIENGTHERVVVLFERCVISCALYEEFWIKYAKYMENHSIEGVRHVFSRACTIHLPKKPMVHMLWAAFEEQQGNINEARNILKTFEECVLGLAMVRLRRVSLERRHGNLEEAEHLLQDAIKNAKSNNESSFYAVKLARHLFKIQKNLPKSRKVLLEAIERDKENTKLYLNLLEMEYSGDLKQNEENILNCFDKAVHGSLPIKMRITFSQRKVEFLEDFGSDVNKLLNAYDEHQTLLKEQDSLKRKAENGSEEPEEKKAHTEDTTSSSTQMIDGDLQANQAVYNYSAWYQYNYQNPWNYGQYYPPPPT

SEQ ID NO: 5524 - protein, 240 aa, Homo sapiens
MQGLLRFEDQDSARGDQNIAMFYPTSTQMVYRRGLQAIPLSVDLWIHYINFLKETLDPGDPETNNTIRGTFEHAVLAAGTDFRSDRLWEMYINWENEQGNLREVTAIYDRILGIPTQLYSHHFQRFKEHVQNNLPRDLLTGEQFIQLRRELASVNGHSGDDGPPGDDLPSGIEDITDPAKLITEIENMRHRIIEIHQEMFNYNEHEVSKRWTFEEGIKRPYFHVKPLEKAQKKLERILRI

SEQ ID NO: 5525 - protein, 858 aa, Homo sapiens
MPPPGIPPPFPPMGLPPMSQRPPAIPPMPPGILPPMLPPMGAPPPLTQIPGMVPPMMPGMLMPAVPVTAATAPGADTASSAVAGTGPPRALWSEHVAPDGRIYYYNADDKQSVWEKPSVLKSKAELLLSQCPWKEYKSDTGKPYYYNNQSKESRWTRPKDLDDLEVLVKQEAAGKQQQQLPQTLQPQPPQPQPDPPPVPPGPTPVPTGLLEPEPGGSEDCDVLEATQPLEQGFLQQLEEGPSSSGQHQPQQEEEESKPEPERSGLSWSNREKAKQAFKELLRDKAVPSNASWEQAMKMVVTDPRYSALPKLSEKKQAFNAYKAQREKEEKEEARLRAKEAKQTLQHFLEQHERMTSTTRYRRAEQTFGELEVWAVVPERDRKEVYDDVLFFLAKKEKEQAKQLRRRNIQALKSILDGMSSVNFQTTWSQAQQYLMDNPSFAQDHQLQNMDKEDALICFEEHIRALEREEEEERERARLRERRQQRKNREAFQTFLDELHETGQLHSMSTWMELYPAVSTDVRFANMLGQPGSTPLDLFKFYVEELKARFHDEKKIIKDILKVNTAFEDFAHVISFDKRAAALDAGNIKLTFNSLLEKAEAREREREKEEARRMRRREAAFRSMLRQAVPALELGTAWEEVRERFVCDSAFEQITLESERIRLFREFLQVLEQTECQHLHTKGRKHGRKGKKHHHKRSHSPSGSESEEEELPPPSLRPPKRRRRNPSESGSEPSSSLDSVESGGAALGGRGSPSSHLLGADHGLRKAKKPKKKTKKRRHKSNSPESETDPEEKAGKESDEKEQEQDKDRELQQAELPNRSPGFGIKKEKTGWDTSESELSEGELERRRRTLLQQLDDHQ

SEQ ID NO: 5526 - protein, 871 aa, Homo sapiens
MMPPPFMPPPGIPPPFPPMGLPPMSQRPPAIPPMPPGILPPMLPPMGAPPPLTQIPGMVPPMMPGMLMPAVPVTAATAPGADTASSAVAGTGPPRALWSEHVAPDGRIYYYNADDKQSVWEKPSVLKSKAELLLSQCPWKEYKSDTGKPYYYNNQSKESRWTRPKDLDDLEVLVKQEAAGKQQQQLPQTLQPQPPQPQPDPPPVPPGPTPVPTGLLEPEPGGSEDCDVLEATQPLEQGFLQQLEEGPSSSGQHQPQQEEEESKPEPERSGLSWSNREKAKQAFKELLRDKAVPSNASWEQAMKMVVTDPRYSALPKLSEKKQAFNAYKAQREKEEKEEARLRAKEAKQTLQHFLEQHERMTSTTRYRRAEQTFGELEVWAVVPERDRKEVYDDVLFFLAKKEKEQAKQLRRRNIQALKSILDGMSSVNFQTTWSQAQQYLMDNPSFAQDHQLQNMDKEDALICFEEHIRALEREEEEERERARLRERRQQRKNREAFQTFLDELHETGQLHSMSTWMELYPAVSTDVRFANMLGQPGSTPLDLFKFYVEELKARFHDEKKIIKDILKDRGFCVEVNTAFEDFAHVISFDKRAAALDAGNIKLTFNSLLEKAEAREREREKEEARRMRRREAAFRSMLRQAVPALELGTAWEEVRERFVCDSAFEQITLESERIRLFREFLQVLEQTECQHLHTKGRKHGRKGKKHHHKRSHSPSGSESEEEELPPPSLRPPKRRRRNPSESGSEPSSSLDSVESGGAALGGRGSPSSHLLGADHGLRKAKKPKKKTKKRRHKSNSPESETDPEEKAGKESDEKEQEQDKDRELQQAELPNRSPGFGIKKEKTGWDTSESELSEGELERRRRTLLQQLDDHQ

SEQ ID NO: 5527 - protein, 6 aa, Homo sapiens
MMPPPF

SEQ ID NO: 5528 - protein, 481 aa, Homo sapiens
MAYNDTDRNQTEKLLKRVRELEQEVQRLKKEQAKNKEDSNIRENSAGAGKTKRAFDFSAHGRRHVALRIAYMGWGYQGFASQENTNNTIEEKLFEALTKTRLVESRQTSNYHRCGRTDKGVSAFGQVISLDLRSQFPRGRDSEDFNVKEEANAAAEEIRYTHILNRVLPPDIRILAWAPVEPSFSARFSCLERTYRYFFPRADLDIVTMDYAAQKYVGTHDFRNLCKMDVANGVINFQRTILSAQVQLVGQSPGEGRWQEPFQLCQFEVTGQAFLYHQVRCMMAILFLIGQGMEKPEIIDELLNIEKNPQKPQYSMAVEFPLVLYDCKFENVKWIYDQEAQEFNITHLQQLWANHAVKTHMLYSMLQGLDTVPVPCGIGPKMDGMTEWGNVKPSVIKQTSAFVEGVKMRTYKPLMDRPKCQGLESRIQHFVRRGRIEHPHLFHEEETKAKRDCNDTLEEENTNLETPTKRVCVDTEIKSII

SEQ ID NO: 5529 - protein, 481 aa, Homo sapiens; identical to SEQ ID NO: 5528

SEQ ID NO: 5530 - protein, 312 aa, Homo sapiens
MADGDSGSERGGGGGPCGFQPASRGGGEQETQELASKRLDIQNKRFYLDVKQNAKGRFLKIAEVGAGGSKSRLTLSMAVAAEFRDSLGDFIEHYAQLGPSSPEQLAAGAEEGGGPRRALKSEFLVRENRKYYLDLKENQRGRFLRIRQTVNRGGGGFGAGPGPGGLQSGQTIALPAQGLIEFRDALAKLIDDYGGEDDELAGGPGGGAGGPGGGLYGELPEGTSITVDSKRFFFDVGCNKYGVFLRVSEVKPSYRNAITVPFKAWGKFGGAFCRYADEMKEIQERQRDKLYERRGGGSGGGEESEGEEVDED

SEQ ID NO: 5531 - protein, 322 aa, Homo sapiens
MERARRRGGGGGRGRGGKNVGGSGLSKSRLYPQAQHSHYPHYAASATPNQAGGAAEIQELASKRVDIQKKRFYLDVKQSSRGRFLKIAEVWIGRGRQDNIRKSKLTLSLSVAAELKDCLGDFIEHYAHLGLKGHRQEHGHSKEQGSRRRQKHSAPSPPVSVGSEEHPHSVLKTDYIERDNRKYYLDLKENQRGRFLRIRQTMMRGTGMIGYFGHSLGQEQTIVLPAQGMIEFRDALVQLIEDYGEGDIEERRGGDDDPLELPEGTSFRVDNKRFYFDVGSNKYGIFLKLTNYPKSRENINLFHCCQIKHKEQPHDTTKTVEE

SEQ ID NO: 5532 - protein, 347 aa, Homo sapiens
MERARRRGGGGGRGRGGKNVGGSGLSKSRLYPQAQHSHYPHYAASATPNQAGGAAEIQELASKRVDIQKKRFYLDVKQSSRGRFLKIAEVWIGRGRQDNIRKSKLTLSLSVAAELKDCLGDFIEHYAHLGLKGHRQEHGHSKEQGSRRRQKHSAPSPPVSVGSEEHPHSVLKTDYIERDNRKYYLDLKENQRGRFLRIRQTMMRGTGMIGYFGHSLGQEQTIVLPAQGMIEFRDALVQLIEDYGEGDIEERRGGDDDPLELPEGTSFRVDNKRFYFDVGSNKYGIFLKVSEVRPPYRNTITVPFKAWTRFGENFIKYEEEMRKICNSHKEKRMDGRKASGEEQECLD

SEQ ID NO: 5533 - protein, 142 aa, Homo sapiens
MAPVKISHVVSFSSQDPKYPVENLLNPDSPRRPWLGCPQDKSGQLKVELQLERAVPTGYIDVGNCGCAFLQIDVGHSSWPLDRPFITLLPATTLMSLTDSKQGKNRSGVRMFKDGKEGKSRKDGGGLYEKQRCSTKEDCECY

SEQ ID NO: 5534 - protein, 501 aa, Homo sapiens
MNRSRQVTCVAWVRCGVAKETPDKVELSKEEVKRLIAEAKEKLQEEGGGSDEEETGSPSEDGMQSARTQARPREPLEDGDPEDDRTLDDDELAEYDLDKYDEEGDPDAETLGESLLGLTVYGSNDQDPYVTLKDTEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGSKLSKKKKKKGKKSSSAEGHTDAVLDLSWNKLIRNVLASASADNTVILWDMSLGKPAASLAVHTDKVQTLQFHPFEAQTLISGSYDKSVALYDCRSPDESHRMWRFSGQIERVTWNHFSPCHFLASTDDGFVYNLDARSDKPIFTLNAHNDEISGLDLSSQIKGCLVTASADKYVKIWDILGDRPSLVHSRDMKMGVLFCSSCCPDLPFIYAFGGQKEGLRVWDISTVSSVNEAFGRRERLVLGSARNSSISGPFGSRSSDTPMES

SEQ ID NO: 5535 - protein, 253 aa, Homo sapiens
MNRSRQVTCVAWVRCGVAKETPDKVELSKEEVKRLIAEAKEKLQEEGGGSDEEETGSPSEDGMQSARTQARPREPLEDGDPEDDRTLDDDELAEYDLDKYDEEGDPDAETLGESLLGLTVYGSNDQDPYVTLKDTEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGSKLSKKKKKKGKKVKKKR

SEQ ID NO: 5536 - protein, 249 aa, Homo sapiens
MNRSRQVTCVAWVRCGVAKETPDKVELSKEEVKRLIAEAKEKLQEEGGGSDEEETGSPSEDGMQSARTQARPREPLEDGDPEDDRTLDDDELAEYDLDKYDEEGDPDAETLGESLLGLTVYGSNDQDPYVTLKDTEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGSKLSKKKKKKGKKK

SEQ ID NO: 5537 - protein, 98 aa, Homo sapiens
MQSARTQARPREPLEDGDPEDDRTLDDDELAEYDLDKYDEEGDPDAETLGESLLGLTVYGSNDQDPYVTLKDTEQYEREDFLIKPSDNLIVCGRAEQD

SEQ ID NO: 5538 - protein, 419 aa, Homo sapiens
MPAENSPAPAYKVSSHGGDSGLDGLGGPGVQLGSPDKKKRKANTQGPSFPPLSEYAPPPNPNSDHLVAANPFDDNYNTISYKPLPSSNPYLGPGYPGFGGYSTFRMPPHVPPRMSSPYCGPYSLRNQPHPFPQNPLGMGFNRPHAFNFGPHDNSSFGNPSYNNALSQNVNMPNQHFRQNPAENFSQIPPQNASQVSNPDLASNFVPGNNSNFTSPLESNHSFIPPPNTFGQAKAPPPKQDFTQGATKNTNQNSSAHPPHLNMDDTVNQSNIELKNVNRNNAVNQENSRSSSTEATNNNPANGTQNKPRQPRGAADACTTEKSNKSSLHPNRHGHSSSDPVYPCGICTNEVNDDQDAILCEASCQKWFHRICTGMTETAYGLLTAEASAVWGCDTCMADKDVQLMRTRETFGPSAVGSDA

SEQ ID NO: 5539 - protein, 419 aa, Homo sapiens
MSAEQEKDPISLKRVRGGDSGLDGLGGPGVQLGSPDKKKRKANTQGPSFPPLSEYAPPPNPNSDHLVAANPFDDNYNTISYKPLPSSNPYLGPGYPGFGGYSTFRMPPHVPPRMSSPYCGPYSLRNQPHPFPQNPLGMGFNRPHAFNFGPHDNSSFGNPSYNNALSQNVNMPNQHFRQNPAENFSQIPPQNASQVSNPDLASNFVPGNNSNFTSPLESNHSFIPPPNTFGQAKAPPPKQDFTQGATKNTNQNSSAHPPHLNMDDTVNQSNIELKNVNRNNAVNQENSRSSSTEATNNNPANGTQNKPRQPRGAADACTTEKSNKSSLHPNRHGHSSSDPVYPCGICTNEVNDDQDAILCEASCQKWFHRICTGMTETAYGLLTAEASAVWGCDTCMADKDVQLMRTRETFGPSAVGSDA

SEQ ID NO: 5540 - protein, 976 aa, Homo sapiens
MSNSNTTQETLEIMKESEKKLVEESVNKNKFISKTPSKEEIEKECEDTSLRQETQRRTSNHGHARKRAKSNSKLKLVRSLAVCEESSTPFADGPLETQDIIQLHISCPSDKEEEKSTKDVSEKEDKDKNKEKIPRKMLSRDSSQEYTDSTGIDLHEFLVNTLKKNPRDRMMLLKLEQEILEFINDNNNQFKKFPQMTSYHRMLLHRVAAYFGMDHNVDQTGKAVIINKTSNTRIPEQRFSEHIKDEKNTEFQQRFILKRDDASMDRDDNQTGQNGYLNDIRLSKEAFSSSSHKRRQIFRGNREGLSRTSSSRQSSTDSELKSLEPRPWSSTDSDGSVRSMRPPVTKASSFSGISILTRGDSIGSSKGGSAGRISRPGMALGAPEVCNQVTSSQSVRGLLPCTAQQQQQQQQQQLPALPPTPQQQPPLNNHMISQADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQNGTSPSVGFLQPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQGQSGLKHGNRGKRQALKSASTDLGTADVVLGRVLEVTDLPEGITRTEADKLFTQLAMSGAKIQWLKDAQGLPGGGGGDNSGTAENGRHSDLAALYTIVAVFPSPLAAQNASLRLNNSVSRFKLRMAKKNYDLRILERASSQ

SEQ ID NO: 5541 - protein, 976 aa, Homo sapiens; identical to SEQ ID NO: 5540

SEQ ID NO: 5542 - protein, 703 aa, Homo sapiens
MRRIQNFNRGSFSREMMPVWTEMITRGNREGLSRTSSSRQSSTDSELKSLEPRPWSSTDSDGSVRSMRPPVTKASSFSGISILTRGDSIGSSKGGSAGRISRPGMALGAPEVCNQVTSSQSVRGLLPCTAQQQQQQQQQQLPALPPTPQQQPPLNNHMISQADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQNGTSPSVGFLQPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQGQSGLKHGNRGKRQALKSASTDLGTADVVLGRVLEVTDLPEGITRTEADKLFTQLAMSGAKIQWLKDAQGLPGGGGGDNSGTAENGRHSDLAALYTIVAVFPSPLAAQNASLRLNNSVSRFKLRMAKKNYDLRILERASSQ

SEQ ID NO: 5543 - protein, 596 aa, Homo sapiens
MRRIQNFNRGSFSREMMPVWTEMITRGNREGLSRTSSSRQSSTDSELKSLEPRPWSSTDSDGSVRSMRPPVTKASSFSGISILTRGDSIGSSKGGSAGRISRPGMALGAPEVCNQVTSSQSVRGLLPCTAQQQQQQQQQQLPALPPTPQQQPPLNNHMISQADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQNGTSPSVGFLQPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQGQSGLKHGNRGKRQALKSASTDLGTADVALSFQP

SEQ ID NO: 5544 - protein, 671 aa, Homo sapiens
MRPPVTKASSFSGISILTRGDSIGSSKGGSAGRISRPGMALGAPEVCNQVTSSQSVRGLLPCTAQQQQQQQQQQLPALPPTPQQQPPLNNHMISQPVPALQPSPQPVQFSPSSCPQVLLPVSPPQQYNMADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQNGTSPSVGFLQPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQGQSGLKHGNRGKRQALKSASTDLGTADVVLGRVLEVTDLPEGITRTEADKLFTQLAMSGAKIQWLKDAQGLPGGGGGDNSGTAENGRHSDLAALYTIVAVFPSPLAAQNASLRLNNSVSRFKLRMAKKNYDLRILERASSQ

SEQ ID NO: 5545 - protein, 29 aa, Homo sapiens
MSNSNTTQETLEIMKESEKKLVEESVNKN

SEQ ID NO: 5546 - protein, 65 aa, Homo sapiens
MFYTHVLMSKRGPLAKIWLAAHWEKKLTKAHVFECNLEITIEKILSPKVKIALRTSGHLLLGVVR

SEQ ID NO: 5547 - protein, 521 aa, Homo sapiens
MFYTHVLMSKRGPLAKIWLAAHWEKKLTKAHVFECNLEITIEKILSPKVKIALRTSGHLLLGVVRIYNRKAKYLLADCSEAFLKMKMTFCPGLVDLPKENFEASYNAITLPEEFHDFDTQNMNAIDVSEHFTQNQSRPEEITLRENFDNDLIFQAESFGEESEILRRHSFFDDNILLNSSGPLIEHSSGSLTGERSLFYDSGDGFGDEGAAGEMIDNLLQDDQNILLEDMHLNREISLPSEPPNSLAVEPDNSECICVPENEKMNETILLSTEEEGFTLDPIDISDIAEKRKGKKRRLLIDPIKELSSKVIHKQLTSFADTLMVLELAPPTQRLMMWKKRGGVHTLLSTAAQDLIHAELKMLFTKCFLSSGFKLGRKMIQKESVREEVGNQNIVETSMMQEPNYQQELSKPQTWKDVIGGSQHSSHEDTNKNINSEESLSNEENIETERWNGRILQMLNRLRVADQGQAAAAATAEALRQAGPEWCEPAGLRRASGLSPRDTAHPTPYSDPQPHGHVPARK

SEQ ID NO: 5548 - protein, 521 aa, Homo sapiens; identical to SEQ ID NO: 5547

SEQ ID NO: 5549 - protein, 556 aa, Homo sapiens
MFYTHVLMSKRGPLAKIWLAAHWEKKLTKAHVFECNLEITIEKILSPKVKIALRTSGHLLLGVVRIYNRKAKYLLADCSEAFLKMKMTFCPGLVDLPKENFEASYNAITLPEEFHDFDTQNMNAIDVSEHFTQNQSRPEEITLRENFDNDLIFQAESFGEESEILRRHSFFDDNILLNSSGPLIEHSSGSLTGERSLFYDSGDGFGDEGAAGEMIDNLLQDDQNILLEDMHLNREISLPSEPPNSLAVEPDNSECICVPENEKMNETILLSTEEEGFTLDPIDISDIAEKRKGKKRRLLIDPIKELSSKVIHKQLTSFADTLMVLELAPPTQRLMMWKKRGGVHTLLSTAAQDLIHAELKMLFTKCFLSSGFKLGRKMIQKESVREEVGNQNIVETSMMQEPNYQQELSKPQTWKDVIGGSQHSSHEDTNKNINSEQDIVEMVSLAAEESSLMNDLFAQEIEYSPVELESLSNEENIETERWNGRILQMLNRLRESNKMGMQSFSLMKLCRNSDRKQAAAKFYSFLVLKKQLAIELSQSAPYADIIATMGPMFYNI

SEQ ID NO: 5550 - protein, 1161 aa, Homo sapiens
MGLGKTLQVISFIDVLFRHTPAKTVLAIVPVNTLQNWLAEFNMWLPPPEALPADNKPEEVQPRFFKVHILNDEHKTMASRAKVMADWVSEGGVLLMGYEMYRLLTLKKSFATGRPKKTKKRSHPVIIDLDEEDRQQEFRREFEKALCRPGPDVVICDEGHRIKNCQASTSQALKNIRSRRRVVLTGYPLQNNLIEYWCMVDFVRPDFLGTRQEFSNMFERPILNGQCIDSTPQDVRLMRYRSHVLHSLLEGFVQRRGHTVLKIHLPAKEENVILVRLSKIQRDLYTQFMDRFRDCGSSGWLGLNPLKAFCVCCKIWNHPDVLYEALQKESLANEQDLDVEELGSAGTSARCPPQGTKGKGEDSTLASSMGEATNSKFLQGVGFNPFQERGNNIVTYEWAKDLLTNYQTGVLENSPKMVLLFHLIEESVKLGDKILVFSQSLSTLALIEEFLGKREVPCPPGTEGQGAQKWVRNISYFRLDGSTPAFERERLINQFNDPSNLTTWLFLLSTRAGCLGVNLIGANRVVVFDASWNPCHDAQAVCRVYRYGQKKPCYIYRLVADYTLEKKIYDRQISKQGMSDRVVDDLNPMLNFTRKEVENLLHFVEKEPAPQVSLNVKGIKESVLQLACLKYPHLITKEPFEHESLLLNRKDHKLTKAEKKAAKKSYEEDKRTSVPYTRPSYAQYYPASDQSLTSIPAFSQRNWQPTLKGDEKPVASVRPVQSTPIPMMPRHVPLGGSVSSASSTNPSMNFPINYLQRAGVLVQKVVTTTDIVIPGLNSSTDVQARINAGESIHIIRGTKGTYIRTSDGRIFAVRATGKPKVPEDGRMAASGSQGPSCESTSNGRHSASSPKAPDPEGLARPVSPDSPEIISELQQYADVAAARESRQSSPSTNAALPGPPAQLMDSSAVPGTALGTEPRLGGHCLNSSLLVTGQPCGDRHPVLDLRGHKRKLATPPAAQESSRRRSRKGHLPAPVQPYEHGYPVSGGFAMPPVSLNHNLTTPFTSQAGENSLFMGSTPSYYQLSNLLADARLVFPVTTDPLVPAGPVSSSSTATSVTASNPSFMLNPSVPGILPSYSLPFSQPLLSEPRMFAPFPSPVLPSNLSRGMSIYPGYMSPHAGYPAGGLLRSQVPPFDSHEVAEVGFSSNDDEDKDDDVIEVTGK

SEQ ID NO: 5551 - protein, 1467 aa, Homo sapiens
MSDESASGSDPDLDPDVELEDAEEEEEEEEVAVEECDRDDEEDLLDDPSLEGMCGTEHAQLGEDGQQPPRCTSTTSSQSEPSEQLRRHQGKNLASEDPKKKRAQKPSHMRRNIRKLLREDQLEPVTKAAQQEELERRKRLEQQRKDYAAPIPTVPLEFLPEEIALRASDGPQLPPRVLAQEVICLDSSSGSEDEKSSRDEVIELSSGEEDTLHIVDSSESVSEDDEEEEKGGTHVNDVLNQRDALGRVLVNLNHPPEEENVFLAPQLARAVKPHQIGGIRFLYDNLVESLERFKTSSGFGCILAHSMGLGKTLQVISFIDVLFRHTPAKTVLAIVPVNTLQNWLAEFNMWLPPPEALPADNKPEEVQPRFFKVHILNDEHKTMASRAKVMADWVSEGGVLLMGYEMYRLLTLKKSFATGRPKKTKKRSHPVIIDLDEEDRQQEFRREFEKALCRPGPDVVICDEGHRIKNCQASTSQALKNIRSRRRVVLTGYPLQNNLIEYWCMVDFVRPDFLGTRQEFSNMFERPILNGQCIDSTPQDVRLMRYRSHVLHSLLEGFVQRRGHTVLKIHLPAKEENVILVRLSKIQRDLYTQFMDRFRDCGSSGWLGLNPLKAFCVCCKIWNHPDVLYEALQKESLANEQDLDVEELGSAGTSARCPPQGTKGKGEDSTLASSMGEATNSKFLQGVGFNPFQERGNNIVTYEWAKDLLTNYQTGVLENSPKMVLLFHLIEESVKLGDKILVFSQSLSTLALIEEFLGKREVPCPPGTEGQGAQKWVRNISYFRLDGSTPAFERERLINQFNDPSNLTTWLFLLSTRAGCLGVNLIGANRVVVFDASWNPCHDAQAVCRVYRYGQKKPCYIYRLVADYTLEKKIYDRQISKQGMSDRVVDDLNPMLNFTRKEVENLLHFVEKEPAPQVSLNVKGIKESVLQLACLKYPHLITKEPFEHESLLLNRKDHKLTKAEKKAAKKSYEEDKRTSVPYTRPSYAQYYPASDQSLTSIPAFSQRNWQPTLKGDEKPVASVRPVQSTPIPMMPRHVPLGGSVSSASSTNPSMNFPINYLQRAGVLVQKVVTTTDIVIPGLNSSTDVQARINAGESIHIIRGTKGTYIRTSDGRIFAVRATGKPKVPEDGRMAASGSQGPSCESTSNGRHSASSPKAPDPEGLARPVSPDSPEIISELQQYADVAAARESRQSSPSTNAALPGPPAQLMDSSAVPGTALGTEPRLGGHCLNSSLLVTGQPCGDRHPVLDLRGHKRKLATPPAAQESSRRRSRKGHLPAPVQPYEHGYPVSGGFAMPPVSLNHNLTTPFTSQAGENSLFMGSTPSYYQLSNLLADARLVFPVTTDPLVPAGPVSSSSTATSVTASNPSFMLNPSVPGILPSYSLPFSQPLLSEPRMFAPFPSPVLPSNLSRGMSIYPGYMSPHAGYPAGGLLRSQVPPFDSHEVAEVGFSSNDDEDKDDDVIEVTGK

SEQ ID NO: 5552 - protein, 224 aa, Homo sapiens
MPPRKKRRQPSQKAPLLFHQQPLEGPKHSCASTQLPITHTRQVSPDFDTAAGSLFPAYQKHQNRARHSSRKPTTSKFPHLTFESPQSSSSETLGIPLIRECPSESEKDVSRRPLVPVLSPQSCGNMSVQALQSLPYVFIPPDIQTPESSSVKEELIPQDQKENSLLSCTLHTGTPNSPEPGPVLVKDTPEDKYGIKVTWRRRQHLLAYLRERGKLSRSQFLVKS

SEQ ID NO: 5553 - protein, 444 aa, Homo sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRIYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 5554 - protein, 730 aa, Homo sapiens
MAIGVWQLLLDMGIMLSVDQHLYFQDTYVFYQFSSDECSYLYCEFEREEEWQNGVKLLLQLVPLIPARGGICELSHQKIEDSEESSDEILVRLTSAVQRELAAVIALKARKSAIEQDEENNDKHVAVTEAESVPDSQAGVMCKLQERDEIGRIELVQKLAKENYQFLQTDKKEQEKSEHQDDEVTTVQVKEQDQSVLVLKKVQCCGPAPTAGSAESHWRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 5555 - protein, 580 aa, Homo sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 5556 - protein, 582 aa, Homo sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRIYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGDKEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 5557 - protein, 373 aa, Homo sapiens
MLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQGPLPPAREESLLGAPSESHAGAQPRPRGGPHDAELLEVAAAPAPEWCPLAAQPQAL

SEQ ID NO: 5558 - protein, 337 aa, Homo sapiens
MLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQVGVVLGGGWEVRTWPSPTPS

SEQ ID NO: 5559 - protein, 373 aa, Homo sapiens; identical to SEQ ID NO: 5557

SEQ ID NO: 5560 - protein, 337 aa, Homo sapiens; identical to SEQ ID NO: 5558

SEQ ID NO: 5561 - protein, 320 aa, Homo sapiens
MLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQWPP

SEQ ID NO: 5562 - protein, 84 aa, Homo sapiens
MLLGLAAMELKVWVDGIQRVVCGVSEQTTCQEVVIALAQAIGQTGRFVLVQRLREKERQLLPQECPVGAQATCGQFASDVQFVL

SEQ ID NO: 5563 - protein, 714 aa, Homo sapiens
MNTLQGPVSFKDVAVDFTQEEWQQLDPDEKITYRDVMLENYSHLVSVGYDTTKPNVIIKLEQGEEPWIMGGEFPCQHSPEAWRVDDLIERIQENEDKHSRQAACINSKTLTEEKENTFSQIYMETSLVPSSIIAHNCVSCGKNLESISQLISSDGSYARTKPDECNECGKTYHGEKMCEFNQNGDTYSHNEENILQKISILEKPFEYNECMEALDNEAVFIAHKRAYIGEKPYEWNDSGPDFIQMSNFNAYQRSQMEMKPFECSECGKSFCKKSKFIIHQRAHTGEKPYECNVCGKSFSQKGTLTVHRRSHLEEKPYKCNECGKTFCQKLHLTQHLRTHSGEKPYECSECGKTFCQKTHLTLHQRNHSGERPYPCNECGKSFSRKSALSDHQRTHTGEKLYKCNECGKSYYRKSTLITHQRTHTGEKPYQCSECGKFFSRVSYLTIHYRSHLEEKPYECNECGKTFNLNSAFIRHRKVHTEEKSHECSECGKFSQLYLTDHHTAHLEEKPYECNECGKTFLVNSAFDGHQPLPKGEKSYECNVCGKLFNELSYYTEHYRSHSEEKPYGCSECGKTFSHNSSLFRHQRVHTGEKPYECYECGKFFSQKSYLTIHHRIHSGEKPYECSKCGKVFSRMSNLTVHYRSHSGEKPYECNECGKVFSQKSYLTVHYRTHSGEKPYECNECGKKFHHRSAFNSHQRIHRRGNMNVLDVENL

SEQ ID NO: 5564 - protein, 714 aa, Homo sapiens; identical to SEQ ID NO: 5563

SEQ ID NO: 5565 - protein, 243 aa, Homo sapiens
MNTLQGPVSFKDVAVDFTQEEWQQLDPDEKITYRDVMLENYSHLVSVGYDTTKPNVIIKLEQGEEPWIMGGEFPCQHSPEAWRVDDLIERIQENEDKHSSRPARRPCGPRCCCCCCCSRPPRSPPPKPLPTRMLTPRKAFRTCSKESGLAETESCGQTHTWPRALAVLMGLWWPRDQKAGEEDLRFRERRPGLQATATGSGEHGAFPVHSQGVWASTHWQGTAVCPLQTPPPDAFIRNNKVLS

SEQ ID NO: 5566 - protein, 113 aa, Homo sapiens
MNTLQGPVSFKDVAVDFTQEEWQQLDPDEKITYRDVMLENYSHLVSVGYDTTKPNVIIKLEQGEEPWIMGGEFPCQHSPAALPAGHVAPAVAAAAAAPGRPGPHRQSRSPPGC

SEQ ID NO: 5567 - protein, 517 aa, Homo sapiens
MDPAGAADPSVPPNPLTHLSLQDRSEMQLQSEADRRSLPGTWTRSSPEHTTILRGGVRRCLQQQCEQTVRILHAKVAQKSYGNEKRFFCPPPCVYLSGPGWRVKPGQDQAHQAGETGPTVCGYMGLDSASGSATETQKLNFEQQPDSREFGCAKTLYISDADKRKHFRLVLRLVLRGGRELGTFHSRLIKVISKPSQKKQSLKNTDLCISSGSKVSLFNRLRSQTVSTRYLSVEDGAFVASARQWAAFTLHLADGHSAQGDFPPREGYVRYGSLVQLVCTVTGITLPPMIIRKVAKQCALLDVDEPISQLHKCAFQFPGSPPGGGGTYLCLATEKVVQFQASPCPKEANRALLNDSSCWTIIGTESVEFSFSTSLACTLEPVTPVPLISTLELSGGGDVATLELHGENFHAGLKVWFGDVEAETMYRSPRSLVCVVPDVAAFCSDWRWLRAPITIPMSLVRADGLFYPSAFSFTYTPEYSVRPGHPGVPEPATDADALLESIHQEFTRTNFHLFIQT

SEQ ID NO: 5568 - protein, 471 aa, Homo sapiens
MDPAGAADPSVPPNPLTHLSLQDRSEMQLQSEADRRSLPGTWTRSSPEHTTILRGGVRRCLQQQCEQTVRILHAKVAQKSYGNEKRFFCPPPCVYLSGPGWRVKPGQDQAHQAGETGPTVCGYMGLDSASGSATETQKLNFEQQPDSREFGCAKTLYISDADKRKHFRLVLRLVLRGGRELGTFHSRLIKVISKPSQKKQSLKNTDLCISSGSKVSLFNRLRSQTVSTRYLSVEDGAFVASARQWAAFTLHLADGHSAQGDFPPREGYVRYGSLVQLVCTVTGITLPPMIIRKVAKQCALLDVDEPISQLHKCAFQFPGSPPGGGGTYLCLATEKVVQFQASPCPKEANRALLNDSSCWTIIGTESVEFSFSTSLACTLEPVTPVPLISTLELSGGGDVATLELHGENFHAGLKVWFGDVEAETMYRYGVEPAVPGVRGAGRGGLLQRLALAARSHHNPHEPGARRRALLP

SEQ ID NO: 5569 - protein, 516 aa, Homo sapiens
MDPAGAADPSVPPNPLTHLSLQDRSEMQLQSEADRRSLPGTWTRSSPEHTTILRGGVRRCLQQQCEQTVRILHAKVAQKSYGNEKRFFCPPPCVYLSGPGWRVKPGQDQAHQAGETGPTVCGYMGLDSASGSATETQKLNFEQQPDSREFGCAKTLYISDADKRKHFRLVLRLVLRGGRELGTFHSRLIKVISKPSQKKQSLKNTDLCISSGSKVSLFNRLRSQTVSTRYLSVEDGAFVASARQWAAFTLHLADGHSAQGDFPPREGYVRYGSLVQLVCTVTGITLPPMIIRKVAKQCALLDVDEPISQLHKCAFQFPGSPPGGGGTYLCLATEKVVQFQASPCPKEANRALLNDSSCWTIIGTESVEFSFSTSLACTLEPVTPVPLISTLELSGGGDVATLELHGENFHAGLKVWFGDVEAETMYSPRSLVCVVPDVAAFCSDWRWLRAPITIPMSLVRADGLFYPSAFSFTYTPEYSVRPGHPGVPEPATDADALLESIHQEFTRTNFHLFIQT

SEQ ID NO: 5570 - protein, 707 aa, Homo sapiens
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATIEMAIETLQKSDGLSTHRSSLLNSHLQWLLDNYETAEGVSLPRSTLYNHYLRHCQEHKLDPVNAASFGKLIRSIFMGLRTRRLGTRGNSKYHYYGIRVKPDSPLNRLQEDMQYMAMRQQPMQQKQRYKPMQKVDGVADGFTGSGQQTGTSVEQTVIAQSQHHQQFLDASRALPEFGEVEISSLPDGTTFEDIKSLQSLYREHCEAILDVVVNLQFSLIEKLWQTFWRYSPSTPTDGTTITESSNLSEIESRLPKAKLITLCKHESILKWMCNCDHGMYQALVEILIPDVLRPIPSALTQAIRNFAKSLEGWLSNAMNNIPQRMIQTKVAAVSAFAQTLRRYTSLNHLAQAARAVLQNTSQINQMLSDLNRVDFANVQEQASWVCQCDDNMVQRLETDFKMTLQQQSTLEQWAAWLDNVMMQALKPYEGRPSFPKAARQFLLKWSFYSSMVIRDLTLRSAASFGSFHLIRLLYDEYMFYLVEHRVAQATGETPIAVMGEVREAERAVTHWVIKNKPELHFSLNTLLIKTMVPNQVSLRARRDCGVIARVP

SEQ ID NO: 5571 - protein, 707 aa, Homo sapiens; identical to SEQ ID NO: 5570

SEQ ID NO: 5572 - protein, 85 aa, Homo sapiens
MQTSETGSDTGSTVTLQTSVASQAAVPTQVVQQVPVQQQVQQVQTVQQVQHVYPAQVQYVEGSDTVYTNGAMSRAPWSMILESSP

SEQ ID NO: 5573 - protein, 195 aa, Homo sapiens
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATANSVPEMKLLRQITMNRLFPTLNHKLTEGSGPHFQSI

SEQ ID NO: 5574 - protein, 138 aa, Homo sapiens
MLSDLNRVDFANVQEQASWVCQCDDNMVQRLETDFKMTLQQQSTLEQWAAWLDNVMMQALKPYEGRPSFPKAARQFLLKWSFYSSMVIRDLTLRSAASFGSFHLIRLLYDEYMFYLVEHRVAQATGETPIAVMGEVPM

SEQ ID NO: 5575 - protein, 216 aa, Homo sapiens
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATLQWLLDNYETAEGVSLPRSTLYNHYLRHCQEHKLDPVNAASFGKLIRSIFMGLRTRRL

SEQ ID NO: 5576 - protein, 749 aa, Homo sapiens
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATIEMAIETLQKSDGLSTHRSSLLNSHLQWLLDNYETAEGVSLPRSTLYNHYLRHCQEHKLDPVNAASFGKLIRSIFMGLRTRRLGTRGNSKYHYYGIRVKPDSPLNRLQEDMQYMAMRQQPMQQKQRYKPMQKVDGVADGFTGSGQQTGTSVEQTVIAQSQHHQQFLDASRALPEFGEVEISSLPDGTTFEDIKSLQSLYREHCEAILDVVVNLQFSLIEKLWQTFWRYSPSTPTDGTTITESSNLSEIESRLPKAKLITLCKHESILKWMCNCDHGMYQALVEILIPDVLRPIPSALTQAIRNFAKSLEGWLSNAMNNIPQRMIQTKVAAVSAFAQTLRRYTSLNHLAQAARAVLQNTSQINQMLSDLNRVDFANVQEQASWVCQCDDNMVQRLETDFKMTLQQQSTLEQWAAWLDNVMMQALKPYEGRPSFPKAARQFLLKWSFYSSMVIRDLTLRSAASFGSFHLIRLLYDEYMFYLVEHRVAQATGETPIAVMGEFGDLNAVSPGNLDKDEGSEVESEMDEELDDSSEPQAKREKTELSQAFPVGCMQPVLETGVQPSLLNPIHSEHIVTSTQTIRQCSATGNTYTAV

SEQ ID NO: 5577 - protein, 156 aa, Homo sapiens
VQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATANSVPEMKLLRQITMNRLFPTLNHKLTEGSGPHFQSI

SEQ ID NO: 5578 - protein, 135 aa, Homo sapiens
VQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATLFLFSCVPFSLGQLSP

SEQ ID NO: 5579 - protein, 138 aa, Homo sapiens
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIG

SEQ ID NO: 5580 - protein, 124 aa, Homo sapiens
EQASWVCQCDDNMVQRLETDFKMTLQQQSTLEQWAAWLDNVMMQALKPYEGRPSFPKAARQFLLKWSFYSSMVIRDLTLRSAASFGSFHLIRLLYDEYMFYLVEHRVAQATGETPIAVMGEVPM

SEQ ID NO: 5581 - protein, 184 aa, Homo sapiens
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATIEMAIETLQKSDGLSTHRSSLLNSHV

SEQ ID NO: 5582 - protein, 216 aa, Homo sapiens; identical to SEQ ID NO: 5575

SEQ ID NO: 5583 - protein, 174 aa, Homo sapiens
MCNCDHGMYQALVEILIPDVLRPIPSALTQAIRNFAKSLEGWLSNAMNNIPQRMIQTKVAAVSAFAQTLRRYTSLNHLAQAARAVLQNTSQINQMLSDLNRVDFANVQEQASWVCQCDDNMVQRLETDFKMTLQQQSTLEQWAAWLDNVMMQALKPYEGRPSFPKAARQFLLKW

SEQ ID NO: 5584 - protein, 641 aa, Homo sapiens
MNWAAFGGSEFFIPEGIQIDSRCPLSRNITEWYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQSYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 5585 - protein, 744 aa, Homo sapiens
MIKRRAHPGAGGDRTRPRRRRSTESWIERCLNESENKRYSSHTSLGNVSNDENEEKENNRASKPHSTPATLQWLEENYEIAEGVCIPRSALYMHYLDFCEKNDTQPVNAASFGKIIRQQFPQLTTRRLGTRGQSKYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQSYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 5586 - protein, 735 aa, Homo sapiens
MHCGLLEEPDMDSTESWIERCLNESENKRYSSHTSLGNVSNDENEEKENNRASKPHSTPATLQWLEENYEIAEGVCIPRSALYMHYLDFCEKNDTQPVNAASFGKIIRQQFPQLTTRRLGTRGQSKYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQSYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 5587 - protein, 586 aa, Homo sapiens
MAEGVPASPSSGEGSRGPHSGVIQWLVDNFCICEECSVPRCLMYEIYVETCGQNTENQVNPATFGKLVRLVFPDLGTRRLGTRGSARYHYDGICIKKSSFFYAQYCYLIGEKRYHSGDAIAFEKSTNYNSIIQQEATCEDHSPMKTDPVGSPLSEFRRCPFLEQEQAKKYSCNMMAFLADEYCNYCRDILRNVEDLLTSFWKSLQQDTVMLMSLPDVCQLFKCYDVQLYKGIEDVLLHDFLEDVSIQYLKSVQLFSKKFKLWLLNALEGVPALLQISKLKEVTLFVKRLRRKTYLSNMAKTMRMVLKSKRRVSVLKSDLQAIINQGTLATSKKALASDRSGADELENNPEMKCLRNLISLLGTSTDLRVFLSCLSSHLQAFVFQTSRSKEEFTKLAASFQLRWNLLLTAVSKAMTLCHRDSFGSWHLFHLLLLEYMIHILQSCLEEEEEEEDMGTVKEMLPDDPTLGQPDQALFHSLNSSLSQACASPSMEPLGVMPTHMGQGRYPVGVSNMVLRILGFLVDTAMGNKLIQVLLEDETTESAVKLSLPMGQEALITLKDGQQFVIQISDVPQSSEDIYFRENNANV

SEQ ID NO: 5588 - protein, 473 aa, Homo sapiens
MYEIYVETCGQNTENQVNPATFGKCEDHSPMKTDPVGSPLSEFRRCPFLEQEQAKKYSCNMMAFLADEYCNYCRDILRNVEDLLTSFWKSLQQDTVMLMSLPDVCQLFKCYDVQLYKGIEDVLLHDFLEDVSIQYLKSVQLFSKKFKLWLLNALEGVPALLQISKLKEVTLFVKRLRRKTYLSNMAKTMRMVLKSKRRVSVLKSDLQAIINQGTLATSKKALASDRSGADELENNPEMKCLRNLISLLGTSTDLRVFLSCLSSHLQAFVFQTSRSKEEFTKLAASFQLRWNLLLTAVSKAMTLCHRDSFGSWHLFHLLLLEYMIHILQSCLEEEEEEEDMGTVKEMLPDDPTLGQPDQALFHSLNSSLSQACASPSMEPLGVMPTHMGQGRYPVGVSNMVLRILGFLVDTAMGNKLIQVLLEDETTESAVKLSLPMGQEALITLKDGQQFVIQISDVPQSSEDIYFRENNANV

SEQ ID NO: 5589 - protein, 45 aa, Homo sapiens
MYEIYVETCGQNTENQVNPATFGKMAFLADEYCNYCRDILRNVRN

SEQ ID NO: 5590 - protein, 567 aa, Homo sapiens
MLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 5591 - protein, 567 aa, Homo sapiens; identical to SEQ ID NO: 5590

SEQ ID NO: 5592 - protein, 567 aa, Homo sapiens; identical to SEQ ID NO: 5590

SEQ ID NO: 5593 - protein, 204 aa, Homo sapiens
MGIGVSLLLQFSLTPGGYRSVGRSRRCSRGSIPRNIPKRSWKKPHPQLCSLQAEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIAC

SEQ ID NO: 5594 - protein, 624 aa, Homo sapiens
MGIGVSLLLQFSLTPGGYRSVGRSRRCSRGSIPRNIPKRSWKKPHPQLCSLQAEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 5595 - protein, 146 aa, Homo sapiens
MLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIA

SEQ ID NO: 5596 - protein, 567 aa, Homo sapiens; identical to SEQ ID NO: 5590

SEQ ID NO: 5597 - protein, 482 aa, Homo sapiens
MVEKGPEVSGKRRGRNNAAASASAAAASAAASAACASPAATAASGAAASSASAAAASAAAAPNNGQNKSLAAAAPNGNSSSNSWEEGSSGSSSDEEHGGGGMRVGPQYQAVVPDFDPAKLARRSQERDNLGMLVWSPNQNLSEAKLDEYIAIAKEKHGYNMEQALGMLFWHKHNIEKSLADLPNFTPFPDEWTVEDKVLFEQAFSFHGKTFHRIQQMLPDKSIASLVKFYYSWKKTRTKTSVMDRHARKQKREREESEDELEEANGNNPIDIEVDQNKESKKEVPPTETVPQVKKEKHSTQAKNRAKRKPPKGMFLSQEDVEAVSANATAATTVLRQLDMELVSVKRQIQNIKQTNSALKEKLDGGIEPYRLPEVIQKCNARWTTEEQLLAVQAIRKYGRDFQAISDVIGNKSVVQVKNFFVNYRRRFNIDEVLQEWEAEHGKEETNGPSNQKPVKSPDNSIKMPEEEDEAPVLDVRYASAS

SEQ ID NO: 5598 - protein, 482 aa, Homo sapiens; identical to SEQ ID NO: 5597

SEQ ID NO: 5599 - protein, 523 aa, Homo sapiens
MPSVMEKPSAGSGILSRSRAKTVPNGGQPHSEDDSSEEEHSHDSMIRVGTNYQAVIPECKPESPARYSNKELKGMLVWSPNHCVSDAKLDKYIAMAKEKHGYNIEQALGMLLWHKHDVEKSLADLANFTPFPDEWTVEDKVLFEQAFGFHGKCFQRIQQMLPDKLIPSLVKYYYSWKKTRSRTSVMDRQARRLGGRKDKEDSDELEEGRGGVSEGEPDPADPKREPLPSRPLNARPGPGKKEVQVSQYRHHPLRTRRRPPKGMYLSPEGLTAVSGSPDLANLTLRGLDSQLISLKRQVQSMKQTNSSLRQALEGGIDPLRPPEANTKFNSRWTTDEQLLAVQAIRRYGKDFGAIAEVIGNKTLTQVKTFFVSYRRRFNLEEVLQEWEAEQDGAPGAPVPMEEARRGAPLPAPALEEDDEVQITSVSTSVPRSVPPAPPPPPPPTSLSQPPPLLRPPLPTAPTLLRQPPPLQQGRFLQPRLAPNQPPPPLIRPALAAPRHSARPGPQPPPTLIGTPLEPPAPSL

SEQ ID NO: 5600 - protein, 495 aa, Homo sapiens
MRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPESNQKINARWTTEEQLLAVQGVRKYGKDFQAIADVIGNKTVGQVKNFFVNYRRRFNLEEVLQEWEAEQGTQASNGDASTLGEETKSASNVPSGKSTDEEEEAQTPQAPRTLGPSPPAPSSTPTPTAPIATLNQPPPLLRPTLPAAPALHRQPPPLQQQARFIQPRPTLNQPPPPLIRPANSMPPRLNPRPVLSTVGGQQPPSLIGIQTDSQSSLH

SEQ ID NO: 5601 - protein, 436 aa, Homo sapiens
MPGMMEKGPELLGKNRSANGSAKSPAGGGGSGASSTNGGLHYSEPESGCSSDDEHDVGMRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPESNQKINARWTTEEQLLAVQGTDPTGSSDTGSITSCPIIHSNTNSPYCHSEPASTTSSSNTACCPGSSPAASSTPAAGSVHPAPANFKSASTTSYSPC

SEQ ID NO: 5602 - protein, 553 aa, Homo sapiens
MPGMMEKGPELLGKNRSANGSAKSPAGGGGSGASSTNGGLHYSEPESGCSSDDEHDVGMRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPESNQKINARWTTEEQLLAVQGVRKYGKDFQAIADVIGNKTVGQVKNFFVNYRRRFNLEEVLQEWEAEQGTQASNGDASTLGEETKSASNVPSGKSTDEEEEAQTPQAPRTLGPSPPAPSSTPTPTAPIATLNQPPPLLRPTLPAAPALHRQPPPLQQQARFIQPRPTLNQPPPPLIRPANSMPPRLNPRPVLSTVGGQQPPSLIGIQTDSQSSLH

SEQ ID NO: 5603 - protein, 449 aa, Homo sapiens
MPGMMEKGPELLGKNRSANGSAKSPAGGGGSGASSTNGGLHYSEPESGCSSDDEHDVGMRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPESNQKINARWTTEEQLLAVQGVRKYGKDFQAIADVIGNKTVGQVKNFFVNYRRRFNLEEVLQEWEAEQGTQASNGDASTLGEETKSASNVPSGKSTDEEEEVCLCMEFELI

SEQ ID NO: 5604 - protein, 149 aa, Homo sapiens
MRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLAN

SEQ ID NO: 5605 - protein, 86 aa, Homo sapiens
MRVGAEYQARIPEFDPGATKYTDKDNGGMLVWSPYHSIPDAKLDEYIAIAKEKHGYNVEQALGMLFWHKHNIEKSLADLPNFTPFP

SEQ ID NO: 5606 - protein, 184 aa, Homo sapiens
MFLSPGEGPATEGGGLGPGEEAPKKKHRRNRTTFTTYQLHQLERAFEASHYPDVYSREELAAKVHLPEVRVQVWFQNRRAKWRRQERLESGSGAVAAPRLPEAPALPFARPPAMSLPLEPWLGPGPPAVPGLPRLLGPGPGLQASFGPHAFAPTFADGFALEEASLRLLAKEHAQALDRAWPPA

SEQ ID NO: 5607 - protein, 230 aa, Homo sapiens
MPAPVEGTDFPGAGRQAWGSPALSLPVAPPAVSPPSVPLPSHQVGAMFLSPGEGPATEGGGLGPGEEAPKKKHRRNRTTFTTYQLHQLERAFEASHYPDVYSREELAAKVHLPEVRVQVWFQNRRAKWRRQERLESGSGAVAAPRLPEAPALPFARPPAMSLPLEPWLGPGPPAVPGLPRLLGPGPGLQASFGPHAFAPTFADGFALEEASLRLLAKEHAQALDRAWPPA

SEQ ID NO: 5608 - protein, 204 aa, Homo sapiens
  MOD_RES (1)..(1): Any amino acid
XAGAGVPWKSTEGLPWAVGAMFLSPGEGPATEGGGLGPGEEAPKKKHRRNRTTFTTYQLHQLERAFEASHYPDVYSREELAAKVHLPEVRVQVWFQNRRAKWRRQERLESGSGAVAAPRLPEAPALPFARPPAMSLPLEPWLGPGPPAVPGLPRLLGPGPGLQASFGPHAFAPTFADGFALEEASLRLLAKEHAQALDRAWPPA

SEQ ID NO: 5609 - protein, 425 aa, Homo sapiens
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 5610 - protein, 424 aa, Homo sapiens
MADKEAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 5611 - protein, 87 aa, Homo sapiens
MTHALEWPSLTAQWLPDVTRPEGKDFSIHRLVLGTHTSDEQNHLVIASVQLPNDDAQFDASHYDSEKGEFGGFGSVSGKIEIEIKIN

SEQ ID NO: 5612 - protein, 390 aa, Homo sapiens
MTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 5613 - protein, 180 aa, Homo sapiens
VADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 5614 - protein, 68 aa, Homo sapiens
MTHALEWPSLTAQWLPDVTRPEGKDFSIHRLVLGTHTSDEQNHLVIASVQLPNDDAQFDASHYDSEKG

SEQ ID NO: 5615 - protein, 173 aa, Homo sapiens
MIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 5616 - protein, 184 aa, Homo sapiens
MARSLVHDTVFYCLSVYQVKISPTPQLGAASSAEGHVGQGAPGLMGNMNPEGGVNHENGMNRDGGMIPEGGGGNQEPRQQPQPPPEEPAQAAMEGPQPENMQPRTRRTKFTLLQVEELESVFRHTQYPDVPTRRELAENLGVTEDKVRVWFKNKRARCRRHQRELMLANELRADPDDCVYIVVD

SEQ ID NO: 5617 - protein, 288 aa, Homo sapiens
MEPPDQCSQYMTSLLSPAVDDEKELQDMNAMVLSLTEEVKEEEEDAQPEPEQGTAAGEKLKSAGAQGGEEKDGGGEEKDGGGAGVPGHLWEGDLEGTSGSDGNVEDSDQSEKEPGQQYSRPQGAVGGLEPGNAQQPNVHAFTPLQLQELERIFQREQFPSEFLRRRLARSMNVTELAVQIWFENRRAKWRRHQRALMARNMLPFMAVGQPVMVTAAEAITAPLFISGMRDDYFWDHSHSSSLCFPMPPFPPPSLPLPLMLLPPMPPAGQAEFGPFPFVIVPSFTFPNV

SEQ ID NO: 5618 - protein, 288 aa, Homo sapiens
MEPPDQCSQYMTSLLSPAVDDEKELQDMNAMVLSLTEEVKEEEEDAQPEPEQGTAAGEKLKSAGAQGGEEKDGGGEEKDGGGAGVPGHLWEGNLEGTSGSDGNVEDSDQSEKEPGQQYSRPQGAVGGLEPGNAQQPNVHAFTPLQLQELECIFQREQFPSEFLRRRLARSMNVTELAVQIWFENRRAKWRRHQRALMARNMLPFMAVGQPVMVTAAEAITAPLFISGMRDDYFWDHSHSSSLCFPMPPFPPPSLPLPLMLLPPMPPAGQAEFGPFPFVIVPSFTFPNV

SEQ ID NO: 5619 - protein, 124 aa, Homo sapiens
MPAPAATYERVVYKNPSEYHYMKVCLEFQDCGVGLNAAQFKQLLISAVKDLFGEVDAALPLDILTYEEKTLSAILRICSSGLVKLWSSLTLLGSYKGKKCAFRVIQVSPFLLALSGNSRELVLD

SEQ ID NO: 5620 - protein, 124 aa, Homo sapiens; identical to SEQ ID NO: 5619

SEQ ID NO: 5621 - protein, 124 aa, Homo sapiens; identical to SEQ ID NO: 5619

SEQ ID NO: 5622 - protein, 199 aa, Homo sapiens
MENFRKVRSEEAPAGCGAEGGGPGSGPFADLAPGAVHMRVKEGSKIRNLMAFATASMAQPATRAIVFSGCGRATTKTVTCAEILKRRLAGLHQVTRLRYRSVREVWQSLPPGPTQGQTPGEPAASLSVLKNVPGLAILLSKDALDPRQPGYQPPNPHPGPSSPPAAPASKRSLGEPAAGEGSAKRSQPEPGVADEDQTA

SEQ ID NO: 5623 - protein, 199 aa, Homo sapiens; identical to SEQ ID NO: 5622

SEQ ID NO: 5624 - protein, 461 aa, Homo sapiens
MVSRVQLPPEIQLAQRLAGNEQVTRDRAVRKLRKYIVARTQRAAGGFTHDELLKVWKGLFYCMWMQDKPLLQEELGRTISQLVHAFQTTEAQHLFLQAFWQTMNREWTGIDRLRLDKFYMLMRMVLNESLKVLKMQGWEERQIEELLELLMTEILHPSSQAPNGVKSHFIEIFLEELTKVGAEELTADQNLKFIDPFCRIAARTKDSLVLNNITRGIFETIVEQAPLAIEDLLNELDTQDEEVASDSDESSEGGERGDALSQKRSEKPPAGSICRAEPEAGEEQAGDDRDSGGPVLQFDYEAVANRLFEMASRQSTPSQNRKRLYKVIRKLLPWFSGIFPEDEIPEKACRRLLEGRRQKKTKKQKRLLRLQQERGKGEKEPPSPGMERKRSRRRGVGADPEARAEAGEQPGTAERALLRDQPRGRGQRGARQRRRTPRPLTSARAKAANVQEPEKKKKRRE

SEQ ID NO: 5625 - protein, 461 aa, Homo sapiens
MVSRVQLPPEIQLAQRLAGNEQVTRDRAVRKLRKYIVARTQRAAGGFTHDELLKVWKGLFYCMWMQDKPLLQEELGRTISQLVHAFQTTEAQHLFLQAFWQTMNREWTGIDRLRLDKFYMLMRMVLNESLKVLKMQGWEERQIEELLELLMTEILHPSSQAPNGVKSHFIEIFLEELTKVGAEELTADQNLKFIDPFCRIAARTKDSLVLNNITRGIFETIVEQAPLAIEDLLNELDTQDEEVASDSDESSEGGERGDALSQKRSEKPPAGSICRAEPEAGEEQAGDDRDSGGPVLQFDYEAVANRLFEMASRQSTPSQNRKRLYKVIRKLQDLAGGIFPEDEIPEKACRRLLEGRRQKKTKKQKRLLRLQQERGKGEKEPPSPGMERKRSRRRGVGADPEARAEAGEQPGTAERALLRDQPRGRGQRGARQRRRTPRPLTSARAKAANVQEPEKKKKRRE

SEQ ID NO: 5626 - protein, 456 aa, Homo sapiens
MFEEPEWAEAAPVAAGLGPVISRPPPAASSQNKGSKRRQLLATLRALEAASLSQHPPSLCISDSEEEEEERKKKCPKKASFASASAEVGKKGKKKCQKQGPPCSDSEEEVERKKKCHKQALVGSDSAEDEKRKRKCQKHAPINSAQHLDNVDQTGPKAWKGSTTNDPPKQSPGSTSPKPPHTLSRKQWRNRQKNKRRCKNKFQPPQVPDQAPAEAPTEKTEVSPVPRTDSHEARAGALRARMAQRLDGARFRYLNEQLYSGPSSAAQRLFQEDPEAFLLYHRGFQSQVKKWPLQPVDRIARDLRQRPASLVVADFGCGDCRLASSIRNPVHCFDLASLDPRVTVCDMAQVPLEDESVDVAVFCLSLMGTNIRDFLEEANRVLKPGGLLKVAEVSSRFEDVRTFLRAVTKLGFKIVSKDLTNSHFFLFDFQKTGPPLVGPKAQLSGLQLQPCLYKRR

SEQ ID NO: 5627 - protein, 475 aa, Homo sapiens
MSATAAARKRGKPASGAGAGAGAGKRRRKADSAGDRGKSKGGGKMNEEISSDSESESLAPRKPEEEEEEELEETAQEKKLRLAKLYLEQLRQQEEEKAEARAFEEDQVAGRLKEDVLEQRGRLQKLVAKEIQAPASADIRVLRGHQLSITCLVVTPDDSAIFSAAKDCSIIKWSVESGRKLHVIPRAKKGAEGKPPGHSSHVLCMAISSDGKYLASGDRSKLILIWEAQSCQHLYTFTGHRDAVSGLAFRRGTHQLYSTSHDRSVKVWNVAENSYVETLFGHQDAVAALDALSRECCVTAGGRDGTVRVWKIPEESQLVFYGHQGSIDCIHLINEEHMVSGADDGSVALWGLSKKRPLALQREAHGLRGEPGLEQPFWISSVAALLNTDLVATGSHSSCVRLWQCGEGFRQLDLLCDIPLVGFINSLKFSSSGDFLVAGVGQEHRLGRWWRIKEARNSVCIIPLRRVPVPPAAGS

SEQ ID NO: 5628 - protein, 349 aa, Homo sapiens
MAKAGDKSSSSGKKSLKRKAAAEELQEAAGAGDGATENGVQPPKAAAFPPGFSISEIKNKQRRHLMFTRWKQQQRKEKLAAKKKLKKEREALGDKAPPKPVPKTIDNQRVYDETTVDPNDEEVAYDEATDEFASYFNKQTSPKILITTSDRPHGRTVRLCEQLSTVIPNSHVYYRRGLALKKIIPQCIARDFTDLIVINEDRKTPNGLILSHLPNGPTAHFKMSSVRLRKEIKRRGKDPTEHIPEIILNNFTTRLGHSIGRMFASLFPHNPQFIGRQVATFHNQRDYIFFRFHRYIFRSEKKVGIQELGPRFTLKLRSLQKGTFDSKYGEYEWVHKPREMDTSRRKFHL

SEQ ID NO: 5629 - protein, 129 aa, Homo sapiens
MAKAGDKSSSSGKKSLKRKAAAEELQEAAGAGDGATENGVQPPKAAAFPPGFSISEIKNKQRRHLMFTRWKQQQRKEKLAAKKKLKKEREALGDKAPPKPVPKTIDNQRVYDETTVDPNDEEVMLEVLN

SEQ ID NO: 5630 - protein, 208 aa, Homo sapiens
MCFVLKAINFVLQYALKKPYGVLYKKKNITRPFEDQTSLEFFSKKSDCSLFMFGSHNKKRPNNLVIGRMYDYHVLDMIELGIENFVSLKDIKNSKCPEGTKPMLIFAGDDFDVTEDYRRLKSLLIDFFRGPTVSNIRLAGLEYVLHFTALNGKIYFRSYKLLLKKSGCRTPRIELEEMGPSLDLVLRRTHLASDDLYKLSMKMPKALK

SEQ ID NO: 5631 - protein, 214 aa, Homo sapiens
MLIKGGNANATVTKVLKDVYALKKPYGVLYKKKNITRPFEDQTSLEFFSKKSDCSLFMFGSHNKKRPNNLVIGRMYDYHVLDMIELGIENFVSLKDIKNSKCPEGTKPMLIFAGDDFDVTEDYRRLKSLLIDFFRGPTVSNIRLAGLEYVLHFTALNGKIYFRSYKLLLKKSGCRTPRIELEEMGPSLDLVLRRTHLASDDLYKLSMKMPKALK

SEQ ID NO: 5632 - protein, 306 aa, Homo sapiens
MDTLDRVVKPKTKRAKRFLEKREPKLNENIKNAMLIKGGNANATVTKVLKDVYALKKPYGVLYKKKNITRPFEDQTSLEFFSKKSDCSLFMFGSHNKKRPNNLVIGRMYDYHVLDMIELGIENFVSLKDIKNSKCPEGTKPMLIFAGDDFDVTEDYRRLKSLLIDFFRGPTVSNIRLAGLEYVLHFTALNGKIYFRSYKLLLKKSGCRTPRIELEEMGPSLDLVLRRTHLASDDLYKLSMKMPKALKPKKKKNISHDTFGTTYGRIHMQKQDLSKLQTRKMKGLKKRPAERITEDHEKKSKRIKKN

SEQ ID NO: 5633 - protein, 181 aa, Homo sapiens
MSGIGNKRAAGEPGTSMPPEKKAAVEDSGTTVETIKLGGVSSTEELDIRTLQTKNRKLAEMLDQRQAIEDELREHIEKLERRQATDDASLLIVNRYWSQFDENIRIILKRYDLEQGLGDLLTERKALVVPEPEPDSDSNQERKDDRERGEGQEPAFSFLATLASSSSEEMESQLQERVESS

SEQ ID NO: 5634 - protein, 975 aa, Homo sapiens
MSGIGNKRAAGEPGTSMPPEKKAAVEDSGTTVETIKLGGVSSTEELDIRTLQTKNRKLAEMLDQRQAIEDELREHIEKLERRQATDDASLLIVNRYWSQFDENIRIILKRYDLEQGLGDLLTERKALVVPEPEPDSDSNQERKDDRERGEGQEPAFSFLATLASSSSEEMESQLQERVESSRRAVSQIVTVYDKLQEKVELLSRKLNSGDNLIVEEAVQELNSFLAQENMRLQELTDLLQEKHRTMSQEFSKLQSKVETAESRVSVLESMIDDLQWDIDKIRKREQRLNRHLAEVLERVNSKGYKVYGAGSSLYGGTITINARKFEEMNAELEENKELAQNRLCELEKLRQDFEEVTTQNEKLKVELRSAVEQVVKETPEYRCMQSQFSVLYNESLQLKAHLDEARTLLHGTRGTHQHQVELIERDEVSLHKKLRTEVIQLEDTLAQVRKEYEMLRIEFEQTLAANEQAGPINREMRHLISSLQNHNHQLKGEVLRYKRKLREAQSDLNKTRLRSGSALLQSQSSTEDPKDEPAELKPDSEDLSSQSSASKASQEDANEIKSKRDEEERERERREKEREREREREKEKEREREKQKLKESEKERDSAKDKEKGKHDDGRKKEAEIIKQLKIELKKAQESQKEMKLLLDMYRSAPKEQRDKVQLMAAEKKSKAELEDLRQRLKDLEDKEKKENKKMADEDALRKIRAVEEQIEYLQKKLAMAKQEEEALLSEMDVTGQAFEDMQEQNIRLMQQLREKDDANFKLMSERIKSNQIHKLLKEEKEELADQVLTLKTQVDAQLQVVRKLEEKEHLLQSNIGTGEKELGLRTQALEMNKRKAMEAAQLADDLKAQLELAQKKLHDFQDEIVENSVTKEKDMFNFKRAQEDISRLRRKLETTKKPDNVPKCDEILMEEIKDYKARLTCPCCNMRKKDAVLTKCFHVFCFECVKTRYDTRQRKCPKCNAAFGANDFHRIYIG

SEQ ID NO: 5635 - protein, 145 aa, Homo sapiens
MSGIGNKRAAGEPGTSMPPEKKAAVEDSGTTVETIKLGGVSSTEELDIRTLQTKNRKLAEMLDQRQAIEDELREHIEKLERRQATDDASLLIVNRYWSQFDENIRIILKRYDLEQGLGDLLTERKALVVPEPEPDSDSNQERKDD

SEQ ID NO: 5636 - protein, 99 aa, Homo sapiens
MSGIGNKRAAGEPGTSMPPEKKAAVEDSGTTVETIKLGGVSSTEELDIRTLQTKNRKLAEMLDQRQAIEDELREHIEKLERRQATDDASLLIVNRYWSQ

SEQ ID NO: 5637 - protein, 625 aa, Homo sapiens
MNVTSIALRAETWLLAAWHVKVPPMWLEACINWIQEENNNVNLSQAQMNKQVFEQWLLTDLRDLEHPLLPDGILEIPKGELNGFYALQINSLVDVSQPAYSQIQKLRGKNTTNDLVTAEAQVTPKPWEAKPSRMLMLQLTDGIVQIQGMEYQPIPILHSDLPPGTKILIYGNISFRLGVLLLKPENVKVLGGEVDALLEEYAQEKVLARLIGEPDLVVSVIPNNSNENIPRVTDVLDPALGPSDEELLASLDENDELTANNDTSSERCFTTGSSSNTIPTRQSSFEPEFVISPRPKEEPSNLSIHVMDGELDDFSLEEALLLEETVQKEQMETKELQPLTFNRNADRSIERFSHNPNTTNNFSLTCKNGNNNWSEKNVSEQMTNEDKSFGCPSVRDQNRSIFSVHCNVPLAHDFTNKEKNLETDNKIKQTSSSDSHSLNNKILNREVVNYVQKRNSQISNENDCNLQSCSLRSSENSINLSIAMDLYSPPFVYLSVLMASKPKEVTTVKVKAFIVTLTGNLSSSGGIWSITAKVSDGTAYLDVDFVDEILTSLIGFSVPEMKQSKKDPLQYQKFLEGLQKCQRDLIDLCCLMTISFNPSLSKAMVLALQDVNMEHLENLKKRLNK

SEQ ID NO: 5638 - protein, 731 aa, Homo sapiens
MPSIPPIPVPPPVPTLPPVPPVPPIPPVPSVPPMTPLPPMSGMPPLNPPPVAPLPAGMNGSGAPMNLNNNLNPMFLGPLNPVNPIQMNSQSSVKPLPINPDDLYVSVHGMPFSAMENDVRDFFHGLRVDAVHLLKDHVGRNNGNGLVKFLSPQDTFEALKRNRMLMIQRYVEVSPATERQWVAAGGHITFKQNMGPSGQTHPPPQTLPRSKSPSGQKRSRSRSPHEAGFCVYLKGLPFEAENKHVIDFFKKLDIVEDSIYIAYGPNGKATGEGFVEFRNEADYKAALCRHKQYMGNRFIQVHPITKKGMLEKIDMIRKRLQNFSYDQREMILNPEGDVNSAKVCAHITNIPFSITKMDVLQFLEGIPVDENAVHVLVDNNGQGLGQALVQFKNEDDARKSERLHRKKLNGREAFVHVVTLEDMREIEKNPPAQGKKGLKMPVPGNPAVPGMPNAGLPGVGLPSAGLPGAGLPSTGLPGSAITSAGLPGAGMPSAGIPSAGGEEHAFLTVGSKEANNGPPFNFPGNFGGSNAFGPPIPPPGLGGGAFGDARPGMPSVGNSGLPGLGLDVPGFGGGPNNLSGPSGFGGGPQNFGNGPGSLGGPPGFGSGPPGLGSAPGHLGGPPAFGPGPGPGPGPGPIHIGGPPGFASSSGKPGPTVIKVQNMPFTVSIDEILDFFYGYQVIPGSVCLKYNEKGMPTGEAMVAFESRDEATAAVIDLNDRPIGSRKVKLVLG

SEQ ID NO: 5639 - protein, 932 aa, Homo sapiens
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVVTATTSVHESNKNIQTFSTASVGTAPPNMGASFGSPTFSSTVPSTASPMNTVPPPPIPPIPAMPSLPPMPSIPPIPVPPPVPTLPPVPPVPPIPPVPSVPPMTPLPPMSGMPPLNPPPVAPLPAGMNGSGAPMNLNNNLNPMFLGPLNPVNPIQMNSQSSVKPLPINPDDLYVSVHGMPFSAMENDVRDFFHGLRVDAVHLLKDHVGRNNGNGLVKFLSPQDTFEALKRNRMLMIQRYVEVSPATERQWVAAGGHITFKQNMGPSGQTHPPPQTLPRSKSPSGQKRSRSRSPHEAGFCVYLKGLPFEAENKHVIDFFKKLDIVEDSIYIAYGPNGKATGEGFVEFRNEADYKAALCRHKQYMGNRFIQVHPITKKGMLEKIDMIRKRLQNFSYDQREMILNPEGDVNSAKVCAHITNIPFSITKMDVLQFLEGIPVDENAVHVLVDNNGQGLGQALVQFKNEDDARKSERLHRKKLNGREAFVHVVTLEDMREIEKNPPAQGKKGLKMPVPGNPAVPGMPNAGLPGVGLPSAGLPGAGLPSTGLPGSAITSAGLPGAGMPSAGIPSAGGEEHAFLTVGSKEANNGPPFNFPGNFGGSNAFGPPIPPPGLGGGAFGDARPGMPSVGNSGLPGLGLDVPGFGGGPNNLSGPSGFGGGPQNFGNGPGSLGGPPGFGSGPPGLGSAPGHLGGPPAFGPGPGPGPGPGPIHIGGPPGFASSSGKPGPTVIKVQNMPFTVSIDEILDFFYGYQVIPGSVCLKYNEKGMPTGEAMVAFESRDEATAAVIDLNDRPIGSRKVKLVLG

SEQ ID NO: 5640 - protein, 932 aa, Homo sapiens; identical to SEQ ID NO: 5639

SEQ ID NO: 5641 - protein, 932 aa, Homo sapiens; identical to SEQ ID NO: 5639

SEQ ID NO: 5642 - protein, 291 aa, Homo sapiens
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVVTATTSVHESNKNIQTFSTASVGTAPPNMGASFGSPTFSSTVPSTASPMNTVPPPPIPPIPAMPSLPPMPSIPPIPVPPPVPTLPPVPPVPPIPPVPSVPPMTPLPPMSGMPPLNPPPVAPLPAGMNGSGAPMNLNNNLNPMFLGPLNPVNPIQMNSQ

SEQ ID NO: 5643 - protein, 143 aa, Homo sapiens
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVVTATTSVHES

SEQ ID NO: 5644 - protein, 134 aa, Homo sapiens
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVV

SEQ ID NO: 5645 - protein, 416 aa, Homo sapiens
MSNKGKKLKRIILAIPPAAPATVAMRPVEAAPSGRQARRRGVGAIIKAGIESAVVVEIGIGIDGEIVGAEVQVGSVVRSRSWDRRHGSESRSRDHRREDRVHYRSPPLATGYRYGHSKSPHFREKSPVREPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 5646 - protein, 405 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSRDHRREDRVHYRSPPLATGEPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 5647 - protein, 439 aa, Homo sapiens
MASDDFDIVIEAMLEAPYKKEEDEQQRKEVKKDYPSNTTSSTSNSGNETSGSSTIGETSKKKRSRSHNKSRDRKRSRSRDRDRYRRRNSRSRSPGRQCRHRSRSWDRRHGSESRSRDHRREDRVHYRSPPLATGYRYGHSKSPHFREKSPVREPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 5648 - protein, 423 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSRDHRREDRVHYRSPPLATGYRYGHSKSPHFREKSPVREPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 5649 - protein, 60 aa, Homo sapiens
MASDDFDIVIEAMLEAPYKKEEDEQQRKEVKKDYPSNTTSSTSNSGNETSGSSTIGETSK

SEQ ID NO: 5650 - protein, 144 aa, Homo sapiens
MASDDFDIVIEAMLEAPYKKEEDEQQRKEVKKDYPSNTTSSTSNSGNETSGSSTIGETSKKKRSRSHNKSRDRKRSRSRDRDRYRRRNSRSRSPGRQCRHRSRSWDRRHGSESRSRDHRREDRVHYRSPPLATGEPVDNLSPEE

SEQ ID NO: 5651 - protein, 75 aa, Homo sapiens
MASDDFDIVIEAMLEAPYKKEEDEQQRKEVKKDYPSNTTSSTSNSGNETSGSSTIGETSKKKRSRSHNKSRDRKR

SEQ ID NO: 5652 - protein, 100 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSR

SEQ ID NO: 5653 - protein, 57 aa, Homo sapiens
MASDDFDIVIEAMLEAPYKKEEDEQQRKEVKKDYPSNTTSSTSNSGNETSGSSTIGE

SEQ ID NO: 5654 - protein, 92 aa, Homo sapiens
MASDDFDIVIEAMLEAPYKKEEDEQQRKEVKKDYPSNTTSSTSNSGNETSGSSTIGETSKKKRSRSHNKSRDRKRSRSRDRDRYRRRNSRSR

SEQ ID NO: 5655 - protein, 66 aa, Homo sapiens
MASDDFDIVIEAMLEAPYKKEEDEQQRKEVKKDYPSNTTSSTSNSGNETSGSSTIGETSNRSRDRD

SEQ ID NO: 5656 - protein, 101 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSRD

SEQ ID NO: 5657 - protein, 91 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDR

SEQ ID NO: 5658 - protein, 211 aa, Homo sapiens
MALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADSSPFRLMLRPCLSISSNTLYCIYRFTIYFWESALASADLEEEIHQKQGQKRKNSQPGVKVADRKILDDTEDTVVSQRKKIQINQEEERLK

SEQ ID NO: 5659 - protein, 430 aa, Homo sapiens
MALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 5660 - protein, 211 aa, Homo sapiens; identical to SEQ ID NO: 5658

SEQ ID NO: 5661 - protein, 357 aa, Homo sapiens
MASVLNVKESKAPERTVVVAGLPVDLFSDQLLAVLVKSHFQDIKNEGGDVEDVIYPTRTKGVAYVIFKEKKVAENVIRQKKHWLARKTRHAELTVSLRVSHFGDKIFSSVNAILDLSVFGKEVTLETLVKDLKKKIPSLSFSPLKPNGRISVEGSFLAVKRLRESLLARACSLLEKDRNFTSEERKWNRQNPQRNLQRSNNSLASVRTLVPETARSGEMLVLDTDVFLYLKHKCGSYESTLKKFHILSQEKVDGEITTICLKSIQVGSQPNNAKHVKELIEEWSHALYLKLRKETFILEGKENREKRMIKRACEQLSSRYLEVLINLYRTHIDIIGSSSDTYLFKKGVMKLIGQKVS

SEQ ID NO: 5662 - protein, 593 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKAGSIRGRGRGAAGNRAPGPRGSYLGGYSAGRGIYSRYHEGKGKQQEKGYELVPNLEIPTVNPVAIKPGTVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAAAAAMYGGYAGYIPQAFPAAAIQVPIPDVYQTY

SEQ ID NO: 5663 - protein, 524 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAAAAAMYGGYAGYIPQAFPAAAIQVPIPDVYQTY

SEQ ID NO: 5664 - protein, 593 aa, Homo sapiens; identical to SEQ ID NO: 5662

SEQ ID NO: 5665 - protein, 524 aa, Homo sapiens; identical to SEQ ID NO: 5663

SEQ ID NO: 5666 - protein, 59 aa, Homo sapiens
MTAEDSTAAMSSDSAAGSSAKVPEGVAGAPNEAALLALMERTGYSMVQENGQRKYGGPP

SEQ ID NO: 5667 - protein, 159 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIP

SEQ ID NO: 5668 - protein, 124 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEA

SEQ ID NO: 5669 - protein, 114 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYA

SEQ ID NO: 5670 - protein, 59 aa, Homo sapiens; identical to SEQ ID NO: 5666

SEQ ID NO: 5671 - protein, 193 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKN

SEQ ID NO: 5672 - protein, 137 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIR

SEQ ID NO: 5673 - protein, 217 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPG

SEQ ID NO: 5674 - protein, 359 aa, Homo sapiens
MVKLFIGNLPREATEQEIRSLFEQYGKVLECDIIKNYGFVHIEDKTAAEDAIRNLHHYKLHGVNINVEASKNKSKASTKLHVGNISPTCTNQELRAKFEEYGPVIECDIVKDYAFVHMERAEDAVEAIRGLDNTEFQGKRMHVQLSTSRLRTAPGMGDQSGCYRCGKEGHWSKECPVDRTGRVADFTEQYNEQYGAVRTPYTMGYGESMYYNDAYGALDYYKRYRVRSYEAVAAAAAASAYNYAEQTMSHLPQVQSTTVTSHLNSTSVDPYDRHLLPNSGAAATSAAMAAAAATTSSYYGRDRSPLRRAAAMLPTVGEGYGYGPESELSQASAATRNSLYDMARYEREQYVDRARYSAF

SEQ ID NO: 5675 - protein, 359 aa, Homo sapiens; identical to SEQ ID NO: 5674

SEQ ID NO: 5676 - protein, 815 aa, Homo sapiens
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTGVSRGFAFVEFYHLQDATSWMEANQKKLVIQGKHIAMHYSNPRPKFEDWLCNKCCLNNFRKRLKCFRCGADKFDSEQEVPPGTTESVQSVDYYCDTIILRNIAPHTVVDSIMTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 5677 - protein, 120 aa, Homo sapiens
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMES

SEQ ID NO: 5678 - protein, 105 aa, Homo sapiens
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGL

SEQ ID NO: 5679 - protein, 137 aa, Homo sapiens
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTG

SEQ ID NO: 5680 - protein, 143 aa, Homo sapiens
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTGESLLSS

SEQ ID NO: 5681 - protein, 126 aa, Homo sapiens
MGSDKRVSRTERSGRYGSIIDRDDRDERESRSRRRDSDYKRSSDDRRGDRYDDYRDYDSPENDKYSRNDGVLRRPSACGCEADEEENRCKPWFRLRGVLSLARCYQLDGSQSEKVGDSRKAHCNAL

SEQ ID NO: 5682 - protein, 149 aa, Homo sapiens
GTKCRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTEKVGDSRKAHCNAL

SEQ ID NO: 5683 - protein, 814 aa, Homo sapiens
GTKCRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTGVSRGFAFVEFYHLQDATSWMEANQKKLVIQGKHIAMHYSNPRPKFEDWLCNKCCLNNFRKRLKCFRCGADKFDSEQEVPPGTTESVQSVDYYCDTIILRNIAPHTVVDSIMTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 5684 - protein, 505 aa, Homo sapiens
NGFRSGERDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 5685 - protein, 1123 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 5686 - protein, 142 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTS

SEQ ID NO: 5687 - protein, 601 aa, Homo sapiens
MIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 5688 - protein, 520 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGNSNDPGQRSYPGVCIKPGFLVLQTM

SEQ ID NO: 5689 - protein, 76 aa, Homo sapiens
MWGDSRPANRTGPFRGSQEERFAPGWNRDYPPPPLKSHAQERHSGNFPGRDSLPFDFQGHSGPPFANVEEHSFSYG

SEQ ID NO: 5690 - protein, 601 aa, Homo sapiens; identical to SEQ ID NO: 5687

SEQ ID NO: 5691 - protein, 991 aa, Homo sapiens
MDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 5692 - protein, 465 aa, Homo sapiens
MLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 5693 - protein, 390 aa, Homo sapiens
MVEADRPGKLFIGGLNTETNEKALETVFGKYGRIVEVLLIKDRETNKSRGFAFVTFESPADAKDAARDMNGKSLDGKAIKVEQATKPSFERGRHGPPPPPRSRGPPRGFGAGRGGSGGTRGPPSRGGHMDDGGYSMNFNMSSSRGPLPVKRGPPPRSGGPSPKRSAPSGLVRSSSGMGGRAPLSRGRDSYGGPPRREPLPSRRDVYLSPRDDGYSTKDSYSSRDYPSSRDTRDYAPPPRDYTYRDYGHSSSRDDYPSRGYGDRDGYGRDRDYSDHPSGGSYRDSYESYGNSRSAPLTRGPPPSYGGSSRYDDYSSSRDGYGGSRDSYSSSRSDLYSSCDRVGRQERGLPPSVERGYPSSRDSYSSSSRGAPRGAGPGGSRSDRGGGRSRY

SEQ ID NO: 5694 - protein, 390 aa, Homo sapiens; identical to SEQ ID NO: 5693

SEQ ID NO: 5695 - protein, 496 aa, Homo sapiens
MVEADHPGKLFIGGLNRETNEKMLKAVFGKHGPISEVLLIKDRTSKSRGFAFITFENPADAKNAAKDMNGTSLHGKAIKVEQAKKPSFQSGGRRRPPASSRNRSPSGSLRSARGSSGGTRGWLPSHEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNHRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREAYGSSSYVASIVDGGESRSEKGDSSRY

SEQ ID NO: 5696 - protein, 459 aa, Homo sapiens
MVEADHPGKLFIGGLNRETNEKMLKAVFGKHGPISEVLLIKDRTSKSRGFAFITFENPADAKNAAKDMNGTSLHGKAIKVEQAKKPSFQSGGRRRPPASSRNRSPSGSLRSARGSSGGTRGWLPSHEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNHRSSRETREYAPPSRGHGYRDYGHSRRHESYSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREAYGSSSYVASIVDGGESRSEKGDSSRY

SEQ ID NO: 5697 - protein, 496 aa, Homo sapiens; identical to SEQ ID NO: 5695

SEQ ID NO: 5698 - protein, 496 aa, Homo sapiens; identical to SEQ ID NO: 5695

SEQ ID NO: 5699 - protein, 459 aa, Homo sapiens; identical to SEQ ID NO: 5696

SEQ ID NO: 5700 - protein, 406 aa, Homo sapiens
MGKVWKQQMYPQYATYYYPQYLQAKQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 5701 - protein, 419 aa, Homo sapiens
MGKVWKQQMYPQYATYYYPQYLQAKQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEAGMTLTYDPTTAAIQNGFYPSPYSIATNRMITQTSITPYIASPVSAYQVAKETRENKYRGSAIKVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 5702 - protein, 370 aa, Homo sapiens
MAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEAGMTLTYDPTTAAIQNGFYPSPYSIATNRMITQTSITPYIASPVSAYQVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 5703 - protein, 370 aa, Homo sapiens; identical to SEQ ID NO: 5702

SEQ ID NO: 5704 - protein, 370 aa, Homo sapiens; identical to SEQ ID NO: 5702

SEQ ID NO: 5705 - protein, 128 aa, Homo sapiens
MAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENML

SEQ ID NO: 5706 - protein, 407 aa, Homo sapiens
MLLSVTSRPGISTFGYNRNNKKPYVSLAQQMAPPSPSNSTPNSSSGSNGNDQLSKTNLYIRGLQPGTTDQDLVKLCQPYGKIVSTKAILDKTTNKCKGYGFVDFDSPSAAQKAVTALKASGVQAQMAKQQEQDPTNLYISNLPLSMDEQELEGMLKPFGQVISTRILRDTSGTSRGVGFARMESTEKCEAIITHFNGKYIKTPPGVPAPSDPLLCKFADGGPKKRQNQGKFVQNGRAWPRNADMGVMALTYDPTTALQNGFYPAPYNITPNRMLAQSALSPYLSSPVSSYQRVTQTSPLQVPNPSWMHHHSYLMQPSGSVLTPGMDHPISLQPASMMGPLTQQLGHLSLSSTGTYMPTAAAMQGAYISQYTPVPSSSVSVEESSGQQNQVAVDAPSEHGVYSFQFNK

SEQ ID NO: 5707 - protein, 306 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGAGGGGGGGGSGGGGSGGGGGGGSSRPPAPQENTTSEAGLPQGEARTRDDGDEEGLLTHSEEELEHSQDTDADDGALQ

SEQ ID NO: 5708 - protein, 290 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGAGGGGGGGGSGGGGSGGGGGGGSSRPPAPQENTTSEAGLPQGEARTRDDGDEEGLLTHSEEELEHSQDTDADDGALQ

SEQ ID NO: 5709 - protein, 89 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINM

SEQ ID NO: 5710 - protein, 237 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGAGGGGGGGGSGGGGSGGGGGGGSS

SEQ ID NO: 5711 - protein, 181 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIK

SEQ ID NO: 5712 - protein, 187 aa, Homo sapiens
MTSLTPGCRYSVRVSPQMANRIVDSARSILNKFIPDIYIYTDHMKGVNSGKSPGFGLSLVAETTSGTFLSAELASNPQGQGAAVLPEDLGRNCARLLLEEIYRGGCVDSTNQSLALLLMTLGQQDVSKVLLGPLSPYTIEFLRHLKSFFQIMFKIETKPCGEELKGGDKVLMTCVGIGFSNLSKTLK

SEQ ID NO: 5713 - protein, 187 aa, Homo sapiens; identical to SEQ ID NO: 5712

SEQ ID NO: 5714 - protein, 175 aa, Homo sapiens
MATQAHSLSYAGCNFLRQRLVLSTLSGRPVKIRKIRARDDNPGLRDFEASFIRLLDKITNGSRIEINQTGTTLYYQPGLLYGGSVEHDCSVLRGIGYYLESLLCLAPFMKHPLKIVLRGVTNDQVDPSVSIENKPWCGFCFVSCHNPTCEKKVPYKAQFYYKCILLLLFTLRFRG

SEQ ID NO: 5715 - protein, 373 aa, Homo sapiens
MATQAHSLSYAGCNFLRQRLVLSTLSGRPVKIRKIRARDDNPGLRDFEASFIRLLDKITNGSRIEINQTGTTLYYQPGLLYGGSVEHDCSVLRGIGYYLESLLCLAPFMKHPLKIVLRGVTNDQVDPSVDVLKATALPLLKQFGIDGESFELKIVRRGMPPGGGGEVVFSCPVRKVLKPIQLTDPGKIKRIRGMAYSVRVSPQMANRIVDSARSILNKFIPDIYIYTDHMKGVNSGKSPGFGLSLVAETTSGTFLSAELASNPQGQGAAVLPEDLGRNCARLLLEEIYRGGCVDSTNQSLALLLMTLGQQDVSKVLLGPLSPYTIEFLRHLKSFFQIMFKIETKPCGEELKGGDKVLMTCVGIGFSNLSKTLK

SEQ ID NO: 5716 - protein, 138 aa, Homo sapiens
MTSLTPGCRYSVRVSPQMANRIVDSARSILNKFIPDIYIYTDHMKGVNSGKSPGFGLSLVAETTSGTFLSAELASNPQGQGAAVLPEDLGRNCARLLLEEIYRGGCVDSTNQSLALLLMTLGQQDVSKVLLGPLSPYT

SEQ ID NO: 5717 - protein, 182 aa, Homo sapiens
MPPGGGGEVVFSCPVRKVLKPIQLTDPGKIKRIRGMAYSVRVSPQMANRIVDSARSILNKFIPDIYIYTDHMKGVNSGKSPGFGLSLVAETTSGTFLSAELASNPQGQGAAVLPEDLGRNCARLLLEEIYRGGCVDSTNQSLALLLMTLGQQDVSKVLLGPLSPYTIEFLRHLKSFFQIMFK

SEQ ID NO: 5718 - protein, 187 aa, Homo sapiens; identical to SEQ ID NO: 5712

SEQ ID NO: 5719 - protein, 517 aa, Homo sapiens
MAAPEQPLAISRGCTSSSSLSPPRGDRTLLVRHLPAELTAEEKEDLLKYFGAQSVRVLSDKGRLKHTAFATFPNEKAAIKALTRLHQLKLLGHTLVVEFAKEQDRVHSPCPTSGSEKKKRSDDPVEDDKEKKELGYLTVENGIAPNHGLTFPLNSCLKYMYPPPSSTILANIVNALASVPKFYVQVLHLMNKMNLPTPFGPITARPPMYEDYMPLHAPLPPTSPQPPEEPPLPDEDEELSSEESEYESTDDEDRQRMNKLMELANLQPKRPKTIKQRHVRKKRKIKDMLNTPLCPSHSSLHPVLLPSDVFDQPQPVGNKRIEFHISTDMPAAFKKDLEKEQNCEEKNHDLPATEVDASNIGFGKIFPKPNLDITEEIKEDSDEMPSECISRRELEKGRISREEMETLSVFRSYEPGEPNCRIYVKNLAKHVQEKDLKYIFGRYVDFSSETQRIMFDIRLMKEGRMKGQAFIGLPNEKAAAKALKEANGYVLFGKPMVVQFARSARPKQDPKEGKRKC

SEQ ID NO: 5720 - protein, 128 aa, Homo sapiens
  MOD_RES (1)..(1): Any amino acid
XRRELEKGRISREEMETLSVFRSYEPGEPNCRIYVKNLAKHVQEKDLKYIFGRYVDFSSETQRIMFDIRLMKEGRMKGQAFIGLPNEKAAAKALKEANGYVLFGKPMVVQFARSARPKQDPKEGKRKC

SEQ ID NO: 5721 - protein, 185 aa, Homo sapiens
MAAPEQPLAISRGCTSSSSLSPPRGDRTLLVRHLPAELTAEEKEDLLKYFGAQSVRVLSDKGRLKHTAFATFPNEKAAIKALTRLHQLKLLGHTLVVEFAKEQDRVHSPCPTSGSEKKKRSDDPVEDDKEKKELGYLTVENGIAPNHGLTFPLNSCLKYMYPPPSSTILANIVNALASVPKFYVQ

SEQ ID NO: 5722 - protein, 517 aa, Homo sapiens; identical to SEQ ID NO: 5719

SEQ ID NO: 5723 - protein, 802 aa, Homo sapiens
MFISGRRTADKWRAEERLQCPAGSARAALARCADGGAVGPFKCVFVGEMAAQVGAVRVVRAVAAQEEPDKEGKEKPHAGVSPRGVKRQRRSSSGGSQEKRGRPSQEPPLAPPHRRRRSRQHPGPLPPTNAAPTVPGPVEPLLLPPPPPPSLAPAGPAVAAPLPAPSTSALFTFSPLTVSAAGPKHKGHKERHKHHHHRGPDGDPSSCGTDLKHKDKQENGERTGGVPLIKAPKRETPDENGKTQRADDFVLKKIKKKKKKKHREDMRGRRLKMYNKEVQTVCAGLTRISKEILTQGQINSTSGLNKESFRYLKDEQLCRLNLGMQEYRVPQGVQTPFMTHQEHSIRRNFLKTGTKFSNFIHEEHQSNGGALVLHAYMDELSFLSPMEMERFSEEFLALTFSENEKNAAYYALAIVHGAAAYLPDFLDYFAFNFPNTPVKMEILGKKDIETTTISNFHTQVNRTYCCGTYRAGPMRQISLVGAVDEEVGDYFPEFLDMLEESPFLKMTLPWGTLSSLRLQCRSQSDDGPIMWVRPGEQMIPTADMPKSPFKRRRSMNEIKNLQYLPRTSEPREVLFEDRTRAHADHVGQGFDWQSTAAVGVLKAVQFGEWSDQPRITKDVICFHAEDFTDVVQRLQLDLHEPPVSQCVQWVDEAKLNQMRREGIRYARIQLCDNDIYFIPRNVIHQFKTVSAVCSLAWHIRLKQYHPVVEATQNTESNSNMDCGLTGKRELEVDSQCVRIKTESEEACTEIQLLTTASSSFPPASELNLQQDQKTQPIPVLKVESRLDSDQQHNLQEHSTTSV

SEQ ID NO: 5724 - protein, 846 aa, Homo sapiens
MAEPPSPVHCVAAAAPTATVSEKEPFGKLQLSSRDPPGSLSAKKVRTEEKKAPRRVNGEGGSGGNSRQLQPPAAPSPQSYGSPASWSFAPLSAAPSPSSSRSSFSFSAGTAVPSSASASLSQPVPRKLLVPPTLLHAQPHHLLLPAAAAAASANAKSRRPKEKREKERRRHGLGGAREAGGASREENGEVKPLPRDKIKDKIKERDKEKEREKKKHKVMNEIKKENGEVKILLKSGKEKPKTNIEDLQIKKVKKKKKKKHKENEKRKRPKMYSKSIQTICSGLLTDVEDQAAKGILNDNIKDYVGKNLDTKNYDSKIPENSEFPFVSLKEPRVQNNLKRLDTLEFKQLIHIEHQPNGGASVIHAYSNELSHLSPMEMERFAEEFVGLVFSENENSAAFYVMGIVHGAATYLPDFLDYFSFNFPNSPVKMEILGKKDIETTTMSNFHAQVKRTYSHGTYRAGPMRQISLVGAVDEEVGDYFPEFLDMLEESPFLKCTLPWGTLSSLKLQSRKDSDDGPIMWVRPGEQMIPVADMPKSPFKRKRTTNEIKNLQYLPRTSEPREMLFEDRTRAHADHIGQGFERQTTAAVGVLKAVHCGEWPDQPRITKDVICFHAEDFLEVVQRMQLDLHEPPLSQCVQWVDDAKLNQLRREGIRYARIQLYDNDIYFIPRNVVHQFKTVSAVCSLAWHIRLKLYHSEEDTSQNTATHETGTSSDSTSSVLGPHTDNMICAVSKASLDSVFSDKLHSKYELQQIKHEPIASVRIKEEPVNVNIPEKTTALNNMDGKNVKAKLDHVQFAEFKIDMDSKFENSNKDLKEELCPGNLSLVDTRQHSSAHSNQDKKDDDILC

SEQ ID NO: 5725 - protein, 576 aa, Homo sapiens
MYSKSIQTICSGLLTDVEDQAAKGILNDNIKDYVGKNLDTKNYDSKIPENSEFPFVSLKEPRVQNNLKRLDTLEFKQLIHIEHQPNGGASVIHAYSNELSHLSPMEMERFAEEFVGLVFSENENSAAFYVMGIVHGAATYLPDFLDYFSFNFPNSPVKMEILGKKDIETTTMSNFHAQVKRTYSHGTYRAGPMRQISLVGAVDEEVGDYFPEFLDMLEESPFLKCTLPWGTLSSLKLQSRKDSDDGPIMWVRPGEQMIPVADMPKSPFKRKRTTNEIKNLQYLPRTSEPREMLFEDRTRAHADHIGQGFERQTTAAVGVLKAVHCGEWPDQPRITKDVICFHAEDFLEVVQRMQLDLHEPPLSQCVQWVDDAKLNQLRREGIRYARIQLYDNDIYFIPRNVVHQFKTVSAVCSLAWHIRLKLYHSEEDTSQNTATHETGTSSDSTSSVLGPHTDNMICAVSKASLDSVFSDKLHSKYELQQIKHEPIASVRIKEEPVNVNIPEKTTALNNMDGKNVKAKLDHVQFAEFKIDMDSKFENSNKDLKEELCPGNLSLVDTRQHSSAHSNQDKKDDDILC

SEQ ID NO: 5726 - protein, 604 aa, Homo sapiens
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 5727 - protein, 567 aa, Homo sapiens
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 5728 - protein, 577 aa, Homo sapiens
MPDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 5729 - protein, 567 aa, Homo sapiens; identical to SEQ ID NO: 5727

SEQ ID NO: 5730 - protein, 615 aa, Homo sapiens
MCHPDKAFTSDKLQCVFNEYKAAVWVPPRPRPLSRAPLPEDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 5731 - protein, 120 aa, Homo sapiens
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVN

SEQ ID NO: 5732 - protein, 135 aa, Homo sapiens
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQ

SEQ ID NO: 5733 - protein, 69 aa, Homo sapiens
MPDRTEKHSTMPDSPVDVKTQSRLTPPTMPPPPTTQGAPRTSSFTPTTLTNGTSHSPTALNGAPSPPNG

SEQ ID NO: 5734 - protein, 58 aa, Homo sapiens
MISVKRNTWRALSLVIGDCRKKGNFEYCQGARAQHPASGDAAPAPLMALLSAATHSRT

SEQ ID NO: 5735 - protein, 79 aa, Homo sapiens
MPDRTEKHSTMPDSPVDVKTQSRLTPPTMPPPPTTQGAPRTSSFTPTTLTNGTSHSPTALNGAPSPPNGFSNGPSSSSS

SEQ ID NO: 5736 - protein, 46 aa, Homo sapiens
MPDSPVDVKTQSRLTPPTMPPPPTTQGAPRTSSFTPTTLTNGTSHS

SEQ ID NO: 5737 - protein, 577 aa, Homo sapiens; identical to SEQ ID NO: 5728

SEQ ID NO: 5738 - protein, 54 aa, Homo sapiens
MISVKRNTWRALSLVIGDCRKKGNFEYCQDRTEKHSTMPDSPVDVKTQSRLTPP

SEQ ID NO: 5739 - protein, 229 aa, Homo sapiens
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDS

SEQ ID NO: 5740 - protein, 26 aa, Homo sapiens
MPDRTEKHSTMPDSPVDVKTQSRLTP

SEQ ID NO: 5741 - protein, 169 aa, Homo sapiens
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKL

SEQ ID NO: 5742 - protein, 48 aa, Homo sapiens
MISVKRNTWRALSLVIGDCRKKGNFEYCQDRTEKHSTMPDSPVDVKTQ

SEQ ID NO: 5743 - protein, 91 aa, Homo sapiens
MPDSPVDVKTQSRLTPPTMPPPPTTQGAPRTSSFTPTTLTNGTSHSPTALNGAPSPPNGFSNGPSSSSSSSLANQQLPPACGARQLSKLKR

SEQ ID NO: 5744 - protein, 120 aa, Homo sapiens
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGA

SEQ ID NO: 5745 - protein, 567 aa, Homo sapiens; identical to SEQ ID NO: 5727

SEQ ID NO: 5746 - protein, 85 aa, Homo sapiens
MISVKRNTWRALSLVIGDCRKKGNFEYCQDRTEKHSTMPDSPVDVKTQSRLTPPTMPPPPTTQGAPRTSSFTPTTLTNGTSHSPT

SEQ ID NO: 5747 - protein, 171 aa, Homo sapiens
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPA

SEQ ID NO: 5748 - protein, 89 aa, Homo sapiens
MPDSPVDVKTQSRLTPPTMPPPPTTQGAPRTSSFTPTTLTNGTSHSPTALNGAPSPPNGFSNGPSSSSSSSLANQQLPPACGARQLSKL

SEQ ID NO: 5749 - protein, 94 aa, Homo sapiens
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPP

SEQ ID NO: 5750 - protein, 101 aa, Homo sapiens
MPDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKR

SEQ ID NO: 5751 - protein, 156 aa, Homo sapiens
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLV

SEQ ID NO: 5752 - protein, 120 aa, Homo sapiens; identical to SEQ ID NO: 5744

SEQ ID NO: 5753 - protein, 604 aa, Homo sapiens; identical to SEQ ID NO: 5726

SEQ ID NO: 5754 - protein, 1034 aa, Homo sapiens
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 5755 - protein, 603 aa, Homo sapiens
MSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 5756 - protein, 100 aa, Homo sapiens
GVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 5757 - protein, 183 aa, Homo sapiens
MNGFSTEEDSREGPPAAPAAAAPGYGQSCCLIEDGERCVRPAGNASFSKRVQKSISQKKLKLDIDKSVRHLYICDFHKNFIQSVRNKRKRKTSDDGGDSPEHDTDIPEVDLFQLQVNTLRRYKRHYKLQTRPGFNKAQLAETVSRHFRNIPVNEKETLAYFIYMVKSNKSRLDQKSEGGKQLE

SEQ ID NO: 5758 - protein, 137 aa, Homo sapiens
MNGFSTEEDSREGPPAAPAAAAPGYGQSCCLIEDGERCVRPAGNASFSKRVQKSISQKKLKLDIDKSLQVNTLRRYKRHYKLQTRPGFNKAQLAETVSRHFRNIPVNEKETLAYFIYMVKSNKSRLDQKSEGGKQLE

SEQ ID NO: 5759 - protein, 142 aa, Homo sapiens
MNGFSTEEDSREGPPAAPAAAAPGYGQSCCLIEDGERCVRPAGNASFSKRVQKSISQKKLKLDIDKSVDLFQLQVNTLRRYKRHYKLQTRPGFNKAQLAETVSRHFRNIPVNEKETLAYFIYMVKSNKSRLDQKSEGGKQLE

SEQ ID NO: 5760 - protein, 179 aa, Homo sapiens
MAATEPILAATGSPAAVPPEKLEGAGSSSAPERNCVGSSLPEASPPAPEPSSPNAAVPEAIPTPRAAASAALELPLGPAPVSVAPQAEAEARSTPGPAGSRLGPETFRQRFRQFRYQDAAGPREAFRQLRELSRQWLRPDIRTKEQIVEMLVQEQLLAILPEAARARRIRRRTDVRITG

SEQ ID NO: 5761 - protein, 179 aa, Homo sapiens; identical to SEQ ID NO: 5760

SEQ ID NO: 5762 - protein, 1325 aa, Homo sapiens
MEAVSRVFPALAGQAPEEQGEIIKVKVKEEDHTWDQESALRRNLSYTRELSRQRFRQFCYQETPGPREALSQLRELCRQWLNPEIHTKEQILELLVLEQFLTILPEELQSWVREHNPESGEEVVTLLEDLERELDEPRQQVSQGTYGQEVSMEEMIPLDSAKESLGTQLQSMEDRMECESPEPHPLQDNGSFLWFSMMSQSMGGDNLSSLDTNEAEIEPENMREKFFRSLARLLENKSNNTKIFSKAKYCQLIKEVKEAKAKAKKESVDYRRLARFDVILVQGNEKLIEAVNGETDKIRYYLHSEDLFDILHNTHLSIGHGGRTRMEKELQAKYKNITKEVIMLYLTLCKPCQQKNSKLKKVLTSKSIKEVSSRCQVDLIDMQLNPDGEYRFILHYQDLCTKLTFLRSLKSKRPTEVAHALLDIFTIIGAPSVLQSDNGREFSSQVVSELSNIWPELKIVHGKSQTCQSQSSAEQTEDIRKRIFSWMQTNNSSHWTEFLWFIQMSQNQPYHRSMQQTPCESAFSSEAKLGLSHSQLTEELVASLHTENELDQADKELENTLRAQYEENIETGTDSSDIEENLSVTPKVAEKSPPESRLRFLSCVVCEKECTGVNSCISCDGNIHAICGVPSQHGTEGCGRQITCSLCYETSTMKRKHDEIQRSLPVKPSKMLKPSGTPFSPDKVGDWMAKQASLDFFVKKRHAFSEHSSSNKRNVNNRSYPEEGKTKRVHASFTRKYDPSYIEFGFVAVIDGEVLKPQCIICGDVLANEAMKPSKLKRHLYSKHKEISSQPKEFFERKSSELKSQPKQVFNVSHINISALRASYKVALPVAKSKTPYTIAETLVKDCIKEVCLEMLGESAAKKVAQVPLSNDTIARRIQELANDMEDQLIEQIKLAKYFSLQLDECRDIANMIILLVYVRFEHDDDIKEEFFFSASLPTNTTSSELYEAVKNYIVNKCGLEFKFCVGVCSDGAASMTGKHSEVVTQIKELAPECKTTHCFIHRESLAMKKISAELNSVLNDIVKIVNYIKSNSLNSRLFSLLCDNMEADHKQLLLHAEIRWLSRGKVLSRMFEIRNELLVFLQGKKPMWSQLFKDVNWTARLAYLSDIFSIFNDLNASMQGKNATYFSMADKVEGQKQKLEAWKNRISTDCYDMFHNLTTIINEVGNDLDIAHLRKVISEHLTNLLECFEFYFPSKEDPRIGNLWIQNPFLSSKDNLNLTVTLQDKLLKLATDEGLKISFENTASLPSFWIKAKNDYPELAEIALKLLLLFPSTYLCETGFSTLSVIKTKHRNSLNIHYPLRVALSSIQPRLDKLTSKKQAHLSH

SEQ ID NO: 5763 - protein, 901 aa, Homo sapiens
MEANQCPLVVEPSYPDLVINVGEVTLGEENRKKLQKIQRDQEKERVMRAACALLNSGGGVIRMAKKVEHPVEMGLDLEQSLRELIQSSDLQAFFETKQQGRCFYIFVKSWSSGPFPEDRSVKPRLCSLSSSLYRRSETSVRSMDSREAFCFLKTKRKPKILEEGPFHKIHKGVYQELPNSDPADPNSDPADLIFQKDYLEYGEILPFPESQLVEFKQFSTKHFQEYVKRTIPEYVPAFANTGGGYLFIGVDDKSREVLGCAKENVDPDSLRRKIEQAIYKLPCVHFCQPQRPITFTLKIVNVLKRGELYGYACMIRVNPFCCAVFSEAPNSWIVEDKYVCSLTTEKWVGMMTDTDPDLLQLSEDFECQLSLSSGPPLSRPVYSKKGLEHKKELQQLLFSVPPGYLRYTPESLWRDLISEHRGLEELINKQMQPFFRGILIFSRSWAVDLNLQEKPGVICDALLIAQNSTPILYTILREQDAEGQDYCTRTAFTLKQKLVNMGGYTGKVCVRAKVLCLSPESSAEALEAAVSPMDYPASYSLAGTQHMEALLQSLVIVLLGFRSLLSDQLGCEVLNLLTAQQYEIFSRSLRKNRELFVHGLPGSGKTIMAMKIMEKIRNVFHCEAHRILYVCENQPLRNFISDRNICRAETRKTFLRENFEHIQHIVIDEAQNFRTEDGDWYGKAKSITRRAKGGPGILWIFLDYFQTSHLDCSGLPPLSDQYPREELTRIVRNADPIAKYLQKEMQVIRSNPSFNIPTGCLEVFPEAEWSQGVQGTLRIKKYLTVEQIMTCVADTCRRFFDRGYSPKDVAVLVSTAKEVEHYKYELLKAMRKKRVVQLSDACDMLGDHIVLDSVRRFSGLERSIVFGIHPRTADPAILPNVLICLASRAKQHLYIFPWGGH

SEQ ID NO: 5764 - protein, 901 aa, Homo sapiens; identical to SEQ ID NO: 5763

SEQ ID NO: 5765 - protein, 90 aa, Homo sapiens
MEANQCPLVVEPSYPDLVINVGEVTLGEENRKKLQKIQRDQEKERVMRAACALLNSGGGVIRMAKKVEHPVEMGLDLEQSLRELIQSSDL

SEQ ID NO: 5766 - protein, 90 aa, Homo sapiens; identical to SEQ ID NO: 5765

SEQ ID NO: 5767 - protein, 90 aa, Homo sapiens; identical to SEQ ID NO: 5765

SEQ ID NO: 5768 - protein, 201 aa, Homo sapiens
MSFATLRPAPPGRYLYPEVSPLSEDEDRGSDSSGSDEKPCRVHAARCGLQGARRRAGGRRAGGGGPGGRPGREPRQRHTANARERDRTNSVNTAFTALRTLIPTEPADRKLSKIETLRLASSYISHLGNVLLAGEACGDGQPCHSGPAFFHAARAGSPPPPPPPPPARDGENTQPKQICTFCLSNQRKLSKDRDRKTAIRS

SEQ ID NO: 5769 - protein, 823 aa, Homo sapiens
MNGEQQLDADAGSGMEEVELSWEDYLEETGSTAVPYGSFKHVDTRLQNGFAPGMKLEVAVRTDPETYWVATVITTCEQLLLLRYDGYGEDRRADFWCDIRKADLYPIGWCEQNKKTLEAPEGIRDKVSDWDEFLRQTLIGACSPPVPLLEGLRNGRNPLDLIAPGSRLECQAFQDSLSTWIVTVVENIGGRLKLRYEGLESSDNYEHWLYYLDPFLHHVGWAAQQGYELQPPSAIRHLKNEAEWQEILAKVKEEEEEPLPSYLFKDKQVIGIHTFSVNMKLEAVDPWSPFGISPATVVKVFDEKYFLVEMDDLRPENHARRSFVCHADSPGIFPVQWSLKNGLHISPPPGYPSQDFDWADYLKQCGAEAAPQRCFPPLISEHEFKENMKLEAVNPILPEEVCVATITAVRGSYLWLQLEGSKKPIPECIVSVESMDIFPLGWCETNGHPLSTPRRARVYKQRKIAVVQPEKQVPSSRTVHEGLRNQELNSTESVMINGKYCCPKIYFNHRCFSGPYLNKGRIAELPQCVGPGNCVLVLREVLTLLINAAYKPSRVLRELQLDKDSVWHGCGEVLKAKYKGKSYRATVEIVKTADRVTEFCRQTCIKLECCPNLFGPRMVLDKCSENCSVLTKTKYTHYYGKKKNKRIGRPPGGHSNLACALKKASKRRKRRKNVFVHKKKRSSASVDNTPAGSPQGSGGEDEDDPDEGDDDSLSEGSTSEQQDELQEESEMSEKKSCSSSPTQSEISTSLPPDRQRRKRELRTFSFSDDENKPPSPKEIDGQALLLLTLPTVQECMDLKLGPAIKLCHHIERIKFAFYEQFAN

SEQ ID NO: 5770 - protein, 866 aa, Homo sapiens
MNGEQQLDADAGSGMEEVELSWEDYLEETGSTAVPYGSFKHVDTRLQNGFAPGMKLEVAVRTDPETYWVATVITTCEQLLLLRYDGYGEDRRADFWCDIRKADLYPIGWCEQNKKTLEAPEGIRDKVSDWDEFLRQTLIGACSPPVPLLEGLRNGRNPLDLIAPGSRLECQAFQDSLSTWIVTVVENIGGRLKLRYEGLESSDNYEHWLYYLDPFLHHVGWAAQQGYELQPPSAIRHLKNEAEWQEILAKVKEEEEEPLPSYLFKDKQVIGIHTFSVNMKLEAVDPWSPFGISPATVVKVFDEKYFLVEMDDLRPENHARRSFVCHADSPGIFPVQWSLKNGLHISPPPGYPSQDFDWADYLKQCGAEAAPQRCFPPLISEHEFKENMKLEAVNPILPEEVCVATITAVRGSYLWLQLEGSKKPIPECIVSVESMDIFPLGWCETNGHPLSTPRRARVYKQRKIAVVQPEKQVPSSRTVHEGLRNQELNSTESVMINGKYCCPKIYFNHRCFSGPYLNKGRIAELPQCVGPGNCVLVLREVLTLLINAAYKPSRVLRELQLDKDSVWHGCGEVLKAKYKGKSYRATVEIVKTADRVTEFCRQTCIKLECCPNLFGPRMVLDKCSENCSVLTKTKYTHYYGKKKNKRIGRPPGGHSNLACALKKASKRRKRRKNVFVHKKKRSSASVDNTPAGSPQGSGGEDEDDPDEGDDDSLSEGSTSEQQDELQEESEMSEKKSCSSSPTQSEISTSLPPDRQRRKRELRTFSFSDDENKPPSPKEIRIEVAERLHLDSNPLKWSVADVVRFIRSTDCAPLARIFLDQEIDGQALLLLTLPTVQECMDLKLGPAIKLCHHIERIKFAFYEQFAN

SEQ ID NO: 5771 - protein, 866 aa, Homo sapiens; identical to SEQ ID NO: 5770

SEQ ID NO: 5772 - protein, 866 aa, Homo sapiens; identical to SEQ ID NO: 5770

SEQ ID NO: 5773 - protein, 121 aa, Homo sapiens
MNGEQQLDADAGSGMEEVELSWEDYLEETGSTAVPYGSFKHVDTRLQNGFAPGMKLEVAVRTDPETYWVATVITTCEQLLLLRYDGYGEDRRADFWCDIRKADLYPIGWCEQNKKTLEAPE

SEQ ID NO: 5774 - protein, 94 aa, Homo sapiens
MNGEQQLDADAGSGMEEVELSWEDYLEETGSTAVPYGSFKHVDTRLQNGFAPGMKLEVAVRTDPETYWVATVITTCEQLLLLRYDGYGEDRRAD

SEQ ID NO: 5775 - protein, 50 aa, Homo sapiens
MNGEQQLDADAGSGMEEVELSWEDYLEETGSTAVPYGSFKHVDTRLQNGF

SEQ ID NO: 5776 - protein, 894 aa, Homo sapiens
MESTLSASNMQDPSSSPLEKCLGSANGNGDLDSEEGSSLEETGFNWGEYLEETGASAAPHTSFKHVEISIQSNFQPGMKLEVANKNNPDTYWVATIITTCGQLLLLRYCGYGEDRRADFWCDVVIADLHPVGWCTQNNKVLMPPDAIKEKYTDWTEFLIRDLTGSRTAPANLLEGPLRGKGPIDLITVGSLIELQDSQNPFQYWIVSVIENVGGRLRLRYVGLEDTESYDQWLFYLDYRLRPVGWCQENKYRMDPPSEIYPLKMASEWKCTLEKSLIDAAKFPLPMEVFKDHADLRSHFFTVGMKLETVNMCEPFYISPASVTKVFNNHFFQVTIDDLRPEPSKLSMLCHADSLGILPVQWCLKNGVSLTPPKGYSGQDFDWADYHKQHGAQEAPPFCFRNTSFSRGFTKNMKLEAVNPRNPGELCVASVVSVKGRLMWLHLEGLQTPVPEVIVDVESMDIFPVGWCEANSYPLTAPHKTVSQKKRKIAVVQPEKQLPPTVPVKKIPHDLCLFPHLDTTGTVNGKYCCPQLFINHRCFSGPYLNKGRIAELPQSVGPGKCVLVLKEVLSMIINAAYKPGRVLRELQLVEDPHWNFQEETLKAKYRGKTYRAVVKIVRTSDQVANFCRRVCAKLECCPNLFSPVLISENCPENCSIHTKTKYTYYYGKRKKISKPPIGESNPDSGHPKPARRRKRRKSIFVQKKRRSSAVDFTAGSGEESEEEDADAMDDDTASEETGSELRDDQTDTSSAEVPSARPRRAVTLRSGSEPVRRPPPERTRRGRGAPAASSAEEGEKCPPTKPEGTEDTKQEEEERLVLESNPLEWTVTDVVRFIKLTDCAPLAKIFQEQDIDGQALLLLTLPTVQECMELKLGPAIKLCHQIERVKVAFYAQYAN

SEQ ID NO: 5777 - protein, 160 aa, Homo sapiens
MESTLSASNMQDPSSSPLEKCLGSANGNGDLDSEEGSSLEETGFNWGEYLEETGASAAPHTSFKHVEISIQSNFQPGMKLEVANKNNPDTYWVATIITTCGQLLLLRYCGYGEDRRADFWCDVVIADLHPVGWCTQNNKVLMPPDVESDVKPSASVQHIS

SEQ ID NO: 5778 - protein, 186 aa, Homo sapiens
MESTLSASNMQDPSSSPLEKCLGSANGNGDLDSEEGSSLEETGFNWGEYLEETGASAAPHTSFKHVEISIQSNFQPGMKLEVANKNNPDTYWVATIITTCGQLLLLRYCGYGEDRRADFWCDVVIADLHPVGWCTQNNKVLMPPDAIKEKYTDWTEFLIRDLTGSRTAPANLLEGVCIVVIHLMYL

SEQ ID NO: 5779 - protein, 160 aa, Homo sapiens; identical to SEQ ID NO: 5777

SEQ ID NO: 5780 - protein, 894 aa, Homo sapiens; identical to SEQ ID NO: 5776

SEQ ID NO: 5781 - protein, 307 aa, Homo sapiens
MPRSFLVKKIKGDGFQCSGVPAPTYHPLETAYVLPGARGPPGDNGYAPHRLPPSSYDADQKPGLELAPAEPAYPPAAPEEYSDPESPQSSLSARYFRGEAAVTDSYSMDAFFISDGRSRRRRGGGGGDAGGSGDAGGAGGRAGRAGAQAGGGHRHACAECGKTYATSSNLSRHKQTHRSLDSQLARKCPTCGKAYVSMPALAMHLLTHNLRHKCGVCGKAFSRPWLLQGHMRSHTGEKPFGCAHCGKAFADRSNLRAHMQTHSAFKHYRCRQCDKSFALKSYLHKHCEAACAKAAEPPPPTPAGPAS

SEQ ID NO: 5782 - protein, 687 aa, Homo sapiens
MSNRNNNKLPSNLPQLQNLIKRDPPAYIEEFLQQYNHYKSNVEIFKLQPNKPSKELAELVMFMAQISHCYPEYLSNFPQEVKDLLSCNHTVLDPDLRMTFCKALILLRNKNLINPSSLLELFFELFRCHDKLLRKTLYTHIVTDIKNINAKHKNNKVNVVLQNFMYTMLRDSNATAAKMSLDVMIELYRRNIWNDAKTVNVITTACFSKVTKILVAALTFFLGKDEDEKQDSDSESEDDGPTARDLLVQYATGKKSSKNKKKLEKAMKVLKKQKKKKKPEVFNFSAIHLIHDPQDFAEKLLKQLECCKERFEVKMMLMNLISRLVGIHELFLFNFYPFLQRFLQPHQREVTKILLFAAQASHHLVPPEIIQSLLMTVANNFVTDKNSGEVMTVGINAIKEITARCPLAMTEELLQDLAQYKTHKDKNVMMSARTLIHLFRTLNPQMLQKKFRGKPTEASIEARVQEYGELDAKDYIPGAEVLEVEKEENAENDEDGWESTSLSEEEDADGEWIDVQHSSDEEQQEISKKLNSMPMEERKAKAAAISTSRVLTQEDFQKIRMAQMRKELDAAPGKSQKRKYIEIDSDEEPRGELLSLRDIERLHKKPKSDKETRLATAMAGKTDRKEFVRKKTKTNPFSSSTNKEKKKQKNFMMMRYSQNVRSKNKRSFREKQLALRDALLKKRKRMK

SEQ ID NO: 5783 - protein, 261 aa, Homo sapiens
MSRYTRPPNTSLFIRNVADATRPEDLRREFGRYGPIVDVYIPLDFYTRRPRGFAYVQFEDVRDAEDALYNLNRKWVCGRQIEIQFAQGDRKTPGQMKSKERHPCSPSDHRRSRSPSQRRTRSRSSSWGRNRRRSDSLKESRHRRFSYSQSKSRSKSLPRRSTSARQSRTPRRNFGSRGRSRSKSLQKRSKSIGKSQSSSPQKQTSSGTKSRSHGRHSDSIARSPCKSPKGYTNSETKVQTAKHSHFRSHSRSRSYRHKNSW

SEQ ID NO: 5784 - protein, 414 aa, Homo sapiens
MIPLEKPGSGGSSPGATSGSGRAGRGLSGPCRPPPPPQARGLLTEIRAVVRTEPFQDGYSLCPGRELGRGKFAVVRKCIKKDSGKEFAAKFMRKRRKGQDCRMEIIHEIAVLELAQDNPWVINLHEVYETASEMILVLEYAAGGEIFDQCVADREEAFKEKDVQRLMRQILEGVHFLHTRDVVHLDLKPQNILLTSESPLGDIKIVDFGLSRILKNSEELREIMGTPEYVAPEILSYDPISMATDMWSIGVLTYVMLTGISPFLGNDKQETFLNISQMNLSYSEEEFDVLSESAVDFIRTLLVKKPEDRATAEECLKHPWLTQSSIQEPSFRMEKALEEANALQEGHSVPEINSDTDKSETKESIVTEELIVVTSYTLGQCRQSEKEKMEQKAISKRFKFEEPLLQEIPGEFIY

SEQ ID NO: 5785 - protein, 353 aa, Homo sapiens
MSLHTQYLESFLRSQFYMLRMDGPLPLPYRHYIAIMKLVKTGENNWSLPELVHAVVLLAHYHALASFVFGSGINPERDPEISNGFRLISVNNFCVCDLANDNNIENASLSGSNFGIVDSLSELEALMERMKRLQEEREDEEASQEEMSTRFEKEKKESLFVVSGDTFHSFPHSDFEDDMIITSDVSRYIEDPGFGYEDFARRGEEHLPTFRAQDYTWENHGFSLVNRLYSDIGHLLDEKFRMVYNLTYNTMATHEDVDTTMLRRALFNYVHCMFGIRYDDYDYGEVNQLLERSLKVYIKTVTCYPERTTKRMYDSYWRQFKHSEKVHVNLLLMEARMQAELLYALRAITRHLT

SEQ ID NO: 5786 - protein, 317 aa, Homo sapiens
MNRGGGSPSAAANYLLCTNCRKVLRKDKRIRVSQPLTRGPSAFIPEKEVVQANTVDERTNFLVEEYSTSGRLDNITQVMSLHTQYLESFLRSQFYMLRMDGPLPLPYRHYIAIMAAARHQCSYLINMHVDEFLKTGGIAEWLNGLEYVPQRLKNLNEINKLLAHRPWLITKEHIQKLVKTGENNWSLPELVHAVVLLAHYHALASFVFGSGINPERDPEISNGFRLISVNNFCVCDLANDNNIENASLSGSNFGIVDSLSELEALMERMKRLQEEREDEEASQEEMSTRFEKEKKESLFVVSGDTFHSFPHSGLLKY

SEQ ID NO: 5787 - protein, 321 aa, Homo sapiens
MNRGGGSPSAAANYLLCTNCRKVLRKDKRIRVSQPLTRGPSAFIPEKEVVQANTVDERTNFLVEEYSTSGRLDNITQVMSLHTQYLESFLRSQFYMLRMDGPLPLPYRHYIAIMAAARHQCSYLINMHVDEFLKTGGIAEWLNGLEYVPQRLKNLNEINKLLAHRPWLITKEHIQKLVKTGENNWSLPELVHAVVLLAHYHALASFVFGSGINPERDPEISNGFRLISVNNFCVCDLANDNNIENASLSGSNFGIVDSLSELEALMERMKRLQEEREDEEASQEEMSTRFEKEKKESLFVVSGDTFHSFPHSGAFLHFFAF

SEQ ID NO: 5788 - protein, 492 aa, Homo sapiens
MNRGGGSPSAAANYLLCTNCRKVLRKDKRIRVSQPLTRGPSAFIPEKEVVQANTVDERTNFLVEEYSTSGRLDNITQVMSLHTQYLESFLRSQFYMLRMDGPLPLPYRHYIAIMAAARHQCSYLINMHVDEFLKTGGIAEWLNGLEYVPQRLKNLNEINKLLAHRPWLITKEHIQKLVKTGENNWSLPELVHAVVLLAHYHALASFVFGSGINPERDPEISNGFRLISVNNFCVCDLANDNNIENASLSGSNFGIVDSLSELEALMERMKRLQEEREDEEASQEEMSTRFEKEKKESLFVVSGDTFHSFPHSDFEDDMIITSDVSRYIEDPGFGYEDFARRGEEHLPTFRAQDYTWENHGFSLVNRLYSDIGHLLDEKFRMVYNLTYNTMATHEDVDTTMLRRALFNYVHCMFGIRYDDYDYGEVNQLLERSLKVYIKTVTCYPERTTKRMYDSYWRQFKHSEKVHVNLLLMEARMQAELLYALRAITRHLT

SEQ ID NO: 5789 - protein, 296 aa, Homo sapiens
MGKKSRVKTQKSGTGATATVSPKEILNLTSELLQKCSSPAPGPGKEWEEYVQIRTLVEKIRKKQKGLSVTFDGKREDYFPDLMKWASENGASVEGFEMVNFKEEGFGLRATRDIKAEELFLWVPRKLLMTVESAKNSVLGPLYSQDRILQAMGNIALAFHLLCERASPNSFWQPYIQTLPSEYDTPLYFEEDEVRYLQSTQAIHDVFSQYKNTARQYAYFYKVIQTHPHANKLPLKDSFTYEDYRWAVSSVMTRQNQIPTEDGSRVTLALIPLWDMCNHTNGLTPEDSFALAVASA

SEQ ID NO: 5790 - protein, 594 aa, Homo sapiens
MGKKSRVKTQKSGTGATATVSPKEILNLTSELLQKCSSPAPGPGKEWEEYVQIRTLVEKIRKKQKGLSVTFDGKREDYFPDLMKWASENGASVEGFEMVNFKEEGFGLRATRDIKAEELFLWVPRKLLMTVESAKNSVLGPLYSQDRILQAMGNIALAFHLLCERASPNSFWQPYIQTLPSEYDTPLYFEEDEVRYLQSTQAIHDVFSQYKNTARQYAYFYKVIQTHPHANKLPLKDSFTYEDYRWAVSSVMTRQNQIPTEDGSRVTLALIPLWDMCNHTNGLITTGYNLEDDRCECVALQDFRAGEQIYIFYGTRSNAEFVIHSGFFFDNNSHDRVKIKLGVSKSDRLYAMKAEVLARAGIPTSSVFALHFTEPPISAQLLAFLRVFCMTEEELKEHLLGDSAIDRIFTLGNSEFPVSWDNEVKLWTFLEDRASLLLKTYKTTIEEDKSVLKNHDLSVRAKMAIKLRLGEKEILEKAVKSAAVNREYYRQQMEEKAPLPKYEESNLGLLESSVGDSRLPLVLRNLEEEAGVQDALNIREAISKAKATENGLVNGENSIPNGTRSENESLNQESKRAVEDAKGSSSDSTAGVKE

SEQ ID NO: 5791 - protein, 473 aa, Homo sapiens
MATQAKRPRVAGPVDGGDLDPVACFLSWCRRVGLELSPKVSERAGGRRTRGGARAALTSPPAQVAVSRQGTVAGYGMVARESVQAGELLFVVPRAALLSQHTCSIGGLLERERVALQSQSGWVPLLLALLHELQAPASRWRPYFALWPELGRLEHPMFWPEEERRCLLQGTGVPEAVEKDLANIRSEYQSIVLPFMEAHPDLFSLRVRSLELYHQLVALVMAYSFQEPLEEEEDEKEPNSPVMVPAADILNHLANHNANLEYSANCLRMVATQPIPKGHEIFNTYGQMANWQLIHMYGFVEPYPDNTDDTADIQMVTVREAALQGTKTEAERHLVYERWDFLCKLEMVGEEGAFVIGREEVLTEEELTTTLKVLCMPAEEFRELKDQDGGGDDKREEGSLTITNIPKLKASWRQLLQNSVLLTLQTYATDLKTDQGLLSNKEVYAKLSWREQQALQVRYGQKMILHQLLELTS

SEQ ID NO: 5792 - protein, 449 aa, Homo sapiens
MATQAKRPRVAGPVDGGDLDPVACFLSWCRRVGLELSPKVAVSRQGTVAGYGMVARESVQAGELLFVVPRAALLSQHTCSIGGLLERERVALQSQSGWVPLLLALLHELQAPASRWRPYFALWPELGRLEHPMFWPEEERRCLLQGTGVPEAVEKDLANIRSEYQSIVLPFMEAHPDLFSLRVRSLELYHQLVALVMAYSFQEPLEEEEDEKEPNSPVMVPAADILNHLANHNANLEYSANCLRMVATQPIPKGHEIFNTYGQMANWQLIHMYGFVEPYPDNTDDTADIQMVTVREAALQGTKTEAERHLVYERWDFLCKLEMVGEEGAFVIGREEVLTEEELTTTLKVLCMPAEEFRELKDQDGGGDDKREEGSLTITNIPKLKASWRQLLQNSVLLTLQTYATDLKTDQGLLSNKEVYAKLSWREQQALQVRYGQKMILHQLLELTS

SEQ ID NO: 5793 - protein, 123 aa, Homo sapiens
MATQAKRPRVAGPVDGGDLDPVACFLSWCRRVGLELSPKVSERAAGRAPVAAHLLHRRPAGARASCAAEPVGLGATAAGAAPRAAGPGLTLEALLCALARAGPLGAPDVLVRALGGVGERLHR

SEQ ID NO: 5794 - protein, 269 aa, Homo sapiens
MLFFTQCFGAVLDLIHLRFQHYKAKRVFSAAGQLVCVVNPTHNLKYVSSRRAVTQSAPEQGSFHPHHLSHHHCHHRHHHHLRHHAHPHHLHHQEAGLHANPVTPCLCMCPLFSCQWEGRLEVVVPHLRQIHRVDILQGAEIVFLATDMHLPAPADWIIMHSCLGHHFLLVLRKQERHEGHPQFFATMMLIGTPTQADCFTYRLELNRNHRRLKWEATPRSVLECVDSVITDGDCLVLNTSLAQLFSDNGSLAIGIAITATEVLPSEAEM

SEQ ID NO: 5795 - protein, 660 aa, Homo sapiens
MLVCYSVLACEILWDLPCSIMGSPLGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGVLKGSNERRDMESFWKLNRSPGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 5796 - protein, 648 aa, Homo sapiens
MQPNVIDWSDVRKHKYGHLSESASQYQEAADILDLGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 5797 - protein, 577 aa, Homo sapiens
MKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 5798 - protein, 591 aa, Homo sapiens
MQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 5799 - protein, 599 aa, Homo sapiens
MKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGVLKGSNERRDMESFWKLNRSPGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 5800 - protein, 577 aa, Homo sapiens; identical to SEQ ID NO: 5797

SEQ ID NO: 5801 - protein, 591 aa, Homo sapiens; identical to SEQ ID NO: 5798

SEQ ID NO: 5802 - protein, 577 aa, Homo sapiens; identical to SEQ ID NO: 5797

SEQ ID NO: 5803 - protein, 618 aa, Homo sapiens
MGSPLGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 5804 - protein, 660 aa, Homo sapiens; identical to SEQ ID NO: 5795

SEQ ID NO: 5805 - protein, 480 aa, Homo sapiens
MQSYTPPSNEFKISMKLEAQDPRNTTSTCIATVVGLTGARLRLRLDGSDNKNDFWRLVDSAEIQPIGNCEKNGGMLQPPLVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 5806 - protein, 414 aa, Homo sapiens
MQSQRIPGRKRGRPSLHSTPMKMAVHNLYSASAGSLPAVKIPKKRGRKPGYKIKSRVLMTPLALSPPRSTPEPDLSSIPQDAATVPSLAAPQALTVCLYINKQANAGPYLERKKVQQLPEHFGPERPSAVLQQAVQACIDCAHQQKLVFSLVKQGYGGEMVSVSASFDGKQHLRSLPVVNSIGYVLRFLAKLCRSLLCDDLFSHQPFPRGCSASEKVQEKEEGRMESVKTVTTEEYLVNPVGMNRYSVDTSASTFNHRGSLHPSSSLYCKRQNSGDSHLGGGPAATAGGPRTSPMSSGGPSAPGLRPPASSPKRNTTSLEGNRCASSPSQDAQDARRPRSRNPSAWTVEDVVWFVKDADPQALGPHVELFRKHEIDGNALLLLKSDMVMKYLGLKLGPALKLCYHIDKLKQAKF

SEQ ID NO: 5807 - protein, 305 aa, Homo sapiens
MPCQRTAWIGCDRQRTPPFHWREIKSRVLMTPLALSPPRSTPEPDLSSIPQDAATVPSLAAPQALTVCLYINKQANAGPYLERKKVQQLPEHFGPERPSAVLQQAVQACIDCAHQQKLVFSLVKQGYGGEMVSVSASFDGKQHLRSLPVVNSIGYVLRFLAKLCRSLLCDDLFSHQPFPRGCSASEKVQEKEEGRMESVKTVTTEEYLVNPVGMNRYSVDTSASTFNHRGSLHPSSSLYCKRQNSGDSHLGGGPAATAGGPRTSPMSSGGPSAPGLRPPASSPKRNTTSLEGNRCGNVMHASASH

SEQ ID NO: 5808 - protein, 107 aa, Homo sapiens
MVIRVFIASSSGFVAIKKKQQDVVRFLEANKIEFEEVDITMSEEQRQWMYKNVPPEKKPTQGNPLPPQIFNGDRYCGDYDSFFESKESNTVFSFLGLKPRLASKAEP

SEQ ID NO: 5809 - protein, 319 aa, Homo sapiens
MEELTAFVSKSFDQKVKEKKEAITYREVLESGPLRGAKEPTGCTEAGRDDRSSPAVRAAGGGGGGGGGGGGGGGGGGVGGGGAGGGAGGGRSPVRELDMGAAERSREPGSPRLTEVSPELKDRKEDAKGMEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQVQAQLQLDSAVAHAHHHLHPHLAAHAPYMMFPAPPFGLPLATLAADSASAASVVAAAAAAKTTSKNSSIADLRLKAKKHAAALGL

SEQ ID NO: 5810 - protein, 220 aa, Homo sapiens
MNGFTPDEMSRGGDAAAAVAAVVAAAAAAASAGNGTGAGTGAEVPGAGAVSAAGPPGAAGPGPGQLCCLREDGERCGRAAGNASFSKRIQKSISQKKVKIELDKSARHLYICDYHKNLIQSVRNRRKRKGSDDDGGDSPVQDIDTPEVDLYQLQVNTLRRYKRHFKLPTRPGLNKAQLVEIVGCHFRSIPVNEKDTLTYFIYSVKNDKNKSDLKVDSGVH

SEQ ID NO: 5811 - protein, 275 aa, Homo sapiens
MGPAGVAARPGRFFGVYLLYCLNPRYRGRVYVGFTVNTARRVQQHNGGRKKGGAWRTSGRGPWEMVLVVHGFPSSVAALRFEWAWQHPHASRRLAHVGPRLRGETAFAFHLRVLAHMLRAPPWARLPLTLRWVRPDLRQDLCLPPPPHVPLAFGPPPPQAPAPRRRAGPFDDAEPEPDQGDPGACCSLCAQTIQDEEGPLCCPHPGCLLRAHVICLAEEFLQEEPGQLLPLEGQCPCCEKSLLWGDLIWLCQMDTEKEVEDSELEEAHWTDLLET

SEQ ID NO: 5812 - protein, 161 aa, Homo sapiens
MGPAGVAARPGRFFGVYLLYCLNPRYRGRVYVGFTVNTARRVQQHNGGRKKGGAWRTSGRGPWEMVLVVHGFPSSVAALRDEEGPLCCPHPGCLLRAHVICLAEEFLQEEPGQLLPLEGQCPCCEKSLLWGDLIWLCQMDTEKEVEDSELEEAHWTDLLET

SEQ ID NO: 5813 - protein, 254 aa, Homo sapiens
MGPAGVAARPGRFFGVYLLYCLNPRYRGRVYVGFTVNTARRVQQHNGGRKKGGAWRTSGRGPWEMVLVVHGFPSSVAALRFEWAWQHPHASRRLAHVGPRLRGETAFAFHLRVLAHMLRAPPWARLPLTLRWVRPDLRQDLCLPPPPHVPLAFGPPPPQAPAPRRRAGPFDDAEPEPDQGDPGACCSLCAQTIQDEEGPLCCPHPGCLLRAHVICLAEEFLQEEPGQLLPLEGQCPCCEKSALGRPDLAVPDGH

SEQ ID NO: 5814 - protein, 275 aa, Homo sapiens; identical to SEQ ID NO: 5811

SEQ ID NO: 5815 - protein, 161 aa, Homo sapiens; identical to SEQ ID NO: 5812

SEQ ID NO: 5816 - protein, 254 aa, Homo sapiens; identical to SEQ ID NO: 5813

SEQ ID NO: 5817 - protein, 123 aa, Homo sapiens
MVVQDPLLCDLPIQVTLEEVNSQIALEYGQAMTVRVCKMDGEVMPVVVVQSATVLDLKKAIQRYVQLKQEREGGIQHISWSYVWRTYHLTSAGEKLTEDRKKLRDYGIRNRDEVSFIKKLRQK

SEQ ID NO: 5818 - protein, 132 aa, Homo sapiens
MDVFQEGLAMVVQDPLLCDLPIQVTLEEVNSQIALEYGQAMTVRVCKMDGEVMPVVVVQSATVLDLKKAIQRYVQLKQEREGGIQHISWSYVWRTYHLTSAGEKLTEDRKKLRDYGIRNRDEVSFIKKLRQK

SEQ ID NO: 5819 - protein, 155 aa, Homo sapiens
MGRSRSRSPRRERRRSRSTSRERERRRRERSRSRERDRRRSRSRSPHRRRSRSPRRHRSTSPSPSRLKERRDEEKKETKETKSKERQITEEDLEGKTEEEIEMMKLMGFASFDSTKGKKVDGSVNAYAINVSQKRKYRQYMNRKGGFNRPLDFIA

SEQ ID NO: 5820 - protein, 155 aa, Homo sapiens; identical to SEQ ID NO: 5819

SEQ ID NO: 5821 - protein, 246 aa, Homo sapiens
MNDWMPIAKEYDPLKAGSIDGTDEDPHDRAVWRAMLARYVPNKGVIGDPLLTLFVARLNLQTKEDKLKEVFSRYGDIRRLRLVRDLVTGFSKGYAFIEYKEERAVIKAYRDADGLVIDQHEIFVDYELERTLKGWIPRRLGGGLGGKKESGQLRFGGRDRPFRKPINLPVVKNDLYREGKRERRERSRSRERHWDSRTRDRDHDRGREKRWQEREPTRVWPDNDWERERDFRDDRIKGREKKERGK

SEQ ID NO: 5822 - protein, 251 aa, Homo sapiens
MKPANMNDWMPIAKEYDPLKAGSIDGTDEDPHDRAVWRAMLARYVPNKGVIGDPLLTLFVARLNLQTKEDKLKEVFSRYGDIRRLRLVRDLVTGFSKGYAFIEYKEERAVIKAYRDADGLVIDQHEIFVDYELERTLKGWIPRRLGGGLGGKKESGQLRFGGRDRPFRKPINLPVVKNDLYREGKRERRERSRSRERHWDSRTRDRDHDRGREKRWQEREPTRVWPDNDWERERDFRDDRIKGREKKERGK

SEQ ID NO: 5823 - protein, 246 aa, Homo sapiens; identical to SEQ ID NO: 5821

SEQ ID NO: 5824 - protein, 437 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 5825 - protein, 166 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSTTQLACS

SEQ ID NO: 5826 - protein, 37 aa, Homo sapiens
AAAAAASLRTDARARRYATWQDDPVPAAQPSGPLCPP

SEQ ID NO: 5827 - protein, 341 aa, Homo sapiens
MEQALHRFGRGLVWLSVAWLSVGRVRVRDDGDTGRGFCRAGPVLTRGPSGDSSPLPLPTSVTAAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 5828 - protein, 437 aa, Homo sapiens; identical to SEQ ID NO: 5824

SEQ ID NO: 5829 - protein, 225 aa, Homo sapiens
MDIRPNHTIYINNMNDKIKKEELKRSLYALFSQFGHVVDIVALKTMKMRGQAFVIFKELGSSTNALRQLQGFPFYGKPMRIQYAKTDSDIISKMRGTFADKEKKKEKKKAKTVEQTATTTNKKPGQGTPNSANTQGNSTPNPQVPDYPPNYILFLNNLPEETNEMMLSMLFNQFPGFKEVRLVPGRHDIAFVEFENDGQAGAARDALQGFKITPSHAMKITYAKK

SEQ ID NO: 5830 - protein, 225 aa, Homo sapiens; identical to SEQ ID NO: 5829

SEQ ID NO: 5831 - protein, 368 aa, Homo sapiens
MGTPPGLQTDCEALLSRFQETDSVRFEDFTELWRNMKFGTIFCGRMRNLEKNMFTKEALALAWRYFLPPYTFQIRVGALYLLYGLYNTQLCQPKQKIRVALKDWDEVLKFQQDLVNAQHFDAAYIFRKLRLDRAFHFTAMPKLLSYRMKKKIHRAEVTEEFKDPSDRVMKLITSDVLEEMLNVHDHYQNMKHVISVDKSKPDKALSLIKDDFFDNIKNIVLEHQQWHKDRKNPSLKSKTNDGEEKMEGNSQETERCERAESLAKIKSKAFSVVIQASKSRRHRQVKLDSSDSDSASGQGQVKATRKKEKKERLKPAGRKMSLRNKGNVQNIHKEDKPLSLSMPVITEEEENESLSGTEFTASKKRRKH

SEQ ID NO: 5832 - protein, 334 aa, Homo sapiens
MKPPPRRRAAPARYLGEVTGPATWSAREKRQLVRLLQARQGQPEPDATELARELRGRSEAEIRVFLQQLKGRVAREAIQKVHPGGLQGPRRREAQPPAPIEVWTDLAEKITGPLEEALAVAFSQVLTIAATEPVTLLHSKPPKPTQARGKPLLLSAPGGQEDPAPEIPSSAPAAPSSAPRTPDPAPEKPSESSAGPSTEEDFAVDFEKIYKYLSSVSRSGRSPELSAAESAVVLDLLMSLPEELPLLPCTALVEHMTETYLRLTAPQPIPAGGSLGPAAEGDGAGSKAPEETPPATEKAEHSELKSPWQAAGICPLNPFLVPLELLGRAATPAR

SEQ ID NO: 5833 - protein, 24 aa, Homo sapiens
LASSWDLSPEPVPESLGPPVGPGL

SEQ ID NO: 5834 - protein, 124 aa, Homo sapiens
MLVLGSQKLTQLRDSIRCVSDLQIGGEFSNTPDQAPEHISKDLYKSAFFYFEGTFYNDKRYPECRDLSRTIIEWSESHDRGYGKFQTARMEDFTFNDLCIKLGFPYLYCHQGDCEHVIVITDIR

SEQ ID NO: 5835 - protein, 243 aa, Homo sapiens
MAEGSRGGPTCSGVGGRQDPVSGSGGCNFPEYELPELNTRAFHVGAFGELWRGRLRGAGDLSLREPPASALPGSQAADSDREDAAVARDLDCSLEAAAELRAVCGLDKLKCLEDGEDPEVIPENTDLVTLGVRKRFLEHREETITIDRACRQETFVYEMESHAIGKKPENSADMIEEGELILSVNILYPVIFHKDLYKSAFFYFEGTFYNDKRYPECRDLSRTIIEWSESHDRGYGKFQTARM

SEQ ID NO: 5836 - protein, 411 aa, Homo sapiens
MAEGSRGGPTCSGVGGRQDPVSGSGGCNFPEYELPELNTRAFHVGAFGELWRGRLRGAGDLSLREPPASALPGSQAADSDREDAAVARDLDCSLEAAAELRAVCGLDKLKCLEDGEDPEVIPENTDLVTLGVRKRFLEHREETITIDRACRQETFVYEMESHAIGKKPENSADMIEEGELILSVNILYPVIFHKHKEHKPYQTMLVLGSQKLTQLRDSIRCVSDLQIGGEFSNTPDQAPEHISKDLYKSAFFYFEGTFYNDKRYPECRDLSRTIIEWSESHDRGYGKFQTARMEDFTFNDLCIKLGFPYLYCHQGDCEHVIVITDIRLVHHDDCLDRTLYPLLIKKHWLWTRKCFVCKMYTARWVTNNDSFAPEDPCFFCDVCFRMLHYDSEGNKLGEFLAYPYVDPGTFN

SEQ ID NO: 5837 - protein, 243 aa, Homo sapiens; identical to SEQ ID NO: 5835

SEQ ID NO: 5838 - protein, 218 aa, Homo sapiens
MAEGSRGGPTCSGVGGRQDPVSGSGGCNFPEYELPELNTRAFHVGAFGELWRGRLRGARDLDCSLEAAAELRAVCGLDKLKCLEDGEDPEVIPENTDLVTLGVRKRFLEHREETITIDRACRQETFVYEMESHAIGKKPENSADMIEEGELILSVNILYPVIFHKHKEHKPYQTMLVLGSQKLTQLRDSIRCVSDLQIGGEFSNTPDQAPEHISKNYH

SEQ ID NO: 5839 - protein, 411 aa, Homo sapiens; identical to SEQ ID NO: 5836

SEQ ID NO: 5840 - protein, 411 aa, Homo sapiens; identical to SEQ ID NO: 5836

SEQ ID NO: 5841 - protein, 1469 aa, Homo sapiens
MDVDAEREKITQEIKELERILDPGSSGSHVEISESSLESDSEADSLPSEDLDPADPPISEEERWGEASNDEDDPKDKTLPEDPETCLQLNMVYQEVIQEKLAEANLLLAQNREQQEELMRDLAGSKGTKVKDGKSLPPSTYMGHFMKPYFKDKVTGVGPPANEDTREKAAQGIKAFEELLVTKWKNWEKALLRKSVVSDRLQRLLQPKLLKLEYLHQKQSKVSSELERQALEKQGREAEKEIQDINQLPEEALLGNRLDSHDWEKISNINFEGSRSAEEIRKFWQNSEHPSINKQEWSREEEERLQAIAAAHGHLEWQKIAEELGTSRSAFQCLQKFQQHNKALKRKEWTEEEDRMLTQLVQEMRVGSHIPYRRIVYYMEGRDSMQLIYRWTKSLDPGLKKGYWAPEEDAKLLQAVAKYGEQDWFKIREEVPGRSDAQCRDRYLRRLHFSLKKGRWNLKEEEQLIELIEKYGVGHWAKIASELPHRSGSQCLSKWKIMMGKKQGLRRRRRRARHSVRWSSTSSSGSSSGSSGGSSSSSSSSSEEDEPEQAQAGEGDRALLSPQYMVPDMDLWVPARQSTSQPWRGGAGAWLGGPAASLSPPKGSSASQGGSKEASTTAAAPGEETSPVQVPARAHGPVPRSAQASHSADTRPAGAEKQALEGGRRLLTVPVETVLRVLRANTAARSCTQKEQLRQPPLPTSSPGVSSGDSVARSHVQWLRHRATQSGQRRWRHALHRRLLNRRLLLAVTPWVGDVVVPCTQASQRPAVVQTQADGLREQLQQARLASTPVFTLFTQLFHIDTAGCLEVVRERKALPPRLPQAGARDPPVHLLQASSSAQSTPGHLFPNVPAQEASKSASHKGSRRLASSRVERTLPQASLLASTGPRPKPKTVSELLQEKRLQEARAREATRGPVVLPSQLLVSSSVILQPPLPHTPHGRPAPGPTVLNVPLSGPGAPAAAKPGTSGSWQEAGTSAKDKRLSTMQALPLAPVFSEAEGTAPAASQAPALGPGQISVSCPESGLGQSQAPAASRKQGLPEAPPFLPAAPSPTPLPVQPLSLTHIGGPHVATSVPLPVTWVLTAQGLLPVPVPAVVSLPRPAGTPGPAGLLATLLPPLTETRAAQGPRAPALSSSWQPPANMNREPEPSCRTDTPAPPTHALSQSPAEADGSVAFVPGEAQVAREIPEPRTSSHADPPEAEPPWSGRLPAFGGVIPATEPRGTPGSPSGTQEPRGPLGLEKLPLRQPGPEKGALDLEKPPLPQPGPEKGALDLGLLSQEGEAATQQWLGGQRGVRVPLLGSRLPYQPPALCSLRALSGLLLHKKALEHKATSLVVGGEAERPAGALQASLGLVRGQLQDNPAYLLLRARFLAAFTLPALLATLAPQGVRTTLSVPSRVGSESEDEDLLSELELADRDGQPGCTTATCPIQGAPDSGKCSASSCLDTSNDPDDLDVLRTRHARHTRKRRRLV

SEQ ID NO: 5842 - protein, 68 aa, Homo sapiens
MLSRLQELRKEEETLLRLKAALHDQLNRLKMLVHVDNEASINQTTLELSTKSHVTEEEEEEEEEESDS

SEQ ID NO: 5843 - protein, 98 aa, Homo sapiens
MLSRLQELRKEEETLLRLKAALHDQLNRLKVEELALQSMISSRRGDEMLSSHTVPEQSHDMLVHVDNEASINQTTLELSTKSHVTEEEEEEEEEESDS

SEQ ID NO: 5844 - protein, 98 aa, Homo sapiens; identical to SEQ ID NO: 5843

SEQ ID NO: 5845 - protein, 1683 aa, Homo sapiens
MSSRRKRAPPVRVDEEKRQQLHWNMHEDRRNEPIIISDDDEQPCPGSDTSSAHYIILSDSLKEEVAHRDKKRCSKVVSFSKPIEKEETVGIFSPLSVKLNIVISPYHFDNSWKAFLGELTLQLLPAQSLIENFSERSITLMSSESSNQFLIYVHSKGEDVEKQKKEPMSICDKGILVESSFSGEMLEDLGWLQKKRRIKLYQKPEGNHIIKVGIYLLEAGLAKLDFLSDANSRMKKFNQLMKKVMEKLHNSIIPDVLEEDEDDPESEPEGQDIDELYHFVKQTHQQETQSIQVDVQHPALIPVLRPYQREAVNWMLQQECFRSSPATESALHFLWREIVTSEGLKLYYNPYTGCIIREYPNSGPQLLGGILADEMGLGKTVEVLALILTHTRQDVKQDALTLPEGKVVNYFIPSHYFGGKLKKTEIQNIEFEPKEKVQCPPTRVMILTAVKEMNGKKGVSILSIYKYVSSIYRYDVQRNRSLLKRMLKCLIFEGLVKQIKGHGFSGTFTLGKNYKEEDICDKTKKQAVGSPRKIQKETRKSGNKDTDSEYLPSDTSDDDDDPYYYYYKSRRNRSKLRKKLVPSTKKGKSQPFINPDSQGHCPATSDSGITDVAMSKSTCISEFNQEHETEDCAESLNHADSDVPPSNTMSPFNTSDYRFECICGELDQIDRKPRVQCLKCHLWQHAKCVNYDEKNLKIKPFYCPHCLVAMEPVSTRATLIISPSSICHQWVDEINRHVRSSSLRVLVYQGVKKDGFLQPHFLAEQDIVIITYDVLRSELNYVDIPHSNSEDGRRLRNQKRYMAIPSPLVAVEWWRICLDEAQMVECPTVKAAEMAQRLSGINRWCISGTPVQRGLEDLFGLVVFLGIEPYCVKHWWVRLLYRPYCKKNPQHLYSFIAKILWRSAKKDVIDQIQIPPQTEEIHWLHFSPVERHFYHRQHEVCCQDVVVKLRKISDWALKLSSLDRRTVTSILYPLLRLRQACCHPQAVRGEFLPLQKSTMTMEELLTSLQKKCGTECEEAHRQLVCALNGLAGIHIIKGEYALAAELYREVLRSSEEHKGKLKTDSLQRLHATHNLMELLIARHPGIPPTLRDGRLEEEAKQLREHYMSKCNTEVAEAQQALYPVQQTIHELQRKIHSNSPWWLNVIHRAIEFTIDEELVQRVRNEITSNYKQQTGKLSMSEKFRDCRGLQFLLTTQMEELNKCQKLVREAVKNLEGPPSRNVIESATVCHLRPARLPLNCCVFCKADELFTEYESKLFSNTVKGQTAIFEEMIEDEEGLVDDRAPTTTRGLWAISETERSMKAILSFAKSHRFDVEFVDEGSTSMDLFEAWKKEYKLLHEYWMALRNRVSAVDELAMATERLRVRDPREPKPNPPVLHIIEPHEVEQNRIKLLNDKAVATSQLQKKLGQLLYLTNLEKSQDKTSGGVNPEPCPICARQLGKQWAVLTCGHCFCNECISIIIEQYSVGSHRSSIKCAICRQTTSHKEISYVFTSEKANQEEDIPVKGSHSTKVEAVVRTLMKIQLRDPGAKALVFSTWQDVLDIISKALTDNNMEFAQISRVKTFQENLSAFKRDPQINILLLPLHTGSNGLTIIEATHVLLVEPILNPAHELQAIGRVHRIGQTKPTIVHRFLIKATIEERMQAMLKTAERSHTNSSAKHSEASVLTVADLADLFTKETEELE

SEQ ID NO: 5846 - protein, 1687 aa, Homo sapiens
MSSRRKRAPPVRVDEEKRQQLHWNMHEDRRNEPIIISDDDEQPCPGSDTSSAHYIILSDSLKEEVAHRDKKRCSKVVSFSKPIEKEETVGIFSPLSVKLNIVISPYHFDNSWKAFLGELTLQLLPAQSLIENFSERSITLMSSESSNQFLIYVHSKGEDVEKQKKEPMSICDKGILVESSFSGEMLEDLGWLQKKRRIKLYQKPEGNHIIKVGIYLLEAGLAKLDFLSDANSRMKKFNQLMKKVMEKLHNSIIPDVLEEDEDDPESEPEGQDIDELYHFVKQTHQQETQSIQVDVQHPALIPVLRPYQREAVNWMLQQECFRSSPATESALHFLWREIVTSEGLKLYYNPYTGCIIREYPNSGPQLLGGILADEMGLGKTVEVLALILTHTRQDVKQDALTLPEGKVVNYFIPSHYFGGKLKKTEIQNIEFEPKEKVQCPPTRVMILTAVKEMNGKKGVSILSIYKYVSSIYRYDVQRNRSLLKRMLKCLIFEGLVKQIKGHGFSGTFTLGKNYKEEDICDKTKKQAVGSPRKIQKETRKSGNKDTDSEYLPSDTSDDDDDPYYYYYKSRRNRSKLRKKLVPSTKKGKSQPFINPDSQGHCPATSDSGITDVAMSKSTCISEFNQEHETEDCAESLNHADSDVPPSNTMSPFNTSDYRFECICGELDQIDRKPRVQCLKCHLWQHAKCVNYDEKNLKIKPFYCPHCLVAMEPVSTRATLIISPSSICHQWVDEINRHVRSSSLRVLVYQGVKKDGFLQPHFLAEQDIVIITYDVLRSELNYVDIPHSNSEDGRRLRNQKRYMAIPSPLVAVEWWRICLDEAQMVECPTVKAAEMAQRLSGINRWCISGTPVQRGLEDLFGLVVFLGIEPYCVKHWWVRLLYRPYCKKNPQHLYSFIAKILWRSAKKDVIDQIQIPPQTEEIHWLHFSPVERHFYHRQHEVCCQDVVVKLRKISDWALKLSSLDRRTVTSILYPLLRLRQACCHPQAVRGEFLPLQKSFEQSTFSFSTMTMEELLTSLQKKCGTECEEAHRQLVCALNGLAGIHIIKGEYALAAELYREVLRSSEEHKGKLKTDSLQRLHATHNLMELLIARHPGIPPTLRDGRLEEEAKQLREHYMSKCNTEVAEAQQALYPVQQTIHELQRKIHSNSPWWLNVIHRAIEFTIDEELVQRVRNEITSNYKQQTGKLSMSEKGLQFLLTTQMEELNKCQKLVREAVKNLEGPPSRNVIESATVCHLRPARLPLNCCVFCKADELFTEYESKLFSNTVKGQTAIFEEMIEDEEGLVDDRAPTTTRGLWAISETERSMKAILSFAKSHRFDVEFVDEGSTSMDLFEAWKKEYKLLHEYWMALRNRVSAVDELAMATERLRVRDPREPKPNPPVLHIIEPHEVEQNRIKLLNDKAVATSQLQKKLGQLLYLTNLEKSQDKTSGGVNPEPCPICARQLGKQWAVLTCGHCFCNECISIIIEQYSVGSHRSSIKCAICRQTTSHKEISYVFTSEKANQEEDIPVKGSHSTKVEAVVRTLMKIQLRDPGAKALVFSTWQDVLDIISKALTDNNMEFAQISRVKTFQENLSAFKRDPQINILLLPLHTGSNGLTIIEATHVLLVEPILNPAHELQAIGRVHRIGQTKPTIVHRFLIKATIEERMQAMLKTAERSHTNSSAKHSEASVLTVADLADLFTKETEELE

SEQ ID NO: 5847 - protein, 1683 aa, Homo sapiens; identical to SEQ ID NO: 5845

SEQ ID NO: 5848 - protein, 155 aa, Homo sapiens
MEFAQISRVKTFQENLSAFKRDPQINILLLPLHTGSNGLTIIEATHVLLVEPILNPAHELQAIGRVHRIGQTKPTIVHRFLIKATIEERMQAMLKTAERRFFEEQALFCFHDITPFSHPWSLTTAILQLRDLVICELFFIYFKNFLICFLSSFSI

SEQ ID NO: 5849 - protein, 1659 aa, Homo sapiens
MSSRRKRAPPVRVDEEKRQQLHWNMHEDRRNEPIIISDDDEQPCPGSDTSSAHYIILSDSLKEEVAHRDKKRCSKVVSFSKPIEKEETVGIFSPLSVKLNIVISPYHFDNSWKAFLGELTLQLLPAQSLIENFSERSITLMSSESSNQFLIYVHSKGEDVEKQKKEPMSICDKGILVESSFSGEMLEDLGWLQKKRRIKLYQKPEGNHIIKVGIYLLEAGLAKLDFLSDANSRMKKFNQLMKKVMEKLHNSIIPDVLEEDEDDPESEPEGQDIDELYHFVKQTHQQETQSIQVDVQHPALIPVLRPYQREAVNWMLQQECFRSSPATESALHFLWREIVTSEGLKLYYNPYTGCIIREYPNSGPQLLGGILADEMGLGKTVEVLALILTHTRQDVKQDALTLPEGKVVNYFIPSHYFGGKLKKTEIQNIEFEPKEKVQCPPTRVMILTAVKEMNGKKGVSILSIYKYVSSIYRYDVQRNRSLLKRMLKCLIFEGLVKQIKGHGFSGTFTLGKNYKEEDICDKTKKQAVGSPRKIQKETRKSGNKDTDSEYLPSDTSDDDDDPYYYYYKSRRNRSKLRKKLVPSTKKGKSQPFINPDSQGHCPATSDSGITDVAMSKSTCISEFNQEHETEDCAESLNHADSDVPPSNTMSPFNTSDYRFECICGELDQIDRKPRVQCLKCHLWQHAKCVNYDEKNLKIKPFYCPHCLVAMEPVSTRATLIISPSSICHQWVDEINRHVRSSSLRVLVYQGVKKDGFLQPHFLAEQDIVIITYDVLRSELNYVDIPHSNSEDGRRLRNQKRYMAIPSPLVAVEWWRICLDEAQMVECPTVKAAEMAQRLSGINRWCISGTPVQRGLEDLFGLVVFLGIEPYCVKHWWVRLLYRPYCKKNPQHLYSFIAKILWRSAKKDVIDQIQIPPQTEEIHWLHFSPVERHFYHRQHEVCCQDVVVKLRKISDWALKLSSLDRRTVTSILYPLLRLRQACCHPQAVRGEFLPLQKSFEQSTFSFSTMTMEELLTSLQKKCGTECEEAHRQLVCALNGLAGIHIIKGEYALAAELYREVLRSSEEHKGKLKTDSLQRLHATHNLMELLIARHPGIPPTLRDGRLEEEAKQLREHYMSKCNTEVAEAQQALYPVQQTIHELQRKIHSNSPWWLNVIHRAIEFTIDEELVQRVRNEITSNYKQQTGKLSMSEKGLQFLLTTQMEELNKCQKLVREAVKNLEGPPSRNVIESATVCHLRPARLPLNCCVFCKADELFTEYESKLFSNTVKGQTAIFEEMIEDEEGLVDDRAPTTTRGLWAISETERSMKAILSFAKSHRFDVEFVDEGSTSMDLFEAWKKEYKLLHEYWMALRNRVSAVDELAMATERLRVRDPREPKPNPPVLHIIEPHEVEQNRIKLLNDKAVATSQLQKKLGQLLYLTNLEKSQDKTSGGVNPEPCPICARQLGKQWAVLTCGHCFCNECISIIIEQYSVGSHRSSIKCAICRQTTSHKEISYVFTSEKANQEEDIPVKGSHSTKVEAVVRTLMKIQLRDPGAKALVFSTWQDVLDIISKALTDNNMEFAQISRVKTFQENLSAFKRDPQINILLLPLHTGSNGLTIIEATHVLLVEPILNPAHELQAIGRVHRIGQTKPTIVHRFLIKATIEERMQAMLKTAERSIYI

SEQ ID NO: 5850 - protein, 660 aa, Homo sapiens
MSSRRKRAPPVRVDEEKRQQLHWNMHEDRRNEPIIISDDDEQPCPGEDVEKQKKEPMSICDKGILVESSFSGEMLEDLGWLQKKRRIKLYQKPEGNHIIKVGIYLLEAGLAKLDFLSDANSRMKKFNQLMKKVMEKLHNSIIPDVLEEDEDDPESEPEGQDIDELYHFVKQTHQQETQSIQVDVQHPALIPVLRPYQREAVNWMLQQECFRSSPATESALHFLWREIVTSEGLKLYYNPYTGCIIREYPNSGPQLLGGILADEMGLGKTVEVLALILTHTRQDVKQDALTLPEGKVVNYFIPSHYFGGKLKKTEIQNIEFEPKEKVQCPPTRVMILTAVKEMNGKKGVSILSIYKYVSSIYRYDVQRNRSLLKRMLKCLIFEGLVKQIKGHGFSGTFTLGKNYKEEDICDKTKKQAVGSPRKIQKETRKSGNKDTDSEYLPSDTSDDDDDPYYYYYKSRRNRSKLRKKLVPSTKKGKSQPFINPDSQGHCPATSDSGITDVAMSKSTCISEFNQEHETEDCAESLNHADSDVPPSNTMSPFNTSDYRFECICGELDQIDRKPRVQCLKCHLWQHAKCVNYDEKNLKIKPFYCPHCLVAMEPVSTRATLIISPSSICHQWVDEINRHVRSSSLRVLVYQGVKKDGFLQPHFGRTGYSYHYL

SEQ ID NO: 5851 - protein, 71 aa, Homo sapiens
MERARDRLHLRRTTEQHVPEVEVQVKRRRTASLSNQECQLYPRRSQQQQVPVVDFQAELRQAFLAETPRGG

SEQ ID NO: 5852 - protein, 71 aa, Homo sapiens; identical to SEQ ID NO: 5851

SEQ ID NO: 5853 - protein, 124 aa, Homo sapiens
MTPQGRGTVAAAAVAATASIAGAPTQYPPGRGTPPPPVGRATPPPGIMAPPPGMRPPMGPPIGLPPARGTPIGMPPPGMRPPPPGIRGEAFLLALVCWYGWPLDFGMSDYAAYLKKTCFQDLFN

SEQ ID NO: 5854 - protein, 71 aa, Homo sapiens; identical to SEQ ID NO: 5851

SEQ ID NO: 5855 - protein, 536 aa, Homo sapiens
MALTSFLPAPTQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVIYSKYTDLVPKEVMNADDPDLQRPDEEAIKEITEKTRVALEKSVSQKVAAAMPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHINENFAKLAEALYIADRKAREAVEMRAQVERKMAQKEKEKHEEKLREMAQKARERRAGIKTHVEKEDGEARERDEIRHDRRKERQHDRNLSRAAPDKRSKLQRNENRDISEVIALGVPNPRTSNEVQYDQRLFNQSKGMDSGFAGGEDEIYNVYDQAWRGGKDMAQSIYRPSKNLDKDMYGDDLEARIKTNRFVPDKEFSGSDRRQRGREGPVQFEEDPFGLDKFLEEAKQHGGSKRPSDSSRPKEHEHEGKKRRKE

SEQ ID NO: 5856 - protein, 288 aa, Homo sapiens
MALTSFLPAPTQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVIYSKYTDLVPKEVMNADDPDLQRPDEEAIKEITEKTRVALEKSVSQKVAAAMPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHKKKKKKKRK

SEQ ID NO: 5857 - protein, 185 aa, Homo sapiens
MALTSFLPAPTQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVIYSKYTDLVPKEVMNADDPDLQRPDEEAIKEMTVKEQQEWKIPPCISNWKNAKGYTIPLDKRLAADGRGLQTVH

SEQ ID NO: 5858 - protein, 736 aa, Homo sapiens
MVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSPRCEPGFSSESCEQLALPKAGGGDAEDAPSLLPGGGVSCKLAIQIDEGESEEMPKLLPYDTEETFDLKTPQVTNEGEPEKGLCLLPGEGEEGSDDCSEMCDGEERQEASSSLARRGSVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQENSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 5859 - protein, 172 aa, Homo sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNENLSSSAVLCQLVSPNKDWRSHEESLAHTGTLRRSCM

SEQ ID NO: 5860 - protein, 405 aa, Homo sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSPRCEPGFSSESCEQLALPKAGGGDAEDAPSLLPGGGVSCKLAIQIDEGESEEMPKLLPYDTEVLESNGMIDAARTYSTAPGEKQGEEEGRNSPRKRNQDKEKYQESPEGRDKETFDLKTPQVTNEGEPEKGLCLLPGEGEEGSDDCSEMCDGEEPQEASSSLARCGSEGSDDCSEMCDGEERQEAQKQGRKVIKRVAQWILWILQTTPLWENPRGKEDKR

SEQ ID NO: 5861 - protein, 867 aa, Homo sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSPRCEPGFSSESCEQLALPKAGGGDAEDAPSLLPGGGVSCKLAIQIDEGESEEMPKLLPYDTEVLESNGMIDAARTYSTAPGEKQGEEEGRNSPRKRNQDKEKYQESPEGRDKETFDLKTPQVTNEGEPEKGLCLLPGEGEEGSDDCSEMCDGEEPQEASSSLARCGSVSCLSAETFDLKTPQVTNEGEPEKELSLLPGEGEEGSDDCSEMCDGEERQEASSSLARRGSVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQENSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 5862 - protein, 840 aa, Homo sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSPRCEPGFSSESCEQLALPKAGGGDAEDAPSLLPGGGVSCKLAIQIDEGESEEMPKLLPYDTEVLESNGMIDAARTYSTAPGEKQGEEEGRNSPRKRNQDKEKYQESPEGRDKETFDLKTPQVTNEGEPEKGLCLLPGEGEEGSDDCSEMCDGEEPQEASSSLARCGSVSCLSAETFDLKTPQVTNEGEPEKELSLLPGEGEVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQENSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 5863 - protein, 768 aa, Homo sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSPRCEPGFSSESCEQLALPKAGGGDAEDAPSLLPGGGETFDLKTPQVTNEGEPEKGLCLLPGEGEEGSDDCSEMCDGEEPQEASSSLARCGSVSCLSAETFDLKTPQVTNEGEPEKELSLLPGEGEEGSDDCSEMCDGEERQEASSSLARRGSVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQENSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKAVHGRPGCR

SEQ ID NO: 5864 - protein, 189 aa, Homo sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDFCLILQEYVTGKKREY

SEQ ID NO: 5865 - protein, 438 aa, Homo sapiens
MAGGGSDLSTRGLNGGVSQVANEMNHLPAHSQSLQRLFTEDQDVDEGLVYDTVFKHFKRHKLEISNAIKKTFPFLEGLRDRELITNKMFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRMGTRTQKNNQQNDNSKADGQLVSSEKKANMNLKDLSKIRGRKRGKPGTHFTQSDRAPQKRVRSRASRKHKDETVDFQAPLLPVTCGGVKGILHKEKLEQGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEK

SEQ ID NO: 5866 - protein, 403 aa, Homo sapiens
MAGGGSDLSTRGLNGGVSQVANEMNHLPAHSQSLQRLFTEDQDVDEGLVYDTVFKHFKRHKLEISNAIKKTFPFLEGLRDRELITNKMFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRMGTRTQKNNQQNDNSKADGQLVSSEKKANMNLKDLSKIRGRKRGKPGTHFTQSDRAPQKRVRSRGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEK

SEQ ID NO: 5867 - protein, 580 aa, Homo sapiens
MAGGGSDLSTRGLNGGVSQVANEMNHLPAHSQSLQRLFTEDQDVDEGLVYDTVFKHFKRHKLEISNAIKKTFPFLEGLRDRELITNKMFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRMGTRTQKNNQQNDNSKADGQLVSSEKKANMNLKDLSKIRGRKRGKPGTHFTQSDRAPQKRVRSRASRKHKDETVDFQAPLLPVTCGGVKGILHKEKLEQGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEKTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGLRLEAEFEKDFKEVFAIQETNGNS

SEQ ID NO: 5868 - protein, 438 aa, Homo sapiens; identical to SEQ ID NO: 5865

SEQ ID NO: 5869 - protein, 129 aa, Homo sapiens
MFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRSKNK

SEQ ID NO: 5870 - protein, 249 aa, Homo sapiens
MAATAAVSPSDYLQPAASTTQDSQPSPLALLAATCSKIGPPAVEAAVTPPAPPQPTPRKLVPIKPAPLPLSPGKNSFGILSSKGNILQIQGSQLSASYPGGQLVFAIQNPTMINKGTRSNANIQYQAVPQIQASNSQTIQVQPNLTNQIQIIPGTNQAIITPSPSSHKPVPIKPAPIQKSSTTTTPVQSGANVVKLTGGGGNVTLTLPVNNLVNASDTGAPTQLLTASCQTGMLNSTRMFLFLAFINVL

SEQ ID NO: 5871 - protein, 613 aa, Homo sapiens
MSDPQTSMAATAAVSPSDYLQPAASTTQDSQPSPLALLAATCSKIGPPAVEAAVTPPAPPQPTPRKLVPIKPAPLPLSPGKNSFGILSSKGNILQIQGSQLSASYPGGQLVFAIQNPTMINKGTRSNANIQYQAVPQIQASNSQTIQVQPNLTNQIQIIPGTNQAIITPSPSSHKPVPIKPAPIQKSSTTTTPVQSGANVVKLTGGGGNVTLTLPVNNLVNASDTGAPTQLLTESPPTPLSKTNKKARKKSLPASQPPVAVAEQVETVLIETTADNIIQAGNNLLIVQSPGGGQPAVVQQVQVVPPKAEQQQVVQIPQQALRVVQAASATLPTVPQKPSQNFQIQAAEPTPTQVYIRTPSGEVQTVLVQDSPPATAAATSNTTCSSPASRAPHLSGTSKKHSAAILRKERPLPKIAPAGSIISLNAAQLAAAAQAMQTININGVQVQGVPVTITNTGGQQQLTVQNVSGNNLTISGLSPTQIQLQMEQALAGETQPGEKRRRMACTCPNCKDGEKRSGEQGKKKHVCHIPDCGKTFRKTSLLRAHVRLHTGERPFVCNWFFCGKRFTRSDELQRHARTHTGDKRFECAQCQKRFMRSDHLTKHYKTHLVTKNL

SEQ ID NO: 5872 - protein, 398 aa, Homo sapiens
MAAVAVLRNDSLQAFLQDRTPSASPDLGKHSPLALLAATCSRIGQPGAAAPPDFLQVPYDPALGSPSRLFHPWTADMPAHSPGALPPPHPSLGLTPQKTHLQPSFGAAHELPLTPPADPSYPYEFSPVKMLPSSMAALPASCAPAYVPYAAQAALPPGYSNLLPPPPPPPPPPTCRQLSPNPAPDDLPWWSIPQAGAGPGASGVPGSGLSGACAGAPHAPRFPASAAAAAAAAAALQRGLVLGPSDFAQYQSQIAALLQTKAPLAATARRCRRCRCPNCQAAGGAPEAEPGKKKQHVCHVPGCGKVYGKTSHLKAHLRWHTGERPFVCNWLFCGKSFTRSDELQRHLRTHTGEKRFACPECGKRFMRSDHLAKHVKTHQNKKLKVAEAGVKREDARDL

SEQ ID NO: 5873 - protein, 376 aa, Homo sapiens
MLTAVCGSLGSQHTEAPHASPPRLDLQPLQTYQGHTSPEAGDYPSPLQPGELQSLPLGPEVDFSQGYELPGASSRVTCEDLESDSPLAPGPFSKLLQPDMSHHYESWFRPTHPGAEDGSWWDLHPGTSWMDLPHTQGALTSPGHPGALQAGLGGYVGDHQLCAPPPHPHAHHLLPAAGGQHLLGPPDGAKALEVAAPESQGLDSSLDGAARPKGSRRSVPRSSGQTVCRCPNCLEAERLGAPCGPDGGKKKHLHNCHIPGCGKAYAKTSHLKAHLRWHSGDRPFVCNWLFCGKRFTRSDELQRHLQTHTGTKKFPCAVCSRVFMRSDHLAKHMKTHEGAKEEAAGAASGEGKAGGAVEPPGGKGKREAEGSVAPSN

SEQ ID NO: 5874 - protein, 376 aa, Homo sapiens; identical to SEQ ID NO: 5873

SEQ ID NO: 5875 - protein, 484 aa, Homo sapiens
MATSILGEEPRFGTTPLAMLAATCNKIGNTSPLTTLPESSAFAKGGFHPWKRSSSSCNLGSSLSGFAVATGGRGSGGLAGGSGAANSAFCLASTSPTSSAFSSDYGGLFSNSAAAAAAAAGVSPQEAGGQSAFISKVHTTAADGLYPRVGMAHPYESWYKSGFHSTLAAGEVTNGAASSWWDVHSSPGSWLEVQNPAGGLQSSLHSGAPQASLHSQLGTYNPDFSSLTHSAFSSTGLGSSAAAASHLLSTSQHLLAQDGFKPVLPSYSDSSAAVAAAAASAMISGAAAAAAGGSSARSARRYSGRATCDCPNCQEAERLGPAGASLRRKGLHSCHIPGCGKVYGKTSHLKAHLRWHTGERPFVCNWLFCGKRFTRSDELQRHLRTHTGEKRFACPVCNKRFMRSDHLSKHIKTHNGGGGGKKGSDSDTDASNLETPRSESPDLILHDSGVSAARAAAAAAAAAAAAAAAASAGGKEAASGPNDS

SEQ ID NO: 5876 - protein, 374 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKKNRVEINDVEPEVFKEMMCFIYTGKAPNLDKMADDLLAAADKYALERLKVMCEDALCSNLSVENAAEILILADLHSADQLKTQAVDFINYHASDVLETSGWKSMVVSHPHLVAEAYRSLASAQCPFLGPPRKRLKQS

SEQ ID NO: 5877 - protein, 374 aa, Homo sapiens; identical to SEQ ID NO: 5876

SEQ ID NO: 5878 - protein, 374 aa, Homo sapiens; identical to SEQ ID NO: 5876

SEQ ID NO: 5879 - protein, 32 aa, Homo sapiens
MSRVPSPPPPAEMSSGPVAESWCYTQIKVVKF

SEQ ID NO: 5880 - protein, 258 aa, Homo sapiens
MESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKKNRVEINDVEPEVFKEMMCFIYTGKAPNLDKMADDLLAAADKYALERLKVMCEDALCSNLSVENAAEILILADLHSADQLKTQAVDFINYHASDVLETSGWKSMVVSHPHLVAEAYRSLASAQCPFLGPPRKRLKQS

SEQ ID NO: 5881 - protein, 374 aa, Homo sapiens; identical to SEQ ID NO: 5876

SEQ ID NO: 5882 - protein, 374 aa, Homo sapiens; identical to SEQ ID NO: 5876

SEQ ID NO: 5883 - protein, 238 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKK

SEQ ID NO: 5884 - protein, 186 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRL

SEQ ID NO: 5885 - protein, 40 aa, Homo sapiens
MSRVPSPPPPAEMSSGPVAESWCYTQIKVVKFSYMWTINN

SEQ ID NO: 5886 - protein, 262 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKKNRVEINDVEPEVFKEMMCFIYTGK

SEQ ID NO: 5887 - protein, 66 aa, Homo sapiens
MSRVPSPPPPAEMSSGPVAESWCYTQIKVVKFSYMWTINNFSFCREEMGEVIKSSTFSSGANDKLK

SEQ ID NO: 5888 - protein, 327 aa, Homo sapiens
MGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKKNRVEINDVEPEVFKEMMCFIYTGKAPNLDKMADDLLAAADKYALERLKVMCEDALCSNLSVENAAEILILADLHSADQLKTQAVDFINYHASDVLETSGWKSMVVSHPHLVAEAYRSLASAQCPFLGPPRKRLKQS

SEQ ID NO: 5889 - protein, 138 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIR

SEQ ID NO: 5890 - protein, 117 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAM

SEQ ID NO: 5891 - protein, 392 aa, Homo sapiens
MSREPTPPLPGDMSTGPIAESWCYTQVKVVKFSYMWTINNFSFCREEMGEVLKSSTFSSGPSDKMKWCLRVNPKGLDDESKDYLSLYLLLVSCPKSEVRAKFKFSLLNAKREETKAMESQRAYRFVQGKDWGFKKFIRRDFLLDEANGLLPDDKLTLFCEVSVVQDSVNISGHTNTNTLKVPECRLAEDLGNLWENTRFTDCSFFVRGQEFKAHKSVLAARSPVFNAMFEHEMEESKKNRVEINDLDPEVFKEMMRFIYTGRAPNLDKMADNLLAAADKYALERLKVMCEEALCSNLSVENVADTLVLADLHSAEQLKAQAIDFINRCSVLRQLGCKDGKNWNSNQATDIMETSGWKSMIQSHPHLVAEAFRALASAQCPQFGIPRKRLKQS

SEQ ID NO: 5892 - protein, 3224 aa, Homo sapiens
MQKARGTRGEDAGTRAPPSPGVPPKRAKVGAGGGAPVAVAGAPVFLRPLKNAAVCAGSDVRLRVVVSGTPQPSLRWFRDGQLLPAPAPEPSCLWLRRCGAQDAGVYSCMAQNERGRASCEAVLTVLEVGDSETAEDDISDVQGTQRLELRDDGAFSTPTGGSDTLVGTSLDTPPTSVTGTSEEQVSWWGSGQTVLEQEAGSGGGTRRLPGSPRQAQATGAGPRHLGVEPLVRASRANLVGASWGSEDSLSVASDLYGSAFSLYRGRALSIHVSVPQSGLRREEPDLQPQLASEAPRRPAQPPPSKSALLPPPSPRVGKRSPPGPPAQPAATPTSPHRRTQEPVLPEDTTTEEKRGKKSKSSGPSLAGTAESRPQTPLSEASGRLSALGRSPRLVRAGSRILDKLQFFEERRRSLERSDSPPAPLRPWVPLRKARSLEQPKSERGAPWGTPGASQEELRAPGSVAERRRLFQQKAASLDERTRQRSPASDLELRFAQELGRIRRSTSREELVRSHESLRATLQRAPSPREPGEPPLFSRPSTPKTSRAVSPAAAQPPSPSSAEKPGDEPGRPRSRGPAGRTEPGEGPQQEVRRRDQFPLTRSRAIQECRSPVPPPAADPPEARTKAPPGRKREPPAQAVRFLPWATPGLEGAAVPQTLEKNRAGPEAEKRLRRGPEEDGPWGPWDRRGARSQGKGRRARPTSPELESSDDSYVSAGEEPLEAPVFEIPLQNVVVAPGADVLLKCIITANPPPQVSWHKDGSALRSEGRLLLRAEGERHTLLLREARAADAGSYMATATNELGQATCAASLTVRPGGSTSPFSSPITSDEEYLSPPEEFPEPGETWPRTPTMKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRAHPESRSLAVLAPLQDVDVGAGEMALFECLVAGPTDVEVDWLCRGRLLQPALLKCKMHFDGRKCKLLLTSVHEDDSGVYTCKLSTAKDELTCSARLTVRPSLAPLFTRLLEDVEVLEGRAARFDCKISGTPPPVVTWTHFGCPMEESENLRLRQDGGLHSLHIAHVGSEDEGLYAVSAVNTHGQAHCSAQLYVEEPRTAASGPSSKLEKMPSIPEEPEQGELERLSIPDFLRPLQDLEVGLAKEAMLECQVTGLPYPTISWFHNGHRIQSSDDRRMTQYRDVHRLVFPAVGPQHAGVYKSVIANKLGKAACYAHLYVTDVVPGPPDGAPQVVAVTGRMVTLTWNPPRSLDMAIDPDSLTYTVQHQVLGSDQWTALVTGLREPGWAATGLRKGVQHIFRVLSTTVKSSSKPSPPSEPVQLLEHGPTLEEAPAMLDKPDIVYVVEGQPASVTVTFNHVEAQVVWRSCRGALLEARAGVYELSQPDDDQYCLRICRVSRRDMGALTCTARNRHGTQTCSVTLELAEAPRFESIMEDVEVGAGETARFAVVVEGKPLPDIMWYKDEVLLTESSHVSFVYEENECSLVVLSTGAQDGGVYTCTAQNLAGEVSCKAELAVHSAQTAMEVEGVGEDEDHRGRRLSDFYDIHQEIGRGAFSYLRRIVERSSGLEFAAKFIPSQAKPKASARREARLLARLQHDCVLYFHEAFERRRGLVIVTELCTEELLERIARKPTVCESEIRAYMRQVLEGIHYLHQSHVLHLDVKPENLLVWDGAAGEQQVRICDFGNAQELTPGEPQYCQYGTPEFVAPEIVNQSPVSGVTDIWPVGVVAFLCLTGISPFVGENDRTTLMNIRNYNVAFEETTFLSLSREARGFLIKVLVQDRLRPTAEETLEHPWFKTQAKGAEVSTDHLKLFLSRRRWQRSQISYKCHLVLRPIPELLRAPPERVWVTMPRRPPPSGGLSSSSDSEEEELEELPSVPRPLQPEFSGSRVSLTDIPTEDEALGTPETGAATPMDWQEQGRAPSQDQEAPSPEALPSPGQEPAAGASPRRGELRRGSSAESALPRAGPRELGRGLHKAASVELPQRRSPSPGATRLARGGLGEGEYAQRLQALRQRLLRGGPEDGKVSGLRGPLLESLGGRARDPRMARAASSEAAPHHQPPLENRGLQKSSSFSQGEAEPRGRHRRAGAPLEIPVARLGARRLQESPSLSALSEAQPSSPARPSAPKPSTPKSAEPSATTPSDAPQPPAPQPAQDKAPEPRPEPVRASKPAPPPQALQTLALPLTPYAQIIQSLQLSGHAQGPSQGPAAPPSEPKPHAAVFARVASPPPGAPEKRVPSAGGPPVLAEKARVPTVPPRPGSSLSSSIENLESEAVFEAKFKRSRESPLSLGLRLLSRSRSEERGPFRGAEEEDGIYRPSPAGTPLELVRRPERSRSVQDLRAVGEPGLVRRLSLSLSQRLRRTPPAQRHPAWEARGGDGESSEGGSSARGSPVLAMRRRLSFTLERLSSRLQRSGSSEDSGGASGRSTPLFGRLRRATSEGESLRRLGLPHNQLAAQAGATTPSAESLGSEASATSGSSAPGESRSRLRWGFSRPRKDKGLSPPNLSASVQEELGHQYVRSESDFPPVFHIKLKDQVLLEGEAATLLCLPAACPAPHISWMKDKKSLRSEPSVIIVSCKDGRQLLSIPRAGKRHAGLYECSATNVLGSITSSCTVAVARVPGKLAPPEVPQTYQDTALVLWKPGDSRAPCTYTLERRVDGESVWHPVSSGIPDCYYNVTHLPVGVTVRFRVACANRAGQGPFSNSSEKVFVRGTQDSSAVPSAAHQEAPVTSRPARARPPDSPTSLAPPLAPAAPTPPSVTVSPSSPPTPPSQALSSLKAVGPPPQTPPRRHRGLQAARPAEPTLPSTHVTPSEPKPFVLDTGTPIPASTPQGVKPVSSSTPVYVVTSFVSAPPAPEPPAPEPPPEPTKVTVQSLSPAKEVVSSPGSSPRSSPRPEGTTLRQGPPQKPYTFLEEKARGRFGVVRACRENATGRTFVAKIVPYAAEGKRRVLQEYEVLRTLHHERIMSLHEAYITPRYLVLIAESCGNRELLCGLSDRFRYSEDDVATYMVQLLQGLDYLHGHHVLHLDIKPDNLLLAPDNALKIVDFGSAQPYNPQALRPLGHRTGTLEFMAPEMVKGEPIGSATDIWGAGVLTYIMLSGRSPFYEPDPQETEARIVGGRFDAFQLYPNTSQSATLFLRKVLSVHPWLSRPSSCLSVCHKEIKMASS

SEQ ID NO: 5893 - protein, 3267 aa, Homo sapiens
MQKARGTRGEDAGTRAPPSPGVPPKRAKVGAGGGAPVAVAGAPVFLRPLKNAAVCAGSDVRLRVVVSGTPQPSLRWFRDGQLLPAPAPEPSCLWLRRCGAQDAGVYSCMAQNERGRASCEAVLTVLEVGDSETAEDDISDVQGTQRLELRDDGAFSTPTGGSDTLVGTSLDTPPTSVTGTSEEQVSWWGSGQTVLEQEAGSGGGTRRLPGSPRQAQATGAGPRHLGVEPLVRASRANLVGASWGSEDSLSVASDLYGSAFSLYRGRALSIHVSVPQSGLRREEPDLQPQLASEAPRRPAQPPPSKSALLPPPSPRVGKRSPPGPPAQPAATPTSPHRRTQEPVLPEDTTTEEKRGKKSKSSGPSLAGTAESRPQTPLSEASGRLSALGRSPRLVRAGSRILDKLQFFEERRRSLERSDSPPAPLRPWVPLRKARSLEQPKSERGAPWGTPGASQEELRAPGSVAERRRLFQQKAASLDERTRQRSPASDLELRFAQELGRIRRSTSREELVRSHESLRATLQRAPSPREPGEPPLFSRPSTPKTSRAVSPAAAQPPSPSSAEKPGDEPGRPRSRGPAGRTEPGEGPQQEVRRRDQFPLTRSRAIQECRSPVPPPAADPPEARTKAPPGRKREPPAQAVRFLPWATPGLEGAAVPQTLEKNRAGPEAEKRLRRGPEEDGPWGPWDRRGARSQGKGRRARPTSPELESSDDSYVSAGEEPLEAPVFEIPLQNVVVAPGADVLLKCIITANPPPQVSWHKDGSALRSEGRLLLRAEGERHTLLLREARAADAGSYMATATNELGQATCAASLTVRPGGSTSPFSSPITSDEEYLSPPEEFPEPGETWPRTPTMKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRAHPESRSLAVLAPLQDVDVGAGEMALFECLVAGPTDVEVDWLCRGRLLQPALLKCKMHFDGRKCKLLLTSVHEDDSGVYTCKLSTAKDELTCSARLTVRPSLAPLFTRLLEDVEVLEGRAARFDCKISGTPPPVVTWTHFGCPMEESENLRLRQDGGLHSLHIAHVGSEDEGLYAVSAVNTHGQAHCSAQLYVEEPRTAASGPSSKLEKMPSIPEEPEQGELERLSIPDFLRPLQDLEVGLAKEAMLECQVTGLPYPTISWFHNGHRIQSSDDRRMTQYRDVHRLVFPAVGPQHAGVYKSVIANKLGKAACYAHLYVTDVVPGPPDGAPQVVAVTGRMVTLTWNPPRSLDMAIDPDSLTYTVQHQVLGSDQWTALVTGLREPGWAATGLRKGVQHIFRVLSTTVKSSSKPSPPSEPVQLLEHGPTLEEAPAMLDKPDIVYVVEGQPASVTVTFNHVEAQVVWRSCRGALLEARAGVYELSQPDDDQYCLRICRVSRRDMGALTCTARNRHGTQTCSVTLELAEAPRFESIMEDVEVGAGETARFAVVVEGKPLPDIMWYKDEVLLTESSHVSFVYEENECSLVVLSTGAQDGGVYTCTAQNLAGEVSCKAELAVHSAQTAMEVEGVGEDEDHRGRRLSDFYDIHQEIGRGAFSYLRRIVERSSGLEFAAKFIPSQAKPKASARREARLLARLQHDCVLYFHEAFERRRGLVIVTELCTEELLERIARKPTVCESEIRAYMRQVLEGIHYLHQSHVLHLDVKPENLLVWDGAAGEQQVRICDFGNAQELTPGEPQYCQYGTPEFVAPEIVNQSPVSGVTDIWPVGVVAFLCLTGISPFVGENDRTTLMNIRNYNVAFEETTFLSLSREARGFLIKVLVQDRLRPTAEETLEHPWFKTQAKGAEVSTDHLKLFLSRRRWQRSQISYKCHLVLRPIPELLRAPPERVWVTMPRRPPPSGGLSSSSDSEEEELEELPSVPRPLQPEFSGSRVSLTDIPTEDEALGTPETGAATPMDWQEQGRAPSQDQEAPSPEALPSPGQEPAAGASPRRGELRRGSSAESALPRAGPRELGRGLHKAASVELPQRRSPSPGATRLARGGLGEGEYAQRLQALRQRLLRGGPEDGKVSGLRGPLLESLGGRARDPRMARAASSEAAPHHQPPLENRGLQKSSSFSQGEAEPRGRHRRAGAPLEIPVARLGARRLQESPSLSALSEAQPSSPARPSAPKPSTPKSAEPSATTPSDAPQPPAPQPAQDKAPEPRPEPVRASKPAPPPQALQTLALPLTPYAQIIQSLQLSGHAQGPSQGPAAPPSEPKPHAAVFARVASPPPGAPEKRVPSAGGPPVLAEKARVPTVPPRPGSSLSSSIENLESEAVFEAKFKRSRESPLSLGLRLLSRSRSEERGPFRGAEEEDGIYRPSPAGTPLELVRRPERSRSVQDLRAVGEPGLVRRLSLSLSQRLRRTPPAQRHPAWEARGGDGESSEGGSSARGSPVLAMRRRLSFTLERLSSRLQRSGSSEDSGGASGRSTPLFGRLRRATSEGESLRRLGLPHNQLAAQAGATTPSAESLGSEASATSGSSAPGESRSRLRWGFSRPRKDKGLSPPNLSASVQEELGHQYVRSESDFPPVFHIKLKDQVLLEGEAATLLCLPAACPAPHISWMKDKKSLRSEPSVIIVSCKDGRQLLSIPRAGKRHAGLYECSATNVLGSITSSCTVAVARVPGKLAPPEVPQTYQDTALVLWKPGDSRAPCTYTLERRVDGESVWHPVSSGIPDCYYNVTHLPVGVTVRFRVACANRAGQGPFSNSSEKVFVRGTQDSSAVPSAAHQEAPVTSRPARARPPDSPTSLAPPLAPAAPTPPSVTVSPSSPPTPPSQALSSLKAVGPPPQTPPRRHRGLQAARPAEPTLPSTHVTPSEPKPFVLDTGTPIPASTPQGVKPVSSSTPVYVVTSFVSAPPAPEPPAPEPPPEPTKVTVQSLSPAKEVVSSPGSSPRSSPRPEGTTLRQGPPQKPYTFLEEKARGRFGVVRACRENATGRTFVAKIVPYAAEGKRRVLQEYEVLRTLHHERIMSLHEAYITPRYLVLIAESCGNRELLCGLSDRFRYSEDDVATYMVQLLQGLDYLHGHHVLHLDIKPDNLLLAPDNALKIVDFGSAQPYNPQALRPLGHRTGTLEFMAPEMVKGEPIGSATDIWGAGVLTYIMLSGRSPFYEPDPQETEARIVGGRFDAFQLYPNTSQSATLFLRKVLSVHPWSRPSLQDCLAHPWLQDAYLMKLRRQTLTFTTNRLKEFLGEQRRRRAEAATRHKVLLRSYPGGP

SEQ ID NO: 5894 - protein, 113 aa, Homo sapiens
MKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRGE

SEQ ID NO: 5895 - protein, 113 aa, Homo sapiens; identical to SEQ ID NO: 5894

SEQ ID NO: 5896 - protein, 113 aa, Homo sapiens; identical to SEQ ID NO: 5894

SEQ ID NO: 5897 - protein, 170 aa, Homo sapiens
MATATNELGQATCAASLTVRPGGSTSPFSSPITSDEEYLSPPEEFPEPGETWPRTPTMKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRGE

SEQ ID NO: 5898 - protein, 227 aa, Homo sapiens
MADLLGSILSSMEKPPSLGDQETRRKAREQAARLKKLQEQEKQQKVEFRKRMEKEVSDFIQDSGQIKKKFQPMNKIERSILHDVVEVAGLTSFSFGEDDDCRYVMIFKKEFAPSDEELDSYRRGEEWDPQKAEEKRKLKELAQRQEEEAAQQGPVVVSPASDYKDKYSHLIGKGAAKDAAHMLQANKTYGCVPVANKRDTRSIEEAMNEIRAKKRLRQSGEELPPTS

SEQ ID NO: 5899 - protein, 425 aa, Homo sapiens
MASSIICQEHCQISGQAKIDILLVGDVTVGYLADTVQKLFANIAEVTITISDTKEAAALLDDCIFNMVLLKVPSSLSAEELEAIKLIRFGKKKNTHSLFVFIIPENFKGCISGHGMDIALTEPLTMEKMSNVVKYWTTCPSNTVKTENATGPEELGLPLQRSYSEHLGYFPTDLFACSESLRNGNGLELNASLSEFEKNKKISLLHSSKEKLRRERIKYCCEQLRTLLPYVKGRKNDAASVLEATVDYVKYIREKISPAVMAQITEALQSNMRFCKKQQTPIELSLPGTVMAQRENSVMSTYSPERGLQFLTNTCWNGCSTPDAESSLDEAVRVPSSSASENAIGDPYKTHISSAALSLNSLHTVRYYSKVTPSYDATAVTNQNISIHLPSAMPPVSKLLPRHCTSGLGQTCTTHPNCLQQFWAY

SEQ ID NO: 5900 - protein, 502 aa, Homo sapiens; identical to SEQ ID NO: 3998

SEQ ID NO: 5901 - protein, 258 aa, Homo sapiens
MKTPNAQEAEGQQTRAAAGRATGSANMTKKKVSQKKQRGRPSSQPRRNIVGCRISHGWKEGDEPITQWKGTVLDQVPINPSLYLVKYDGIDCVYGLELHRDERVLSLKILSDRVASSHISDANLANTIIGKAVEHMFEGEHGSKDEWRGMVLAQAPIMKAWFYITYEKDPVLYMYQLLDDYKEGDLRIMPESSESPPTEREPGGVVDGLIGKHVEYTKEDGSKRIGMVIHQVEAKPSVYFIKFDDDFHIYVYDLVKKS

SEQ ID NO: 5902 - protein, 258 aa, Homo sapiens; identical to SEQ ID NO: 5901

SEQ ID NO: 5903 - protein, 157 aa, Homo sapiens
MKTPNAQEAEGQQTRAAAGRATGSANMTKKKVSQKKQRGRPSSQPRRNIVGCRISHGWKEGDEPITQWKGTVLDQLLDDYKEGDLRIMPESSESPPTEREPGGVVDGLIGKHVEYTKEDGSKRIGMVIHQVEAKPSVYFIKFDDDFHIYVYDLVKKS

SEQ ID NO: 5904 - protein, 258 aa, Homo sapiens; identical to SEQ ID NO: 5901

SEQ ID NO: 5905 - protein, 247 aa, Homo sapiens
MKTPNAQEAEGQQTRAAAGRATGSANMTKKKVSQKKQRGRPSSQPRRNIVGCRISHGWKEGDEPITQWKGTVLDQVPINPSLYLVKYDGIDCVYGLELHRDERVLSLKILSDRVASSHISDANLANTIIGKAVEHMFEGEHGSKDEWRGMVLAQAPIMKAWFYITYEKDPVLYMYQLLDDYKEGDLRIMPESSESPPTEREPGGVVDGLIGKHVEYTKEDGSKRIGMVIHQVEAKPSVYFIKFDDDF

SEQ ID NO: 5906 - protein, 501 aa, Homo sapiens
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVQRKQARTGEEREEEEEEQISESESEDEENEIIYNPKNLPLGWDGKPIPYWLYKLHGLNINYNCEICGNYTYRGPKAFQRHFAEWRHAHGMRCLGIPNTAHFANVTQIEDAVSLWAKLKLQKASERWQPDTEEEYEDSSGNVVNKKTYEDLKRQGLL

SEQ ID NO: 5907 - protein, 448 aa, Homo sapiens
METILEQQRRYHEEKERLMDVMAKEMLTKKSTLRDQINSDHRTRAMQDICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVQRKQARTGEEREEEEEEQISESESEDEENEIIYNPKNLPLGWDGKPIPYWLYKLHGLNINYNCEICGNYTYRGPKAFQRHFAEWRHAHGMRCLGIPNTAHFANVTQIEDAVSLWAKLKLQKASERWQPDTEEEYEDSSGNVVNKKTYEDLKRQGLL

SEQ ID NO: 5908 - protein, 86 aa, Homo sapiens
MTDRYTIHSQLEHLQSKYIGTGHADTTKWEWLVNQHRDSYCSYMGHFDLLNYFAIAENESKARVRFNLMEKMLQPCGPPADKPEEN

SEQ ID NO: 5909 - protein, 1003 aa, Homo sapiens
MYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPLPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKASFAPISFAIKAKENDLLPLEKNRVKLDDDSDDDEESKEGQESSSSAANTNPAVAPPCVVVEEKKPQLTQEELEAKQAKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKKKKKHKKRSRTRSRSPKYHSSSKSRSRSHSKAKHSLPSAYRTVRRSRVTASPGTLRAEPCQSSASVTAAAEPGSYQAASTTTRFDSASSFEGKPGKTSRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 5910 - protein, 951 aa, Homo sapiens
MYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPLPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKASFAPISFAIKAKENDLLPLEKNRVKLDDDSDDDEESKEGQESSSSAANTNPAVAPPCVVVEEKKPQLTQEELEAKQAKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKKKKKHKKRSRTRSRSPKYHSSSKSRSRSHSKAKHSLPSAYRTVRRSRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 5911 - protein, 547 aa, Homo sapiens
MGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPLPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKASFAPISFAIKAKENDLLPLEKNRKKRKKRKRKSTKK

SEQ ID NO: 5912 - protein, 696 aa, Homo sapiens
MEVSSPSPAQRLRRKKRPMVQGPAGCQVFQPSPSGGTAGDPGGLSDPFYPPRSGSLALGDPSSDPACSQSGPMEAEEDSLPEQPEDSAQLQQEKPSLYIGVRGTVVRSMQEVLWTRLRELPDPVLSEEVVEGIAAGIEAALWDLTQGTNGRYKTKYRSLLFNLRDPRNLDLFLKVVHGDVTPYDLVRMSSMQLAPQELARWRDQEEKRGLNIIEQQQKEPCRLPASKMTHKGEVEIQRDMDQTLTLEDLVGPQMFMDCSPQALPIASEDTTGQHDHHFLDPNCHICKDWEPSNELLGSFEAAKSCGDNIFQKALSQTPMPAPEMPKTRELSPTEPQDRVPPSGLHVPAAPTKALPCLPPWEGVLDMFSIKRFRARAQLVSGHSCRLVQALPTVIRSAGCIPSNIVWDLLASICPAKAKDVCVVRLCPHGARDTQNCRLLYSYLNDRQRHGLASVEHMGMVLLPLPAFQPLPTRLRPLGGPGLEVTHSSLLLAVLLPKEGLPDTAGSSPWLGKVQKMVSFNSKVEKRYYQPDDRRPNVPLKGTPPPGGAWQQSQGRGSIAPRGISAWQRPPRGRGRLWPEPENWQHPGRGQWPPEPGLRQSQHPYSVAPAGHGFGRGQHFHRDSCPHQALLRHLESLATMSHQLQALLCPQTKSSIPRPLQRLSSALAAPEPPGPARDSSLGPTDEAGSECPFPRKA

SEQ ID NO: 5913 - protein, 343 aa, Homo sapiens
GTKCLESLLGSVPPPCPGLHSLRELPDPVLSEEVVEGIAAGIEAALWDLTQGTNGRYKTKYRSLLFNLRDPRNLDLFLKVVHGDVTPYDLVRMSSMQLAPQELARWRDQEEKRGLNIIEQQQKEPCRLPASKMTHKGEVEIQRDMDQTLTLEDLGPQMFMDCSPQALPIASEDTTGQHDHHFLDPNCHICKDWEPSNELLGSFEAAKSCGDNIFQKALSQTPMPPPWEGVLDMFSIKRFRARAQLVSGHSCRLVQALPTVIRSAGCIPSNIVWDLLASICPAKAKVWRSLTQVCCWLCCSPRKGFQTQQGPAPGWGRFKRWSPSTVRWRRDTISQMTGGRMCP

SEQ ID NO: 5914 - protein, 1216 aa, Homo sapiens
MSQAGDVEGPSTGDPVLSPQHNCELLQNMEGASSMPGLSPDGPGASSGPGVRAGSRRKIPRKEALRGGSSRAAGAAEVRPGVLELLAVVQSRGSMLAPGLHMQLPSVPTQGRALTSKRLQVSLCDILDDSCPRKLCSRSAGLPERALACRERLAGVEEVSCLRPREARDGGMSSPGCDRRSPTLSKEEPPGRPLTSSPDPVPVRVRKKWRRQGAHSECEEGAGDFLWLDQSPRGDNLLSVGDPPQVADLESLGGPCRPPSPKDTGSGPGEPGGSGAGCASGTEKFGYLPATGDGPQPGSPCGPVGFPVPSGGESLSSAAQAPPQSAALCLGASAQASAEQQEAVCVVRTGSDEGQAPAQDQEELEAKAQPASRGRLEQGLAAPADTCASSREPLGGLSSSLDTEASRACSGPFMEQRRSKGTKNLKKGPVPCAQDRGTDRSSDNSHQDRPEEPSPGGCPRLEEVKIPHGVKLVCYLGSGPVIQLLGAISHGQAGGQLPPKLEVLEDLMEVSSPSPAQRLRRKKRPMVQGPAGCQVFQPSPSGGTAGDPGGLSDPFYPPRSGSLALGDPSSDPACSQSGPMEAEEDSLPEQPEDSAQLQQEKPSLYIGVRGTVVRSMQEVLWTRLRELPDPVLSEEVVEGIAAGIEAALWDLTQGTNGRYKTKYRSLLFNLRDPRNLDLFLKVVHGDVTPYDLVRMSSMQLAPQELARWRDQEEKRGLNIIEQQQKEPCRLPASKMTHKGEVEIQRDMDQTLTLEDLVGPQMFMDCSPQALPIASEDTTGQHDHHFLDPNCHICKDWEPSNELLGSFEAAKSCGDNIFQKALSQTPMPAPEMPKTRELSPTEPQDRVPPSGLHVPAAPTKALPCLPPWEGVLDMFSIKRFRARAQLVSGHSCRLVQALPTVIRSAGCIPSNIVWDLLASICPAKAKDVCVVRLCPHGARDTQNCRLLYSYLNDRQRHGLASVEHMGMVLLPLPAFQPLPTRLRPLGGPGLWALPVSPLLSPGLEVTHSSLLLAVLLPKEGLPDTAGSSPWLGKVQKMVSFNSKVEKRYYQPDDRRPNVPLKGTPPPGGAWQQSQGRGSIAPRGISAWQRPPRGRGRLWPEPENWQHPGRGQWPPEPGLRQSQHPYSVAPAGHGFGRGQHFHRDSCPHQALLRHLESLATMSHQLQALLCPQTKSSIPRPLQRLSSALAAPEPPGPARDSSLGPTDEAGSECPFPRKA

SEQ ID NO: 5915 - protein, 544 aa, Homo sapiens
MSQAGDVEGPSTGDPVLSPQHNCELLQNMEGASSMPGLSPDGPGASSGPGVRAGSRRKIPRKEALRGGSSRAAGAAEVRPGVLELLAVVQSRGSMLAPGLHMQLPSVPTQGRALTSKRLQVSLCDILDDSCPRKLCSRSAGLPERALACRERLAGVEEVSCLRPREARDGGMSSPGCDRRSPTLSKEEPPGRPLTSSPDPVPVRVRKKWRRQGAHSECEEGAGDFLWLDQSPRGDNLLSVGDPPQVADLESLGGPCRPPSPKDTGSGPGEPGGSGAGCASGTEKFGYLPATGDGPQPGSPCGPVGFPVPSGGESLSSAAQAPPQSAALCLGASAQASAEQQEAVCVVRTGSDEGQAPAQDQEELEAKAQPASRGRLEQGLAAPADTCASSREPLGGLSSSLDTEASRACSGPFMEQRRSKGTKNLKKGPVPCAQDRGTDRSSDNSHQDRPEEPSPGGCPRLEEVKIPHGVKLVCYVFQPSPSGGTAGDPGGLSDPFYPPRSGSLALGDPSSDPACSQSGPMEAEEDSLPEQPEDSAFGSSQTQC

SEQ ID NO: 5916 - protein, 269 aa, Homo sapiens
MQEVLWTRLRELPDPVLSEEVVEGIAAGIEAALWDLTQGTNGRYKTKYRSLLFNLRDPRNLDLFLKVVHGDVTPYDLVRMSSMQLAPQELARWRDQEEKRGPQMFMDCSPQALPIASEDTTGQHDHHFLDPNCHICKDWEPSNELLGSFEAAKSCGDNIFQKALSQTPMPAPEMPKTRELSPTEPQDRCGVGSREVDNPAGLRGRPPPGATDIALAFPVWPWASLPSLGNLTFPICAMELIIPASWQPPAQGQAWASVPVPTVGTQDLL

SEQ ID NO: 5917 - protein, 20 aa, Homo sapiens
MEVSSPSPAQRLRRKKRPMV

SEQ ID NO: 5918 - protein, 87 aa, Homo sapiens
MEVSSPSPAQRLRRKKRPMVQGPAGCQVFQPSPSGGTAGDPGGLSDPFYPPRSGSLALGDPSSDPACSQSGPMEAEEDSLPEQPEDS

SEQ ID NO: 5919 - protein, 1203 aa, Homo sapiens
MSQAGDVEGPSTGDPVLSPQHNCELLQNMEGASSMPGLSPDGPGASSGPGVRAGSRRKIPRKEALRGGSSRAAGAAEVRPGVLELLAVVQSRGSMLAPGLHMQLPSVPTQGRALTSKRLQVSLCDILDDSCPRKLCSRSAGLPERALACRERLAGVEEVSCLRPREARDGGMSSPGCDRRSPTLSKEEPPGRPLTSSPDPVPVRVRKKWRRQGAHSECEEGAGDFLWLDQSPRGDNLLSVGDPPQVADLESLGGPCRPPSPKDTGSGPGEPGGSGAGCASGTEKFGYLPATGDGPQPGSPCGPVGFPVPSGGESLSSAAQAPPQSAALCLGASAQASAEQQEAVCVVRTGSDEGQAPAQDQEELEAKAQPASRGRLEQGLAAPADTCASSREPLGGLSSSLDTEASRACSGPFMEQRRSKGTKNLKKGPVPCAQDRGTDRSSDNSHQDRPEEPSPGGCPRLEEVKIPHGVKLVCYLGSGPVIQLLGAISHGQAGGQLPPKLEVLEDLMEVSSPSPAQRLRRKKRPMVQGPAGCQVFQPSPSGGTAGDPGGLSDPFYPPRSGSLALGDPSSDPACSQSGPMEAEEDSLPEQPEDSAQLQQEKPSLYIGVRGTVVRSMQEVLWTRLRELPDPVLSEEVVEGIAAGIEAALWDLTQGTNGRYKTKYRSLLFNLRDPRNLDLFLKVVHGDVTPYDLVRMSSMQLAPQELARWRDQEEKRGLNIIEQQQKEPCRLPASKMTHKGEVEIQRDMDQTLTLEDLVGPQMFMDCSPQALPIASEDTTGQHDHHFLDPNCHICKDWEPSNELLGSFEAAKSCGDNIFQKALSQTPMPAPEMPKTRELSPTEPQDRVPPSGLHVPAAPTKALPCLPPWEGVLDMFSIKRFRARAQLVSGHSCRLVQALPTVIRSAGCIPSNIVWDLLASICPAKAKDVCVVRLCPHGARDTQNCRLLYSYLNDRQRHGLASVEHMGMVLLPLPAFQPLPTRLRPLGGPGLEVTHSSLLLAVLLPKEGLPDTAGSSPWLGKVQKMVSFNSKVEKRYYQPDDRRPNVPLKGTPPPGGAWQQSQGRGSIAPRGISAWQRPPRGRGRLWPEPENWQHPGRGQWPPEPGLRQSQHPYSVAPAGHGFGRGQHFHRDSCPHQALLRHLESLATMSHQLQALLCPQTKSSIPRPLQRLSSALAAPEPPGPARDSSLGPTDEAGSECPFPRKA

SEQ ID NO: 5920 - protein, 1312 aa, Homo sapiens
MEEEDESRGKTEESGEDRGDGPPDRDPTLSPSAFILRAIQQAVGSSLQGDLPNDKDGSRCHGLRWRRCRSPRSEPRSQESGGTDTATVLDMATDSFLAGLVSVLDPPDTWVPSRLDLRPGESEDMLELVAEVRIGDRDPIPLPVPSLLPRLRAWRTGKTVSPQSNSSRPTCARHLTLGTGDGGPAPPPAPSSASSSPSPSPSSSSPSPPPPPPPPAPPAPPAPRFDIYDPFHPTDEAYSPPPAPEQKYDPFEPTGSNPSSSAGTPSPEEEEEEEEEEEEEEEDEEEEEGLSQSISRISETLAGIYDDNSLSQDFPGDESPRPDAQPTQPTPAPGTPPQVDSTRADGAMRRRVFVVGTEAEACREGKVSVEVVTAGGAALPPPLLPPGDSEIEEGEIVQPEEEPRLALSLFRPGGRAARPTPAASATPTAQPLPQPPAPRAPEGDDFLSLHAESDGEGALQVDLGEPAPAPPAADSRWGGLDLRRKILTQRRERYRQRSPSPAPAPAPAAAAGPPTRKKSRRERKRSGEAKEAASSSSGTQPAPPAPASPWDSKKHRSRDRKPGSHASSSARRRSRSRSRSRSTRRRSRSTDRRRGGSRRSRSREKRRRRRRSASPPPATSSSSSSRRERHRGKHRDGGGSKKKKKRSRSRGEKRSGDGSEKAPAPAPPPSGSTSCGDRDSRRRGAVPPSIQDLTDHDLFAIKRTITVGRLDKSDPRGPSPAPASSPKREVLYDSEGLSGEERGGKSSQKDRRRSGAASSSSSSREKGSRRKALDGGDRDRDRDRDRDRDRSSKKARPPKESAPSSGPPPKPPVSSGSGSSSSSSSCSSRKVKLQSKVAVLIREGVSSTTPAKDAASAGLGSIGVKFSRDRESRSPFLKPDERAPTEMAKAAPGSTKPKKTKVKAKAGAKKTKGTKGKTKPSKTRKKVRSGGGSGGSGGQVSLKKSKADSCSQAAGTKGAEETSWSGEERAAKVPSTPPPKAAPPPPALTPDSQTVDSSCKTPEVSFLPEEATEEAGVRGGAEEEEEEEEEEEEEEEEEEQQPATTTATSTAAAAPSTAPSAGSTAGDSGAEDGPASRVSQLPTLPPPMPWNLPAGVDCTTSGVLALTALLFKMEEANLASRAKAQELIQATNQILSHRKPPSSLGMTPAPVPTSLGLPPGPSSYLLPGSLPLGGCGSTPPTPTGLAATSDKREGSSSSEGRGDTDKYLKKLHTQERAVEEVKLAIKPYYQKKDITKEEYKDILRKAVHKICHSKSGEINPVKVSNLVRAYVQRYRYFRKHGRKPGDPPGPPRPPKEPGPPDKGGPGLPLPPL

SEQ ID NO: 5921 - protein, 219 aa, Homo sapiens
MEEEDESRGKTEESGEDRGDGPPDRDPTLSPSAFILRAIQQAVGSSLQGDLPNDKDGSRCHGLRWRRCRSPRSEPRSQESGGTDTATVLDMATDSFLAGLVSVLDPPDTWVPSRLDLRPGESEDMLELVAEVRIGDRDPIPLPVPSLLPRLRAWRTGKTVSPQSNSSRPTCARHLTLGTGDGPCPTPCPLLCILLPFPFSLIFLPFPSPTPTAPSPQFH

SEQ ID NO: 5922 - protein, 1147 aa, Homo sapiens
MDAVNAFNQELFSLMDMKPPISRAKMILITKAAIKAIKLYKHVVQIVEKFIKKCKPEYKVPGLYVIDSIVRQSRHQFGTDKDVFGPRFSKNITATFQYLYLCPSEDKSKIVRVLNLWQKNGVFKIEIIQPLLDMAAGTSNAAPVAENVTNNEGSPPPPVKVSSEPPTQATPNSVPAVPQLPSSDAFAAVAQLFQTTQGQQLQQILQTFQQPPKPQSPALDNAVMAQVQAITAQLKTTPTQPSEQKAAFPPPEQKTAFDKKLLDRFDYDDEPEAVEESKKEDTTAVTTTAPAAAVPPAPTATVPAAAAPAAASPPPPQAPFGFPGDGMQQPAYTQHQNMDQFQPRMMGIQQDPMHHQVPLPPNGQMPGFGLLPTPPFPPMAQPVIPPTPPVQQPFQASFQAQNEPLTQKPHQQEMEVEQPCIQEVKRHMSDNRKSRSRSASRSPKRRRSRSGSRSRRSRHRRSRSRSRDRRRHSPRSRSQERRDREKERERRQKGLPQVKPETASVCSTTLWVGQLDKRTTQQDVASLLEEFGPIESINMIPPRGCAYIVMVHRQDAYRALQKLSRGNYKVNQKSIKIAWALNKGIKADYKQYWDVELGVTYIPWDKVKPEELESFCEGGMLDSDTLNPDWKGIPKKPENEVAQNGGAETSHTEPVSPIPKPLPVPVPPIPVPAPITVPPPQVPPHQPGPPVVGALQPPAFTPPLGIPPPGFGPGVPPPPPPPPFLRPGFNPMHLPPGFLPPGPPPPITPPVSIPPPHTPPISIPNSTIAGINEDTTKDLSIGNPIPTVVSGARGNAESGDSVKMYGSAVPPAAPTNLPTPPVTQPVSLLGTQGVAPGPVIGLQAPSTGLLGARPGLIPLQRPPGMPPPHLQRFPLMPPRPMPPHMMHRGPPPGPGGFAMPPPHGMKGPFPPHGPFVRPGGMPGLGGPGPGPGGPEDRDGRQQPPQQPQQQPQPQAPQQPQQQQQQQPPPSQQPPPTQQQPQQFRNDNRQQFNSGRDQERFGRRSFGNRVENDRERYGNRNDDRDNSNRDRREWGRRSPDRDRHRDLEERNRRSSGHRDRERDSRDRESRREKEEARGKEKPEVTDRAGGNKTVEPPISQVGNVDTASELEKGVSEAAVLKPSEELPAEATSSVEPEKDSGSAAEAPR

SEQ ID NO: 5923 - protein, 1125 aa, Homo sapiens
MDAVNAFNQELFSLMDMKPPISRAKMILITKAAIKAIKLYKHVVQIVEKFIKKCKPEYKVPGLYVIDSIVRQSRHQFGTDKDVFGPRFSKNITATFQYLYLCPSEDKSKIVRVLNLWQKNGVFKIEIIQPLLDMAAGTSNAAPVAENVTNNEGSPPPPVKVSSEPPTQATPNSVPAVPQLPSSDAFAAVAQLFQTTQGQQLQQILQTFQQPPKPQSPALDNAVMAQVQAITAQLKTTPTQPSEQKAAFPPPEQKTAFDKKLLDRFDYDDEPEAVEESKKEDTTAVTTTAPAAAVPPAPTATVPAAAAPAAASPPPPQAPFGFPGDGMQQPAYTQHQNMDQFQPRMMGIQQDPMHHQVPLPPNGQMPGFGLLPTPPFPPMAQPVIPPTPPVQQPFQASFQAQNEPLTQKPHQQEMEVEQPCIQEVKRHMSDNRKSRSRSASRSPKRRRSRSGSRSRRSRHRRSRSRSRDRRRHSPRSRSQERRDREKERERRQKGLPQVKPETASVCSTTLWVGQLDKRTTQQDVASLLEEFGPIESINMIPPRGCAYIVMVHRQDAYRALQKLSRGNYKVNQKSIKIAWALNKGIKADYKQYWDVELGVTYIPWDKVKPEELESFCEGGMLDSDTLNPDWKGIPKKPENEVAQNGGAETSHTEPVSPIPKPLPVPVPPIPVPAPITVPPPQVPPHQPGPPVVGALQPPAFTPPLGIPPPGFGPGVPPPPPPPPFLRPGFNPMHLPPGFLPPGPPPPITPPVSIPPPHTPPISIPNLVSGARGNAESGDSVKMYGSAVPPAAPTNLPTPPVTQPVSLLGTQGVAPGPVIGLQAPSTGLLGARPGLIPLQRPPGMPPPHLQRFPLMPPRPMPPHMMHRGPPPGPGGFAMPPPHGMKGPFPPHGPFVRPGGMPGLGGPGPGPGGPEDRDGRQQPPQQPQQQPQPQAPQQPQQQQQQQPPPSQQPPPTQQQPQQFRNDNRQQFNSGRDQERFGRRSFGNRVENDRERYGNRNDDRDNSNRDRREWGRRSPDRDRHRDLEERNRRSSGHRDRERDSRDRESRREKEEARGKEKPEVTDRAGGNKTVEPPISQVGNVDTASELEKGVSEAAVLKPSEELPAEATSSVEPEKDSGSAAEAPR

SEQ ID NO: 5924 - protein, 1132 aa, Homo sapiens
MDAVNAFNQELFSLMDMKPPISRAKMILITKAAIKAIKCKPEYKVPGLYVIDSIVRQSRHQFGTDKDVFGPRFSKNITATFQYLYLCPSEDKSKIVRVLNLWQKNGVFKIEIIQPLLDMAAGTSNAAPVAENVTNNEGSPPPPVKVSSEPPTQATPNSVPAVPQLPSSDAFAAVAQLFQTTQGQQLQQILQTFQQPPKPQSPALDNAVMAQVQAITAQLKTTPTQPSEQKAAFPPPEQKTAFDKKLLDRFDYDDEPEAVEESKKEDTTAVTTTAPAAAVPPAPTATVPAAAAPAAASPPPPQAPFGFPGDGMQQPAYTQHQNMDQFQPRMMGIQQDPMHHQVPLPPNGQMPGFGLLPTPPFPPMAQPVIPPTPPVQQPFQASFQAQNEPLTQKPHQQEMEVEQPCIQEVKRHMSDNRKSRSRSASRSPKRRRSRSGSRSRRSRHRRSRSRSRDRRRHSPRSRSQERRDREKERERRQKGLPQVKPETASVCSTTLWVGQLDKRTTQQDVASLLEEFGPIESINMIPPRGCAYIVMVHRQDAYRALQKLSRGNYKVNQKSIKIAWALNKGIKADYKQYWDVELGVTYIPWDKVKPEELESFCEGGMLDSDTLNPDWKGIPKKPENEVAQNGGAETSHTEPVSPIPKPLPVPVPPIPVPAPITVPPPQVPPHQPGPPVVGALQPPAFTPPLGIPPPGFGPGVPPPPPPPPFLRPGFNPMHLPPGFLPPGPPPPITPPVSIPPPHTPPISIPNSTIAGINEDTTKDLSIGNPIPTVVSGARGNAESGDSVKMYGSAVPPAAPTNLPTPPVTQPVSLLGTQGVAPGPVIGLQAPSTGLLGARPGLIPLQRPPGMPPPHLQRFPLMPPRPMPPHMMHRGPPPGPGGFAMPPPHGMKGPFPPHGPFVRPGGMPGLGGPGPGPGGPEDRDGRQQPPQQPQQQPQPQAPQQPQQQQQQQPPPSQQPPPTQQQPQQFRNDNRQQFNSGRDQERFGRRSFGNRVENDRERYGNRNDDRDNSNRDRREWGRRSPDRDRHRDLEERNRRSSGHRDRERDSRDRESRREKEEARGKEKPEVTDRAGGNKTVEPPISQVGNVDTASELEKGVSEAAVLKPSEELPAEATSSVEPEKDSGSAAEAPR

SEQ ID NO: 5925 - protein, 1271 aa, Homo sapiens
MEAVKTFNSELYSLNDYKPPISKAKMTQITKAAIKAIKFYKHVVQSVEKFIQKCKPEYKVPGLYVIDSIVRQSRHQFGQEKDVFAPRFSNNIISTFQNLYRCPGDDKSKIVRVLNLWQKNNVFKSEIIQPLLDMAAGIPPPVVTPVLASTTTAMSNTPGTPVTPVTPANVVQGLPDPWVSQITNTDTLAAVAQILQSPQGQQLQQLIQTLQIQQQKPQPSILQALDAGLVVQLQALTAQLTAAAAAANTLTPLEQGVSFNKKLMDRFDFGEDSEHSEEPKKEIPASQLSHVSESVNNSIFHQIAEQLQQQNLEHLRQQLLEQQQPQKATPQDSQEGTFGSEHSASPSQGSSQQHFLEPEVNLDDSIDIQQQDMDIDEGQDGVEEEVFEQEAKKVAVRSRSRTHSRSRSRSPRKRRSRSRSGSRKRKHRKRSRSRSRERKRKSSRSYSSERRAREREKERQKKGLPPIRSKTLSVCSTTLWVGQVDKKATQQDLTNLFEEFGQIESINMIPPRGCAYVCMVHRQDAFRALQKLSSGSYKIGSKVIKIAWALNKGVKTEYKQFWDVDLGVTYIPWEKVKVDDLEGFAEGGMIDQETVNTEWETVKSSEPVKETVQTTQSPTPVEKETVVTTQAEVFPPPVAMLQIPVAPAVPTVSLVPPAFPVSMPVPPPGFSPIPPPPFLRASFNPSQPPPGFMPPPVPPPVVPPPTIPPVVPTSLVQPSLSMTPETVKDVGFGSLVIPGGSVASNLATSALPAGNVFNAPTKQAEPEEKVPHLIDHQISSGENTRSVIPNDISSNAAILGGQPPNVTSNSGILGVQRPNVSSNSEILGVRPSNVSSSSGIIAAQPPNILNNSGILGIQPPSVSNSSGLLGVLPPNIPNNSGLVGVQPPNVPNTPGLLGTQPPAGPQNLPPLSIPNQRMPTMPMLDIRPGLIPQAPGPRFPLIQPGIPPQRGIPPPSVLDSALHPPPRGPFPPGDIFSQPERPFLAPGRQSVDNVTNPEKRIPLGNDNIQQEGDRDYRFPPIETRESISRPPPVDVRDVVGRPIDPREGPGRPPLDGRDHFGRPPVDIRENLVRPGIDHLGRRDHFGFNPEKPWGHRGDFDEREHRVLPVYGGPKGLHEERGRFRSGNYRFDPRSGPWNRGFGQEVHRDFDDRRRPWERQRDRDDRDFDFCREMNGNRLGRDRIQNTWVPPPHARVFDYFEGATSQRKGDNVPQVNGENTERHAQPPPIPVQNDPELYEKLTSSNEINKEKSDTVADIESEPVVESTETEGT

SEQ ID NO: 5926 - protein, 1337 aa, Homo sapiens
MPQPLLPALPPLSSPSGAGSCGPSGGECSGRRLFRRRARGLRSDNMEAVKTFNSEDCASTPACTDCFSSSMDTRSILYSLNDYKPPISKAKMTQITKAAIKAIKFYKHVVQSVEKFIQKCKPEYKVPGLYVIDSIVRQSRHQFGQEKDVFAPRFSNNIISTFQNLYRCPGDDKSKIVRVLNLWQKNNVFKSEIIQPLLDMAAGIPPPVVTPVLASTTTAMSNTPGTPVTPVTPANVVQGLPDPWVSQITNTDTLAAVAQILQSPQGQQLQQLIQTLQIQQQKPQPSILQALDAGLVVQLQALTAQLTAAAAAANTLTPLEQGVSFNKKLMDRFDFGEDSEHSEEPKKEIPASQLSHVSESVNNSIFHQIAEQLQQQNLEHLRQQLLEQQQPQKATPQDSQEGTFGSEHSASPSQGSSQQHFLEPEVNLDDSIDIQQQDMDIDEGQDGVEEEVFEQEAKKVAVRSRSRTHSRSRSRSPRKRRSRSRSGSRKRKHRKRSRSRSRERKRKSSRSYSSERRAREREKERQKKGLPPIRSKTLSVCSTTLWVGQVDKKATQQDLTNLFEEFGQIESINMIPPRGCAYVCMVHRQDAFRALQKLSSGSYKIGSKVIKIAWALNKGVKTEYKQFWDVDLGVTYIPWEKVKVDDLEGFAEGGMIDQETVNTEWETVKSSEPVKETVQTTQSPTPVEKETVVTTQAEVFPPPVAMLQIPVAPAVPTVSLVPPAFPVSMPVPPPGFSPIPPPPFLRASFNPSQPPPGFMPPPVPPPVVPPPTIPPVVPTSLVQPSLSMTPETVKDVGFGSLVIPGGSVASNLATSALPAGNVFNAPTKQAEPEEKVPHLIDHQISSGENTRSVIPNDISSNAAILGGQPPNVTSNSGILGVQRPNVSSNSEILGVRPSNVSSSSGIIAAQPPNILNNSGILGIQPPSVSNSSGLLGVLPPNIPNNSGLVGVQPPNVPNTPGLLGTQPPAGPQNLPPLSIPNQRMPTMPMLDIRPGLIPQAPGPRFPLIQPGIPPQRGIPPPSVLDSALHPPPRGPFPPGDIFSQPERPFLAPGRQSVDNVTNPEKRIPLGNDNIQQEGDRDYRFPPIETRESISRPPPVDVRDVVGRPIDPREGPGRPPLDGRDHFGRPPVDIRENLVRPGIDHLGRRDHFGFNPEKPWGHRGDFDEREHRVLPVYGGPKGLHEERGRFRSGNYRFDPRSGPWNRGFGQEVHRDFDDRRRPWERQRDRDDRDFDFCREMNGNRLGRDRIQNTWVPPPHARVFDYFEGATSQRKGDNVPQVNGENTERHAQPPPIPVQNDPELYEKLTSSNEINKEKSDTVADIESEPVVESTETEGT

SEQ ID NO: 5927 - protein, 1271 aa, Homo sapiens; identical to SEQ ID NO: 5925

SEQ ID NO: 5928 - protein, 753 aa, Homo sapiens [sequence omitted]

SEQ ID NO: 5929 - protein, 501 aa, Homo sapiens
MERARPEPPPQPRPLRPAPPPLPVEGTSFWAAAMEPPPSSPTLSAAASATLASSCGEAVASGLQPAVRRLLQVKPEQVLLLPQPQAQNEEAAASSAQARLLQFRPDLRLLQPPTASDGATSRPELHPVQPLALHVKAKKQKLGPSLDQSVGPRGAVETGPRASRVVKLEGPGPALGYFRGDEKGKLEAEEVMRDSMQGGAGKSPAAIREGVIKTEEPERLLEDCRLGAEPASNGLVHGSAEVILAPTSGAFGPHQQDLRIPLTLHTVPPGARIQFQGAPPSELIRLTKVPLTPVPTKMQSLLEPSVKIETKDVPLTVLPSDAGIPDTPFSKDRNGHVKRPMNAFMVWARIHRPALAKANPAANNAEISVQLGLEWNKLSEEQKKPYYDEAQKIKEKHREEFPGWVYQPRPGKRKRFPLSVSNVFSGTTQNIISTNPTTVYPYRSPTYSVVIPSLQNPITHPVVHALTVGLPLAMEIFRVQCQNALVIMKTGTQNMRVSFQL

SEQ ID NO: 5930 - protein, 194 aa, Homo sapiens
MPSSPLRVAVVCSSNQNRSMEAHNILSKRGFSVRSFGTGTHVKLPGPAPDKPNVYDFKTTYDQMYNDLLRKDKELYTQNGILHMLDRNKRIKPRPERFQNCKDLFDLILTCEERVYDQVVEDLNSREQETCQPVHVVNVDIQDNHEEATLGAFLICELCQCIQHTEDMENEIDELLQEFEEKSGRTFLHTVCFY

SEQ ID NO: 5931 - protein, 153 aa, Homo sapiens
MPSSPLRVAVVCSSNQNRSMEAHNILSKRGFSVRSFGTGTHVKLPGPAPDKPNVYDFKTTYDQMYNDLLRKDKELYPSGLPFKNPPCGPPWKVLRVARAQEACHPVQCTHWLLCLCESLVSIPGARRIVHGLVPVPPMAVGVVRRTDTVWGSP

SEQ ID NO: 5932 - protein, 162 aa, Homo sapiens
MPSSPLRVAVVCSSNQNRSMEAHNILSKRGFSVRSFGTGTHVKLPGPAPDKPNVYDFKTTYDQMYNDLLRKDKELYTQNGILHMLDRNKRIKPRPERFQNCKDLFDLILTCEERVYDQVVEGEEAAACWAGLQQLSQGLGMPAGPHHDQYSPSRVAGAGEQT

SEQ ID NO: 5933 - protein, 111 aa, Homo sapiens [sequence omitted]

SEQ ID NO: 5934 - protein, 202 aa, Homo sapiens
MFTELRSKLSPPRGRAGAVRAGFGERRDVDATAHFSFCRTLLEHTVSAESIPCHLPRTPGTSLTWHDSRSQRAASSRPIKLLQQPGTDTPQGRLYSDHYGLYHTSPSLGGLTRPVVLWSQQDVCKWLKKHCPHNYLVYVEAFSQHAITGRALLRLNAEKLQRMGLAQEAQRQEVLQQVLRLQVREEGRSLQLLSQASFGKMS

SEQ ID NO: 5935 - protein, 106 aa, Homo sapiens
MFTELRSKLSPPRGRAGAVRAGFGERRDVDGSVHLQIPYRAFIHSFIDNECGVPLCNQTWIKTPASPDSATAHFSFCRTLLEHTVSAESIPCHLPRTPGTSLTWHD

SEQ ID NO: 5936 - protein, 681 aa, Homo sapiens
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCSQDGNLPTLISSVHRSRHLVMPEHQSRCEFQRGSLEIGLRPAGDLLGKRLGRSPRISSDCFSEKRARSESPQEALLLPRELGPSMAPEDHYRRLVSALSEASTFEDPQRLYHLGLPSHGEDPPWHDPPHHLPSHDLLRVRQEVAAAALRGPSGLEAHLPSSTAGQRRKQGLAQHREGAAPAAAPSFSERELPQPPPLLSPQNAPHVALGPHLRPPFLGVPSALCQTPGYGFLPPAQAEMFAWQQELLRKQNLARLELPADLLRQKELESARPQLLAPETALRPNDGAEELQRRGALLVLNHGAAPLLALPPQGPPGSGPPTPSRDSARRAPRKGGPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQVARRLGRVFYVASFPVALPLQPPTLRAPERELGTGEQPLSPTTATSPYGGGHALAGQTSPKQENGTLALLPGAPDPSQPLC

SEQ ID NO: 5937 - protein, 179 aa, Homo sapiens
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCSQDGNLPTLISSVHRSRHLVMPEHQSRCEFQRGSLEIGLRPAGDLLGKRLGRSPRISSDCFSEKRARSESPQEALLLP

SEQ ID NO: 5938 - protein, 109 aa, Homo sapiens
MSKGILQVHPPICDCPGCRISSPVNRGRLADKRTVALPAARNLKKERTPSFSASDGDSDGSGPTCGRRPGLKQEDGPHIRIMKRRVHTHWDVNISFREASCSQDGNLPT

SEQ ID NO: 5939 - protein, 201 aa, Homo sapiens
MAVEALHCGLNPRGIDHPAHAEGIKLQIEGEGVESQSIKNKNFQKVPDQKGTPKRLQAEAETAKSATVKLSKPVALWTQQDVCKWLKKHCPNQYQIYSESFKQHDITGRALLRLTDKKLERMGIAQENLRQHILQQVLQLKVREEVRNLQLLTQGTLLLPDGWMDGEIRRKTTLLLGQTGVRENLLLFLHRISIIENSIQI

SEQ ID NO: 5940 - protein, 161 aa, Homo sapiens
MAVEALHCGLNPRGIDHPAHAEGIKLQIEGEGVESQSIKNKNFQKVPDQKGTPKRLQAEAETAKSATVKLSKPVALWTQQDVCKWLKKHCPNQYQIYSESFKQHDITGRALLRLTDKKLERMGIAQENLRQHILQQVLQLKVREEVRNLQLLTQASSEGSP

SEQ ID NO: 5941 - protein, 92 aa, Homo sapiens
MRSCLMPGNEMSMTSPEGTEPKGKQRRWQRQKTFGGGTMHSQDSQEIDGKSLLLMTRNDVLTGLQLKLGPALKIYEYHVKPLQTKHLKNNSS

SEQ ID NO: 5942 - protein, 102 aa, Homo sapiens
MLSVDMENKENGSVGVKNSMENGRPPDPADWAVMDVVNYFRTVGFEEQASAFQEQEIDGKSLLLMTRNDVLTGLQLKLGPALKIYEYHVKPLQTKHLKNNSS

SEQ ID NO: 5943 - protein, 102 aa, Homo sapiens; identical to SEQ ID NO: 5942

SEQ ID NO: 5944 - protein, 102 aa, Homo sapiens; identical to SEQ ID NO: 5942

SEQ ID NO: 5945 - protein, 122 aa, Homo sapiens
MANSLLEGVFAEVKEPCSLPMLSVDMENKENGSVGVKNSMENGRPPDPADWAVMDVVNYFRTVGFEEQASAFQEQEIDGKSLLLMTRNDVLTGLQLKLGPALKIYEYHVKPLQTKHLKNNSS

SEQ ID NO: 5946 - protein, 116 aa, Homo sapiens
MRGVAEVKEPCSLPMLSVDMENKENGSVGVKNSMENGRPPDPADWAVMDVVNYFRTVGFEEQASAFQEQEIDGKSLLLMTRNDVLTGLQLKLGPALKIYEYHVKPLQTKHLKNNSS

SEQ ID NO: 5947 - protein, 102 aa, Homo sapiens; identical to SEQ ID NO: 5942

SEQ ID NO: 5948 - protein, 1221 aa, Homo sapiens
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQSVVDDWIESYKQDRDIALLDLINFFIQCSGCRGTVRIEMFRNMQNAEIIRKMTEEFDEDSGDYPLTMPGPQWKKFRSNFCEFIGVLIRQCQYSIIYDEYMMDTVISLLTGLSDSQVRAFRHTSTLAAMKLMTALVNVALNLSIHQDNTQRQYEAERNKMIGKRANERLELLLQKRKELQENQDEIENMMNSIFKGIFVHRYRDAIAEIRAICIEEIGVWMKMYSDAFLNDSYLKYVGWTLHDRQGEVRLKCLKALQSLYTNRELFPKLELFTNRFKDRIVSMTLDKEYDVAVEAIRLVTLILHGSEEALSNEDCENVYHLVYSAHRPVAVAAGEFLHKKLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCSEEYTIQNRVDIARSQLIDEFVDRFNHSVEDLLQEGEEADDDDIYNVLSTLKRLTSFHNAHDLTKWDLFGNCYRLLKTGIEHGAMPEQIVVQALQCSHYSILWQLVKITDGSPSKEDLLVLRKTVKSFLAVCQQCLSNVNTPVKEQAFMLLCDLLMIFSHQLMTGGREGLQPLVFNPDTGLQSELLSFVMDHVFIDQDEENQSMEGDEEDEANKIEALHKRRNLLAAFSKLIIYDIVDMHAAADIFKHYMKYYNDYGDIIKETLSKTRQIDKIQCAKTLILSLQQLFNELVQEQGPNLDRTSAHVSGIKELARRFALTFGLDQIKTREAVATLHKDGIEFAFKYQNQKGQEYPPPNLAFLEVLSEFSSKLLRQDKKTVHSYLEKFLTEQMMERREDVWLPLISYRNSLVTGGEDDRMSVNSGSSSSKTSSVRNKKGRPPLHKKRVEDESLDNTWLNRTDTMIQTPGPLPAPQLTSTVLRENSRPMGDQIQEPESEHGSEPDFLHNRGLMEEDAEPIFEDVMMSSRSQLEDMNEEFEDTMVIDLPPSRNRRERAELRPDFFDSAAIIEDDSGFGMPMF

SEQ ID NO: 5949 - protein, 1258 aa, Homo sapiens
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQSVVDDWIESYKQDRDIALLDLINFFIQCSGCRGTVRIEMFRNMQNAEIIRKMTEEFDEDSGDYPLTMPGPQWKKFRSNFCEFIGVLIRQCQYSIIYDEYMMDTVISLLTGLSDSQVRAFRHTSTLAAMKLMTALVNVALNLSIHQDNTQRQYEAERNKMIGKRANERLELLLQKRKELQENQDEIENMMNSIFKGIFVHRYRDAIAEIRAICIEEIGVWMKMYSDAFLNDSYLKYVGWTLHDRQGEVRLKCLKALQSLYTNRELFPKLELFTNRFKDRIVSMTLDKEYDVAVEAIRLVTLILHGSEEALSNEDCENVYHLVYSAHRPVAVAAGEFLHKKLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCSEEYTIQNRVDIARSQLIDEFVDRFNHSVEDLLQEGEEADDDDIYNVLSTLKRLTSFHNAHDLTKWDLFGNCYRLLKTGIEHGAMPEQIVVQALQCSHYSILWQLVKITDGSPSKEDLLVLRKTVKSFLAVCQQCLSNVNTPVKEQAFMLLCDLLMIFSHQLMTGGREGLQPLVFNPDTGLQSELLSFVMDHVFIDQDEENQSMEGDEEDEANKIEALHKRRNLLAAFSKLIIYDIVDMHAAADIFKHYMKYYNDYGDIIKETLSKTRQIDKIQCAKTLILSLQQLFNELVQEQGPNLDRTSAHVSGIKELARRFALTFGLDQIKTREAVATLHKDGIEFAFKYQNQKGQEYPPPNLAFLEVLSEFSSKLLRQDKKTVHSYLEKFLTEQMMERREDVWLPLISYRNSLVTGGEDDRMSVNSGSSSSKTSSVRNKKGRPPLHKKRVEDESLDNTWLNRTDTMIQTPGPLPAPQLTSTVLRENSRPMGDQIQEPESEHGSEPDFLHNPQMQISWLGQPKLEDLNRKDRTGMNYMKVRTGVRHAVRGLMEEDAEPIFEDVMMSSRSQLEDMNEEFEDTMVIDLPPSRNRRERAELRPDFFDSAAIIEDDSGFGMPMF

SEQ ID NO: 5950 - protein, 998 aa, Homo sapiens
MKLMTALVNVALNLSIHQDNTQRQYEAERNKMIGKRANERLELLLQKRKELQENQDEIENMMNSIFKGIFVHRYRDAIAEIRAICIEEIGVWMKMYSDAFLNDSYLKYVGWTLHDRQGEVRLKCLKALQSLYTNRELFPKLELFTNRFKDRIVSMTLDKEYDVAVEAIRLVTLILHGSEEALSNEDCENVYHLVYSAHRPVAVAAGEFLHKKLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCSEEYTIQNRVDIARSQLIDEFVDRFNHSVEDLLQEGEEADDDDIYNVLSTLKRLTSFHNAHDLTKWDLFGNCYRLLKTGIEHGAMPEQIVVQALQCSHYSILWQLVKITDGSPSKEDLLVLRKTVKSFLAVCQQCLSNVNTPVKEQAFMLLCDLLMIFSHQLMTGGREGLQPLVFNPDTGLQSELLSFVMDHVFIDQDEENQSMEGDEEDEANKIEALHKRRNLLAAFSKLIIYDIVDMHAAADIFKHYMKLFNELVQEQGPNLDRTSAHVSGIKELARRFALTFGLDQIKTREAVATLHKDGIEFAFKYQNQKGQEYPPPNLAFLEVLSEFSSKLLRQDKKTVHSYLEKFLTEQMMERREDVWLPLISYRNSLVTGGEDDRMSVNSGSSSSKTSSVRNKKGRPPLHKKRVEDESLDNTWLNRTDTMIQTPGPLPAPQLTSTVLRENSRPMGDQIQEPESEHGSEPDFLHNPQMQISWLGQPKLEDLNRKDRTGMNYMKVRTGVRHAVRGLMEEDAEPIFEDVMMSSRSQLEDMNEEFEDTMVIDLPPSRNRRERAELRPDFFDSAAIIEDDSGFGMPMF

SEQ ID NO: 5951 - protein, 842 aa, Homo sapiens
MTLDKEYDVAVEAIRLVTLILQLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCSEEYTIQNRVDIARSQLIDEFVDRFNHSVEDLLQEGEEADDDDIYNVLSTLKRLTSFHNAHDLTKWDLFGNCYRLLKTGIEHGAMPEQIVVQALQCSHYSILWQLVKITDGSPSKEDLLVLRKTVKSFLAVCQQCLSNVNTPVKEQAFMLLCDLLMIFSHQLMTGGREGLQPLVFNPDTGLQSELLSFVMDHVFIDQDEENQSMEGDEEDEANKIEALHKRRNLLAAFSKLIIYDIVDMHAAADIFKHYMKYYNDYGDIIKETLSKTRQIDKIQCAKTLILSLQQLFNELVQEQGPNLDRTSAHVSGIKELARRFALTFGLDQIKTREAVATLHKDGIEFAFKYQNQKGQEYPPPNLAFLEVLSEFSSKLLRQDKKTVHSYLEKFLTEQMMERREDVWLPLISYRNSLVTGGEDDRMSVNSGSSSSKTSSVRNKKGRPPLHKKRVEDESLDNTWLNRTDTMIQTPGPLPAPQLTSTVLRENSRPMGDQIQEPESEHGSEPDFLHNPQMQISWLGQPKLEDLNRKDRTGMNYMKVRTGVRHAVRGLMEEDAEPIFEDVMMSSRSQLEDMNEEFEDTMVIDLPPSRNRRERAELRPDFFDSAAIIEDDSGFGMPMF

SEQ ID NO: 5952 - protein, 134 aa, Homo sapiens
MIFSMLRKLPKVTCRDVLPEIRAICIEEIGCWMQSYSTSFLTDSYLKYIGWTLHDKHREVRVKCVKALKGLYGNRDLTARLELFTGRFKDWMVSMIVDREYSVAVEAVRLLILILKNMEGVLMDVDCESVYPIV

SEQ ID NO: 5953 - protein, 205 aa, Homo sapiens
MIFSMLRKLPKVTCRDVLPEIRAICIEEIGCWMQSYSTSFLTDSYLKYIGWTLHDKHREVRVKCVKALKGLYGNRDLTARLELFTGRFKDWMVSMIVDREYSVAVEAVRLLILILKLFYPECEIRTMGGREQRQSPGAQRTFFQLLLSFFVESKLHDHAAYLVDNLWDCAGTQLKDWEGLTSLLLEKDQSTCHMEPGPGTFHLLG

SEQ ID NO: 5954 - protein, 151 aa, Homo sapiens
MQHREVRVKCVKALKGLYGNRDLTARLELFTGRFKDWMVSMIVDREYSVAVEAVRLLILILKLFYPECEIRTMGGREQRQSPGAQRTFFQLLLSFFVESKLHDHAAYLVDNLWDCAGTQLKDWEGLTSLLLEKDQSTCHMEPGPGTFHLLG

SEQ ID NO: 5955 - protein, 128 aa, Homo sapiens
MIFSMLRKLPKVTCRDVLPEIRAICIEEIGCWMQSYSTSFLTDSYLKYIGWTLHDKHREVRVKCVKALKGLYGNRDLTARLELFTGRFKDWMVSMIVDREYSVAVEAVRLLILILKIGSQTPATRECI

SEQ ID NO: 5956 - protein, 125 aa, Homo sapiens
MQHREVRVKCVKALKGLYGNRDLTARLELFTGRFKDWMVSMIVDREYSVAVEAVRLLILILKLFYPECEIRTMGGREQRQSPGAQRTFFQLLLSFFVESKVTYTERTLAVVHRTYKWAGVGGSRL

SEQ ID NO: 5957 - protein, 79 aa, Homo sapiens
MGGREQRQSPGAQRTFFQLLLSFFVESKLHDHAAYLVDNLWDCAGTQLKDWEGLTSLLLEKDQSTCHMEPGPGTFHLLG

SEQ ID NO: 5958 - protein, 134 aa, Homo sapiens; identical to SEQ ID NO: 5952

SEQ ID NO: 5959 - protein, 134 aa, Homo sapiens; identical to SEQ ID NO: 5952

SEQ ID NO: 5960 - protein, 134 aa, Homo sapiens; identical to SEQ ID NO: 5952

SEQ ID NO: 5961 - protein, 205 aa, Homo sapiens
MIFSMLRKLPKVTCRDVLPEIRAICIEEIGCWMQSYSTSFLTDSYLKYIGWTLHDKHREVRVKCVKALKGLYGNRDLTARLELFTGCFKDWMVSMIMDREYSVAVEAVRLLILILKLFYPECEIRTMGGREQRQSPGAQRTFFQLLLSFFVESKLHDHAAYLVDNLWDCAGTQLKDWEGLTSLLLEKDQSTCHMEPGPGTFHLLG

SEQ ID NO: 5962 - protein, 134 aa, Homo sapiens
MIFSMLRKLPKVTCRDVLPEIRAICIEEIGCWMQSYSTSFLTDSYLKYIGWTLHDKHREVRVKCVKALKGLYGNRDLTARLELFTGCFKDWMVSMIMDREYSVAVEAVRLLILILKNMEGVLMDVDCESVYPIV

SEQ ID NO: 5963 - protein, 151 aa, Homo sapiens
MQHREVRVKCVKALKGLYGNRDLTARLELFTGCFKDWMVSMIMDREYSVAVEAVRLLILILKLFYPECEIRTMGGREQRQSPGAQRTFFQLLLSFFVESKLHDHAAYLVDNLWDCAGTQLKDWEGLTSLLLEKDQSTCHMEPGPGTFHLLG

SEQ ID NO: 5964 - protein, 116 aa, Homo sapiens
MIFSMLRKLPKVTCRDVLPEIRAICIEEIGCWMQSYSTSFLTDSYLKYIGWTLHDKHREVRVKCVKALKGLYGNRDLTARLELFTGCFKDWMVSMIMDREYSVAVEAVRLLILILK

SEQ ID NO: 5965 - protein, 1235 aa, Homo sapiens
MAHLELLLVENFKSWRGRQVIGPFRRFTCIIGPNGSGKSNVMDALSFVMGEKIANLRVKNIQELIHGAHIGKPISSSASVKIIYVEESGEEKTFARIIRGGCSEFRFNDNLVSRSVYIAELEKIGIIVKAQNCLVFQGTVESISVKKPKERTQFFEEISTSGELIGEYEEKKRKLQKAEEDAQFNFNKKKNIAAERRQAKLEKEEAERYQSLLEELKMNKIQLQLFQLYHNEKKIHLLNTKLEHVNRDLSVKRESLSHHENIVKARKKEHGMLTRQLQQTEKELKSVETLLNQKRPQYIKAKENTSHHLKKLDVAKKSIKDSEKQCSKQEDDIKALETELADLDAAWRSFEKQIEEEILHKKRDIELEASQLDRYKELKEQVRKKVATMTQQLEKLQWEQKTDEERLAFEKRRHGEVQGNLKQIKEQIEDHKKRIEKLEEYTKTCMDCLKEKKQQEETLVDEIEKTKSRMSEFNEELNLIRSELQNAGIDTHEGKRQQKRAEVLEHLKRLYPDSVFGRLFDLCHPIHKKYQLAVTKVFGRFITAIVVASEKVAKDCIRFLKEERAEPETFLALDYLDIKPINERLRELKGCKMVIDVIKTQFPQLKKVIQFVCGNGLVCETMEEARHIALSGPERQKTVALDGTLFLKSGVISGGSSDLKYKARCWDEKELKNLRDRRSQKIQELKGLMKTLRKETDLKQIQTLIQGTQTRLKYSQNELEMIKKKHLVAFYQEQSQLQSELLNIESQCIMLSEGIKERQRRIKEFQEKIDKVEDDIFQHFCEEIGVENIREFENKHVKRQQEIDQKRLEFEKQKTRLNVQLEYSRSHLKKKLNKINTLKETIQKGSEDIDHLKKAEENCLQTVNELMAKQQQLKDIRVTQNSSAEKVQTQIEEERKKFLAVDREVGKLQKEVVSIQTSLEQKRLEKHNLLLDCKVQDIEIILLSGSLDDIIEVEMGTEAESTQATIDIYEKEEAFEIDYSSLKEDLKALQSDQEIEAHLRLLLQQVASQEDILLKTAAPNLRALENLKTVRDKFQESTDAFEASRKEARLCRQEFEQVKKRRYDLFTQCFEHVSISIDQIYKKLCRNNSAQAFLSPENPEEPYLEGISYNCVAPGKRFMPMDNLSGGEKCVAALALLFAVHSFRPAPFFVLDEVDAALDNTNIGKVSSYIKEQTQDQFQMIVISLKEEFYSRADALIGIYPEYDDCMFSRVLTLDLSQYPDTEGQESSKRHGESR

SEQ ID NO: 5966 - protein, 1161 aa, Homo sapiens
MAHLELLLVENFKSWRGRQVIGPFRRFTCIIGPNGSGKSNVMDALSFVMGEKIANLRVKNIQELIHGAHIGKPISSSASVKIIYVEESGEEKTFARIIRGGCSEFRFNDNLVSRSVYIAELEKIGIIVKAQNCLVFQGTVESISVKKPKERTQFFEEISTSGELIGEYEEKKRKLQKAEEDAQFNFNKKKNIAAERRQAKLEKEEAERYQSLLEELKMNKIQLQLFQLYHNEKKIHLLNTKLEHVNRDLSVKRESLSHHENIVKARKKEHGMLTRQLQQTEKELKSVETLLNQKRPQYIKAKENTSHHLKKLDVAKKSIKDSEKQCSKQEDDIKALETELADLDAAWRSFEKQIEEEILHKKRDIELEASQLDRYKELKEQVRKKVATMTQQLEKLQWEQKTDEERLAFEKRRHGEVQGNLKQIKEQIEDHKKRIEKLEEYTKTCMDCLKEKKQQEETLVDEIEKTKSRMSEFNEELNLIRSELQNAGIDTHEGKRQQKRAEVLEHLKRLYPDSVFGRLFDLCHPIHKKYQLAVTKVFGRFITAIVVASEKVAKDCIRFLKEERAEPETFLALDYLDIKPINERLRELKGCKMVIDVIKTQFPQLKKVIQFVCGNGLVCETMEEARHIALSGPERQKTVALDGTLFLKSGVISGGSSDLKYKARCWDEKELKNLRDRRSQKIQELKGLMKTLRKETDLKQIQTLIQGTQTRLKYSQNELEMIKKKHLVAFYQEQSQLQSELLNIESQCIMLSEGIKERQRRIKEFQEKIDKVEDDIFQHFCEEIGVENIREFENKHVKRQQEIDQKRLEFEKQKTRLNVQLEYSRSHLKKKLNKINTLKETIQKGSEDIDHLKKAEENCLQTVNELMAKQQQLKDIRVTQNSSAEKVQTQIEEERKKFLAVDREVGKLQKEVVSIQTSLEQKRLEKHNLLLDCKVQDIEIILLSGSLDDIIEVEMGTEAESTQATIDIYEKEEAFEIDYSSLKEDLKALQSDQEIEAHLRLLLQQVASQEDILLKTAAPNLRALENLKTVRDKFQESTDAFEASRKEARLCRQEFEQVKKRRYDLFTQCFEHVSISIDQIYKKLCRNNSAQVSSYIKEQTQDQFQMIVISLKEEFYSRADALIGIYPEYDDCMFSRVLTLDLSQYPDTEGQESSKRHGESR

SEQ ID NO: 5967 - protein, 1917 aa, Homo sapiens
MAAADGGGPGGASVGTEEDGGGVGHRTVYLFDRREKESELGDRPLQVGERSDYAGFRACVCQTLGISPEEKFVITTTSRKEITCDNFDETVKDGVTLYLLQSVNQLLLTATKERIDFLPHYDTLVKSGMYEYYASEGQNPLPFALAELIDNSLSATSRNIGVRRIQIKLLFDETQGKPAVAVIDNGRGMTSKQLNNWAVYRLSKFTRQGDFESDHSGYVRPVPVPRSLNSDISYFGVGGKQAVFFVGQSARMISKPADSQDVHELVLSKEDFEKKEKNKEAIYSGYIRNRKPSDSVHITNDDERFLHHLIIEEKEKDSFTAVVITGVQPEHIQYLKNYFHLWTRQLAHIYHYYIHGPKGNEIRTSKEVEPFNNIDIEISMFEKGKVPKIVNLREIQDDMQTLYVNTAADSFEFKAHVEGDGVVEGIIRYHPFLYDRETYPDDPCFPSKLKDEDDEDDCFILEKAARGKRPIFECFWNGRLIPYTSVEDFDWCTPPKKRGLAPIECYNRISGALFTNDKFQVSTNKLTFMDLELKLKDKNTLFTRILNGQEQRMKIDREFALWLKDCHEKYDKQIKFTLFKGVITRPDLPSKKQGPWATYAAIEWDGKIYKAGQLVKTIKTLPLFYGSIVRFFLYGDHDGEVYATGGEVQIAMEPQALYDEVRTVPIAKLDRTVAEKAVKKYVEDEMARLPDRLSVTWPEGDELLPNEVRPAGTPIGALRIEILNKKGEAMQKLPGTSHGGSKKLLVELKVILHSSSGNKEIISHISQHGGKWPYWFKKMENIQKLGNYTLKLQVVLNESNADTYAGRPLPSKAIKFSVKEGKPEKFSFGLLDLPFRVGVPFNIPLEFQDEFGHTSQLVTDIQPVLEASGLSLHYEEITKGPNCVIRGVTAKGPVNSCQGKNYNLKVTLPGLKEDSQILKIRLLPGHPRRLKVKPDSEILVIENGTAFPFQVEVLDESDNITAQPKLIVHCKFSGAPNLPVYVVDCSSSGTSILTGSAIQVQNIKKDQTLKARIEIPSCKDVAPVEKTIKLLPSSHVARLQIFSVEGQKAIQIKHQDEVNWIAGDIMHNLIFQMYDEGEREINITSALAEKIKVNWTPEINKEHLLQGLLPDVQVPTSVKDMRYCQVSFQDDHVSLESAFTVRPLPDEPKHLKCEMKGGKTVQMGQELQGEVVIIITDQYGNQIQAFSPSSLSSLSIAGVGLDSSNLKTTFQENTQSISVRGIKFIPGPPGNKDLCFTWREFSDFIRVQLISGPPAKLLLIDWPELKESIPVINGRDLQNPIIVQLCDQWDNPAPVQHVKISLTKASNLKLMPSNQQHKTDEKGRANLGVFSVFAPRGEHTLQVKAIYNKSIIEGPIIKLMILPDPEKPVRLNVKYDKDASFLAGGLFTDFMISVISEDDSIIKNINPARISMKMWKLSTSGNRPPANAETFSCNKIKDNDKEDGCFYFRDKVIPNKVGTYCIQFGFMMDKTNILNSEQVIVEVLPNQPVKLVPKIKPPTPAVSNVRSVASRTLVRDLHLSITDDYDNHTGIDLVGTIIATIKGSNEEDTDTPLFIGKVRTLEFPFVNGSAEIMSLVLAESSPGRDSTEYFIVFEPRLPLLSRTLEPYILPFMFYNDVKKQQQMAALTKEKDQLSQSIVMYKSLFEASQQLLNEMKCQVEEARLKEAQLRNELKIHNIDIPTTQQVPHIEALLKRKLSEQEELKKKPRRSCTLPNYTKGSGDVLGKIAHLAQIEDDRAAMVISWHLASDMDCVVTLTTDAARRIYDETQGRQQVLPLDSIYKKTLPDWKRSLPHFRNGKLYFKPIGDPVFARDLLTFPDNVEHCETVFGMLLGDTIILDNLDAANHYRKEVVKITHCPTLLTRDGDRIRSNGKFGGLQNKAPPMDKLRGMVFGAPVPKQCLILGEQIVHACVPSYSGG

SEQ ID NO: 5968 - protein, 2005 aa, Homo sapiens
MAAADGGGPGGASVGTEEDGGGVGHRTVYLFDRREKESELGDRPLQVGERSDYAGFRACVCQTLGISPEEKFVITTTSRKEITCDNFDETVKDGVTLYLLQSVNQLLLTATKERIDFLPHYDTLVKSGMYEYYASEGQNPLPFALAELIDNSLSATSRNIGVRRIQIKLLFDETQGKPAVAVIDNGRGMTSKQLNNWAVYRLSKFTRQGDFESDHSGYVRPVPVPRSLNSDISYFGVGGKQAVFFVGQSARMISKPADSQDVHELVLSKEDFEKKEKNKEAIYSGYIRNRKPSDSVHITNDDERFLHHLIIEEKEKDSFTAVVITGVQPEHIQYLKNYFHLWTRQLAHIYHYYIHGPKGNEIRTSKEVEPFNNIDIEISMFEKGKVPKIVNLREIQDDMQTLYVNTAADSFEFKAHVEGDGVVEGIIRYHPFLYDRETYPDDPCFPSKLKDEDDEDDCFILEKAARGKRPIFECFWNGRLIPYTSVEDFDWCTPPKKRGLAPIECYNRISGALFTNDKFQVSTNKLTFMDLELKLKDKNTLFTRILNGQEQRMKIDREFALWLKDCHEKYDKQIKFTLFKGVITRPDLPSKKQGPWATYAAIEWDGKIYKAGQLVKTIKTLPLFYGSIVRFFLYGDHDGEVYATGGEVQIAMEPQALYDEVRTVPIAKLDRTVAEKAVKKYVEDEMARLPDRLSVTWPEGDELLPNEVRPAGTPIGALRIEILNKKGEAMQKLPGTSHGGSKKLLVELKVILHSSSGNKEIISHISQHGGKWPYWFKKMENIQKLGNYTLKLQVVLNESNADTYAGRPLPSKAIKFSVKEGKPEKFSFGLLDLPFRVGVPFNIPLEFQDEFGHTSQLVTDIQPVLEASGLSLHYEEITKGPNCVIRGVTAKGPVNSCQGKNYNLKVTLPGLKEDSQILKIRLLPGHPRRLKVKPDSEILVIENGTAFPFQVEVLDESDNITAQPKLIVHCKFSGAPNLPVYVVDCSSSGTSILTGSAIQVQNIKKDQTLKARIEIPSCKDVAPVEKTIKLLPSSHVARLQIFSVEGQKAIQIKHQDEVNWIAGDIMHNLIFQMYDEGEREINITSALAEKIKVNWTPEINKEHLLQGLLPDVQVPTSVKDMRYCQVSFQDDHVSLESAFTVRPLPDEPKHLKCEMKGGKTVQMGQELQGEVVIIITDQYGNQIQAFSPSSLSSLSIAGVGLDSSNLKTTFQENTQSISVRGIKFIPGPPGNKDLCFTWREFSDFIRVQLISGPPAKLLLIDWPELKESIPVINGRDLQNPIIVQLCDQWDNPAPVQHVKISLTKASNLKLMPSNQQHKTDEKGRANLGVFSVFAPRGEHTLQVKAIYNKSIIEGPIIKLMILPDPEKPVRLNVKYDKDASFLAGGLFTDFMISVISEDDSIIKNINPARISMKMWKLSTSGNRPPANAETFSCNKIKDNDKEDGCFYFRDKVIPNKVGTYCIQFGFMMDKTNILNSEQVIVEVLPNQPVKLVPKIKPPTPAVSNVRSVASRTLVRDLHLSITDDYDNHTGIDLVGTIIATIKGSNEEDTDTPLFIGKVRTLEFPFVNGSAEIMSLVLAESSPGRDSTEYFIVFEPRLPLLSRTLEPYILPFMFYNDVKKQQQMAALTKEKDQLSQSIVMYKSLFEASQQLLNEMKCQVEEARLKEAQLRNELKIHNIDIPTTQQVPHIEALLKRKLSEQEELKKKPRRSCTLPNYTKGSGDVLGKIAHLAQIEDDRAAMVISWHLASDMDCVVTLTTDAARRIYDETQGRQQVLPLDSIYKKTLPDWKRSLPHFRNGKLYFKPIGDPVFARDLLTFPDNVEHCETVFGMLLGDTIILDNLDAANHYRKEVVKITHCPTLLTRDGDRIRSNGKFGGLQNKAPPMDKLRGMVFGAPVPKQCLILGEQIDLLQQYRSAVCKLDSVNKDLNSQLEYLRTPDMRKKKQELDEHEKNLKLIEEKLGMTPIRKCNDSLRHSPKVETTDCPVPPKRMRREATRQNRIITKTDV

SEQ ID NO: 5969 - protein, 127 aa, Homo sapiens
MPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQISDIDDAVRKL

SEQ ID NO: 5970 - protein, 127 aa, Homo sapiens; identical to SEQ ID NO: 5969

SEQ ID NO: 5971 - protein, 127 aa, Homo sapiens; identical to SEQ ID NO: 5969

SEQ ID NO: 5972 - protein, 66 aa, Homo sapiens
MPKSKELVSSSSSGSDSDSEVDKKLKRKKQVAPEKPVKKQKTGETSRALSSSKQSSSSRDDNMFQV

SEQ ID NO: 5973 - protein, 127 aa, Homo sapiens; identical to SEQ ID NO: 5969

SEQ ID NO: 5974 - protein, 127 aa, Homo sapiens; identical to SEQ ID NO: 5969

SEQ ID NO: 5975 - protein, 123 aa, Homo sapiens
MPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQILVALWQ

SEQ ID NO: 5976 - protein, 1042 aa, Homo sapiens
MADAFGDELFSVFEGDSTTAAGTKKDKEKDKGKWKGPPGSADKAGKRFDGKLQSESTNNGKNKRDVDFEGTDEPIFGKKPRIEESITEDLSLADLMPRVKVQSVETVEGCTHEVALPAEEDYLPLKPRVGKAAKEYPFILDAFQREAIQCVDNNQSVLVSAHTSAGKTVCAEYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQPCHVIYTDYRPTPLQHYIFPAGGDGLHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFSNAIDCLSDEDKKLPQVEHVLPLLKRGIGIHHGGLLPILKETIEILFSEGLIKALFATETFAMGINMPARTVLFTNARKFDGKDFRWISSGEYIQMSGRAGRRGMDDRGIVILMVDEKMSPTIGKQLLKGSADPLNSAFHLTYNMVLNLLRVEEINPEYMLEKSFYQFQHYRAIPGVVEKVKNSEEQYNKIVIPNEESVVIYYKIRQQLAKLGKEIEEYIHKPKYCLPFLQPGRLVKVKNEGDDFGWGVVVNFSKKSNVKPNSGELDPLYVVEVLLRCSKESLKNSATEAAKPAKPDEKGEMQVVPVLVHLLSAISSVRLYIPKDLRPVDNRQSVLKSIQEVQKRFPDGIPLLDPIDDMGIQDQGLKKVIQKVEAFEHRMYSHPLHNDPNLETVYTLCEKKAQIAIDIKSAKRELKKARTVLQMDELKCRKRVLRRLGFATSSDVIEMKGRVACEISSADELLLTEMMFNGLFNDLSAEQATALLSCFVFQENSSEMPKLTEQLAGPLRQMQECAKRIAKVSAEAKLEIDEETYLSSFKPHLMDVVYTWATGATFAHICKMTDVFEGSIIRCMRRLEELLRQMCQAAKAIGNTELENKFAEGITKIKRDIVFAASLYL

SEQ ID NO: 5977 - protein, 941 aa, Homo sapiens
MEGASRVCRQGRVALPAEEDYLPLKPRVGKAAKEYPFILDAFQREAIQCVDNNQSVLVSAHTSAGKTVCAEYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQPCHVIYTDYRPTPLQHYIFPAGGDGLHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFSNAIDCLSDEDKKLPQVEHVLPLLKRGIGIHHGGLLPILKETIEILFSEGLIKALFATETFAMGINMPARTVLFTNARKFDGKDFRWISSGEYIQMSGRAGRRGMDDRGIVILMVDEKMSPTIGKQLLKGSADPLNSAFHLTYNMVLNLLRVEEINPEYMLEKSFYQFQHYRAIPGVVEKVKNSEEQYNKIVIPNEESVVIYYKIRQQLAKLGKEIEEYIHKPKYCLPFLQPGRLVKVKNEGDDFGWGVVVNFSKKSNVKPNSGELDPLYVVEVLLRCSKESLKNSATEAAKPAKPDEKGEMQVVPVLVHLLSAISSVRLYIPKDLRPVDNRQSVLKSIQEVQKRFPDGIPLLDPIDDMGIQDQGLKKVIQKVEAFEHRMYSHPLHNDPNLETVYTLCEKKAQIAIDIKSAKRELKKARTVLQMDELKCRKRVLRRLGFATSSDVIEMKGRVACEISSADELLLTEMMFNGLFNDLSAEQATALLSCFVFQENSSEMPKLTEQLAGPLRQMQECAKRIAKVSAEAKLEIDEETYLSSFKPHLMDVVYTWATGATFAHICKMTDVFEGSIIRCMRRLEELLRQMCQAAKAIGNTELENKFAEGITKIKRDIVFAASLYL

SEQ ID NO: 5978 - protein, 1047 aa, Homo sapiens
MDAEAEDKTLRTRSKGTEVPMDSLIQELSVAYDCSMAKKRTAEDQALGVPVNKRKSLLMKPRHYSPKADCQEDRSDRTEDDGPLETHGHSTAEEIMIKPMDESLLSTAQENSSRKEDRYSCYQELMVKSLMHLGKFEKNVSVQTVSENLNDSGIQSLKAESDEADECFLIHSDDGRDKIDDSQPPFCSSDDNESNSESAENGWDSGSNFSEETKPPRVPKYVLTDHKKDLLEVPEIKTEGDKFIPCENRCDSETERKDPQNALAEPLDGNAQPSFPDVEEEDSESLAVMTEEGSDLEKAKGNLSLLEQAIALQAERGCVFHNTYKELDRFLLEHLAGERRQTKVIDMGGRQIFNNKHSPRPEKRETKCPIPGCDGTGHVTGLYPHHRSLSGCPHKVRVPLEILAMHENVLKCPTPGCTGRGHVNSNRNTHRSLSGCPIAAAEKLAMSQDKNQLDSPQTGQCPDQAHRTSLVKQIEFNFPSQAITSPRATVSKEQEKFGKVPFDYASFDAQVFGKRPLIQTVQGRKTPPFPESKHFPNPVKFPNRLPSAGAHTQSPGRASSYSYGQCSEDTHIAAAAAILNLSTRCREATDILSNKPQSLHAKGAEIEVDENGTLDLSMKKNRILDKSAPLTSSNTSIPTPSSSPFKTSSILVNAAFYQALCDQEGWDTPINYSKTHGKTEEEKEKDPVSSLENLEEKKFPGEASIPSPKPKLHARDLKKELITCPTPGCDGSGHVTGNYASHRSVSGCPLADKTLKSLMAANSQELKCPTPGCDGSGHVTGNYASHRSLSGCPRARKGGVKMTPTKEEKEDPELKCPVIGCDGQGHISGKYTSHRTASGCPLAAKRQKENPLNGASLSWKLNKQELPHCPLPGCNGLGHVNNVFVTHRSLSGCPLNAQVIKKGKVSEELMTIKLKATGGIESDEEIRHLDEEIKELNESNLKIEADMMKLQTQITSMESNLKTIEEENKLIEQNNESLLKELAGLSQALISSLADIQLPQMGPISEQNFEAYVNTLTDMYSNLERDYSPECKALLESIKQAVKGIHV

SEQ ID NO: 5979 - protein, 620 aa, Homo sapiens
MDAEAEDKTLRTRSKGTEVPMDSLIQELSVAYDCSMAKKRTAEDQALGVPVNKRKSLLMKPRHYSPKADCQEDRSDRTEDDGPLETHGHSTAEEIMIKPMDESLLSTAQENSSRKEDRYSCYQELMVKSLMHLGKFEKNVSVQTVSENLNDSGIQSLKAESDEADECFLIHSDDGRDKIDDSQPPFCSSDDNESNSESAENGWDSGSNFSEETKPPRVPKYVLTDHKKDLLEVPEIKTEGDKFIPCENRCDSETERKDPQNALAEPLDGNAQPSFPDVEEEDSESLAVMTEEGSDLEKAKGNLSLLEQAIALQAERGCVFHNTYKELDRFLLEHLAGERRQTKVIDMGGRQIFNNKHSPRPEKRETKCPIPGCDGTGHVTGLYPHHRSLSGCPHKVRVPLEILAMHENVLKCPTPGCTGRGHVNSNRNTHRSLSGCPIAAAEKLAMSQDKNQLDSPQTGQCPDQAHRTSLVKQIEFNFPSQAITSPRATVSKEQEKFGKVPFDYASFDAQVFGKRPLIQTVQGRKTPPFPESKHFPNPVKFPNRLPSAGAHTQSPGRASSYSYGQCSEDTHIAAAAAILNLSTRCREATDILSNKPQSLHAKGAEIEVDENGTLDLSMKK

SEQ ID NO: 5980 - protein, 13 aa, Homo sapiens
MDAEAEDKTLRTR

SEQ ID NO: 5981 - protein, 329 aa, Homo sapiens
MSAAGLLAPAPAQAGAPPAPEYYPEEDEELESAEDDERSCRGRESDEDTEDASETDLAKHDEEDYVEMKEQMYQDKLASLKRQLQQLQEGTLQEYQKRMKKLDQQYKERIRNADTLLLQAQTEQVERNYIKEKKAAVKEFEDKKVELKENLIAELEEKKKMIENEKLTMELTGDSMEVKPIMTRKLRRRPNDPVPIPDKRRKPAPAQLNYLLTDEQIMEDLRTLNKLKSPKRPASPSSPEHLPATPAESPAQRFEARIEDGKLYYDKRWYHKSQAIYLESKDNQKLSCVISSVGANEIWVRKTSDSTKMRIYLGQLQRGLFVIRRRSAA

SEQ ID NO: 5982 - protein, 328 aa, Homo sapiens
MSAAGLLAPAPAQAGAPPAPEYYPEEDEELESAEDDERSCRGRESDEDTEDASETDLAKHDEEDYVEMKEQMYQDKLASLKRQLQQLQEGTLQEYQKRMKKLDQQYKERIRNAELFLQLETEQVERNYIKEKKAAVKEFEDKKVELKENLIAELEEKKKMIENEKLTMELTGDSMEVKPIMTRKLRRRPNDPVPIPDKRRKPAPAQLNYLLTDEQIMEDLRTLNKLKSPKRPASPSSPEHLPATPAESPAQRFEARIEDGKLYYDKRWYHKSQAIYLESKDNQKLSCVISSVGANEIWVRKTSDSTKMRIYLGQLQRGLFVIRRRSAA

SEQ ID NO: 5983 - protein, 1047 aa, Homo sapiens
MAVTLDKDAYYRRVKRLYSNWRKGEDEYANVDAIVVSVGVDEEIVYAKSTALQTWLFGYELTDTIMVFCDDKIIFMASKKKVEFLKQIANTKGNENANGAPAITLLIREKNESNKSSFDKMIEAIKESKNGKKIGVFSKDKFPGEFMKSWNDCLNKEGFDKIDISAVVAYTIAVKEDGELNLMKKAASITSEVFNKFFKERVMEIVDADEKVRHSKLAESVEKAIEEKKYLAGADPSTVEMCYPPIIQSGGNYNLKFSVVSDKNHMHFGAITCAMGIRFKSYCSNLVRTLMVDPSQEVQENYNFLLQLQEELLKELRHGVKICDVYNAVMDVVKKQKPELLNKITKNLGFGMGIEFREGSLVINSKNQYKLKKGMVFSINLGFSDLTNKEGKKPEEKTYALFIGDTVLVDEDGPATVLTSVKKKVKNVGIFLKNEDEEEEEEEKDEAEDLLGRGSRAALLTERTRNEMTAEEKRRAHQKELAAQLNEEAKRRLTEQKGEQQIQKARKSNVSYKNPSLMPKEPHIREMKIYIDKKYETVIMPVFGIATPFHIATIKNISMSVEGDYTYLRINFYCPGSALGRNEGNIFPNPEATFVKEITYRASNIKAPGEQTVPALNLQNAFRIIKEVQKRYKTREAEEKEKEGIVKQDSLVINLNRSNPKLKDLYIRPNIAQKRMQGSLEAHVNGFRFTSVRGDKVDILYNNIKHALFQPCDGEMIIVLHFHLKNAIMFGKKRHTDVQFYTEVGEITTDLGKHQHMHDRDDLYAEQMEREMRHKLKTAFKNFIEKVEALTKEELEFEVPFRDLGFNGAPYRSTCLLQPTSSALVNATEWPPFVVTLDEVELIHFERVQFHLKNFDMVIVYKDYSKKVTMINAIPVASLDPIKEWLNSCDLKYTEGVQSLNWTKIMKTIVDDPEGFFEQGGWSFLEPEGEGSDAEEGDSESEIEDETFNPSEDDYEEEEEDSDEDYSSEAEESDYSKESLGSEEESGKDWDELEEEARKADRESRYEEEEEQSRSMSRKRKASVHSSGRGSNRGSRHSSAPPKKKRK

SEQ ID NO: 5984 - protein, 398 aa, Homo sapiens
MAVTLDKDAYYRRVKRLYSNWRKGEDEYANVDAIVVSVGVDEEIVYAKSTALQTWLFGYELTDTIMVFCDDKIIFMASKKKVEFLKQIANTKGNENANGAPAITLLIREKNESNKSSFDKMIEAIKESKNGKKIGVFSKDKFPGEFMKSWNDCLNKEGFDKIDISAVVAYTIAVKEDGELNLMKKAASITSEVFNKFFKERVMEIVDADEKVRHSKLAESVEKAIEEKKYLAGADPSTVEMCYPPIIQSGGNYNLKFSVVSDKNHMHFGAITCAMGIRFKSYCSNLVRTLMVDPSQEVQENYNFLLQLQEELLKELRHGVKICDVYNAVMDVVKKQKPELLNKITKNLGFGMGIEFREGSLVINSKNQYKLKKGMVFSINLGFSDLTNKKKKKKKKAK

SEQ ID NO: 5985 - protein, 317 aa, Homo sapiens
MNNTAASPMSTATSSSGRSTGKSISFATELQSMMYSLGDARRPLHETAVLVEDVVHTQLINLLQQAAEVSQLRGARVITPEDLLFLMRKDKKKLRRLLKYMFIRDYKSKIVKGIDEDDLLEDKLSGSNNANKRQKIAQDFLNSIDQTGELLAMFEDDEIDEVKQERMERAERQTRIMDSAQYAEFCESRQLSFSKKASKFRDWLDCSSMEIKPNVVAMEILAYLAYETVAQLVDLALLVRQDMVTKAGDPFSHAISATFIQYHNSAESTAACGVEAHSDAIQPCHIREAIRRYSHRIGPLSPFTNAYRRNGMAFLAC

SEQ ID NO: 5986 - protein, 108 aa, Homo sapiens
MEILAYLAYETVAQLVDLALLVRQDMVTKAGDPFSHAISATFIQYHNSAESTAACGVEAHSDAIQPCHIREAIRRYSHRIGPLSPFTISFSLTECLPQEWDGFSSLLM

SEQ ID NO: 5987 - protein, 317 aa, Homo sapiens; identical to SEQ ID NO: 5985

SEQ ID NO: 5988 - protein, 328 aa, Homo sapiens
MVVFGTTFFNFDSFIGKTDSIEIIGKSVFPYCYHNILPLLNDSGRYSLGDARRPLHETAVLVEDVVHTQLINLLQQAAEVSQLRGARVITPEDLLFLMRKDKKKLRRLLKYMFIRDYKSKIVKGIDEDDLLEDKLSGSNNANKRQKIAQDFLNSIDQTGELLAMFEDDEIDEVKQERMERAERQTRIMDSAQYAEFCESRQLSFSKKASKFRDWLDCSSMEIKPNVVAMEILAYLAYETVAQLVDLALLVRQDMVTKAGDPFSHAISATFIQYHNSAESTAACGVEAHSDAIQPCHIREAIRRYSHRIGPLSPFTNAYRRNGMAFLAC

SEQ ID NO: 5989 - protein, 328 aa, Homo sapiens; identical to SEQ ID NO: 5988

SEQ ID NO: 5990 - protein, 317 aa, Homo sapiens; identical to SEQ ID NO: 5985

SEQ ID NO: 5991 - protein, 117 aa, Homo sapiens
MALETVPKDLRHLRACLLCSLVKTIDQFEYDGCDNCDAYLQMKGNREMVYDCTSSSFDGIIAMMSPEDSWVSKWQRVSNFKPGVYAVSVTGRLPQGIVRELKSRGVAYKSRDTAIKT

SEQ ID NO: 5992 - protein, 739 aa, Homo sapiens
MAPQKHGGGGGGGSGPSAGSGGGGFGGSAAVAAATASGGKSGGGSCGGGGSYSASSSSSAAAAAGAAVLPVKKPKMEHVQADHELFLQAFEKPTQIYRFLRTRNLIAPIFLHRTLTYMSHRNSRTNIKRKTFKVDDMLSKVEKMKGEQESHSLSAHLQLTFTGFFHKNDKPSPNSENEQNSVTLEVLLVKVCHKKRKDVSCPIRQVPTGKKQVPLNPDLNQTKPGNFPSLAVSSNEFEPSNSHMVKSYSLLFRVTRPGRREFNGMINGETNENIDVNEELPARRKRNREDGEKTFVAQMTVFDKNRRLQLLDGEYEVAMQEMEECPISKKRATWETILDGKRLPPFETFSQGPTLQFTLRWTGETNDKSTAPIAKPLATRNSESLHQENKPGSVKPTQTIAVKESLTTDLQTRKEKDTPNENRQKLRIFYQFLYNNNTRQQTEARDDLHCPWCTLNCRKLYSLLKHLKLCHSRFIFNYVYHPKGARIDVSINECYDGSYAGNPQDIHRQPGFAFSRNGPVKRTPITHILVCRPKRTKASMSEFLESEDGEVEQQRTYSSGHNRLYFHSDTCLPLRPQEMEVDSEDEKDPEWLREKTITQIEEFSDVNEGEKEVMKLWNLHVMKHGFIADNQMNHACMLFVENYGQKIIKKNLCRNFMLHLVSMHDFNLISIMSIDKAVTKLREMQQKLEKGESASPANEEITEEQNGTANGFSEINSKEKALETDSVSGVSKQSKKQKL

SEQ ID NO: 5993 - protein, 645 aa, Homo sapiens
MSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVSPPEGAETRKVIEKLARFVAEGGPELEKVAMEDYKDNPAFAFLHDKNSREFLYYRKKVAEIRKEAQKSQAASQKVSPPEDEEVKNLAEKLARFIADGGPEVETIALQNNRENQAFSFLYEPNSQGYKYYRQKLEEFRKAKASSTGSFTAPDPGLKRKSPPEALSGSLPPATTCPASSTPAPTIIPAPAAPGKPASAATVKRKRKSRWGPEEDKVELPPAELVQRDVDASPSPLSVQDLKGLGYEKGKPVGLVGVTELSDAQKKQLKEQQEMQQMYDMIMQHKRAMQDMQLLWEKAVQQHQHGYDSDEEVDSELGTWEHQLRRMEMDKTREWAEQLTKMGRGKHFIGDFLPPDELEKFMETFKALKEGREPDYSEYKEFKLTVENIGYQMLMKMGWKEGEGLGSEGQGIKNPVNKGTTTVDGAGFGIDRPAELSKEDDEYEAFRKRMMLAYRFRPNPLNNPRRPYY

SEQ ID NO: 5994 - protein, 222 aa, Homo sapiens
MSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKVCLTKTVRPTPPSSWCFVPGLGTPDSLLHLTLFSPHPLCRCGP

SEQ ID NO: 5995 - protein, 185 aa, Homo sapiens
MSLKMDNRDVAGKANRWFGVAPPKSGKMNMNILHQEELIAQKKREIEAKMEQKAKQNQVASPQPPHPGEITNAHNSSCISNKFANDGSFLQQFLKLQKAQTSTDAPTSAPSAPPSTPTPSAGKRSLLISRRTGLGLASLPGPVKSYSHAKQLPVAHRPSVFQSPDEDEEEDYEQWLEIKGRRWLR

SEQ ID NO: 5996 - protein, 1030 aa, Homo sapiens
MAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGGSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVGTPSEGEGLGADGQEHKEDTFDVFRQRMMQMYRHKRANK

SEQ ID NO: 5997 - protein, 1082 aa, Homo sapiens
MAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGGSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVGTPSEGEGLGADGQEHKEDTFDVFRQRMMQMYRHKRANK

SEQ ID NO: 5998 - protein, 1082 aa, Homo sapiens; identical to SEQ ID NO: 5997

SEQ ID NO: 5999 - protein, 861 aa, Homo sapiens
MTATFAKNVAGIWNFLTLILGTRSLATGNWGISVLRTGNLRSVVLGNKTLAIQFLKSPLGHRSIVLIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVYAAGSLGWEWVGPQSFHLQPAAWLLHSQDGLQLAVDFCFLNRRHLQMRS

SEQ ID NO: 6000 - protein, 177 aa, Homo sapiens
  MOD_RES (1)..(1): Any amino acid
XMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEKNCQLCPRKTLTSRYTDFPD

SEQ ID NO: 6001 - protein, 411 aa, Homo sapiens
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 6002 - protein, 328 aa, Homo sapiens
MSKRPSYAPPPTPAPATASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEKNCQLCPRKTLTSRYTDFPD

SEQ ID NO: 6003 - protein, 189 aa, Homo sapiens
  MOD_RES (1)..(1): Any amino acid
XAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEKNCQLCPRKTLTSRYTDFPD

SEQ ID NO: 6004 - protein, 393 aa, Homo sapiens
MPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 6005 - protein, 157 aa, Homo sapiens
LSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEKNCQLCPRKTLTSRYTDFPD

SEQ ID NO: 6006 - protein, 341 aa, Homo sapiens
MPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 6007 - protein, 235 aa, Homo sapiens
MQRRGQRDLWRHNKSCARNRCPRPPRERGGAGFPWVRAQLSVRQFTLRVRVPGPVHLRGRSPTPALDPLAPLNPLIRGPRTPGLRRWIQSLALLLPNCSSSRIPTVPRPHSGLWVQSDFPLGFLSRTEPRLTRSCRGAFRSPRPLPKSGQADGTSEESLHLDIQKLKEKRDMLDKEISQFVSEGYSVDELEDHITQLHEYNDIKDVGQMLMGKLAVIRGVTTKELYPEFGLDMND

SEQ ID NO: 6008 - protein, 307 aa, Homo sapiens
MKNLVVPMWEGKWKTAKRARMNYKVKLEEISGLLVDALYTNTIYYLIKVDYREVWLIRLFYNFSFLEKNQDFTFKMESPSDSAVVLPSTPQASANPSSPYTNSSRKQPMSATLRERLRKTRFSFNSSYNVVKRLKVESEENDQTFSEKPASSTEENCLEFQESFKHIDSEFEENTNLKNTLKNLNVCESQSLDSGSCSALQNEFVSEKLPKQRLNAEKAKLVKQVQEKEDLLRRLKLVKMYRSKNDLSQLQLLIKKWRSCSQLLLYELQSAVSEENKKLSLTQLIDHYGLDDKLLHYNRSEEEFIDV

SEQ ID NO: 6009 - protein, 245 aa, Homo sapiens
MAEGEKNQDFTFKMESPSDSAVVLPSTPQASANPSSPYTNSSRKQPMSATLRERLRKTRFSFNSSYNVVKRLKVESEENDQTFSEKPASSTEENCLEFQESFKHIDSEFEENTNLKNTLKNLNVCESQSLDSGSCSALQNEFVSEKLPKQRLNAEKAKLVKQVQEKEDLLRRLKLVKMYRSKNDLSQLQLLIKKWRSCSQLLLYELQSAVSEENKKLSLTQLIDHYGLDDKLLHYNRSEEEFIDV

SEQ ID NO: 6010 - protein, 232 aa, Homo sapiens
MESPSDSAVVLPSTPQASANPSSPYTNSSRKQPMSATLRERLRKTRFSFNSSYNVVKRLKVESEENDQTFSEKPASSTEENCLEFQESFKHIDSEFEENTNLKNTLKNLNVCESQSLDSGSCSALQNEFVSEKLPKQRLNAEKAKLVKQVQEKEDLLRRLKLVKMYRSKNDLSQLQLLIKKWRSCSQLLLYELQSAVSEENKKLSLTQLIDHYGLDDKLLHYNRSEEEFIDV

SEQ ID NO: 6011 - protein, 352 aa, Homo sapiens
MFRGLSSWLGLQQPVAGGGQPNGDAPPEQPSETVAESAEEELQQAGDQELLHQAKDFGNYLFNFASAATKKITESVAETAQTIKKSVEEGKIDGIIDKTIIGDFQKEQKKFVEEQHTKKSEAAVPPWVDTNDEETIQQQILALSADKRNFLRDPPAGVQFNFDFDQMYPVALVMLQEDELLSKMRFALVPKLVKEEVFWRNYFYRVSLIKQSAQLTALAAQQQAAGKEEKSNGREQDLPLAEAVRPKTPPVVIKSQLKTQEDEEEISTSPGVSEFVSDAFDACNLNQEDLRKEMEQLVLDKKQEETAVLEEDSADWEKELQQELQEYEVVTESEKRDENWDKEIEKMLQEEN

SEQ ID NO: 6012 - protein, 812 aa, Homo sapiens [sequence omitted]

SEQ ID NO: 6013 - protein, 288 aa, Homo sapiens
MLDSFLLSLGFLVTEKTVNHLLQQEGLKTFNCILHAVPREERKKFPLSEGMCHLMKDLARTLLTVGDYDQQVAISEALCRLTIKKSRDELVHKWFDDEVIAEAFKEIKDREFETDSRRFLNHLNNRLGDQRRVYSFPCIAAFADEHEMRKPADEKLEKFWIDFNLGSQSVTFYIDNAENTLWDSVTLPKEAVMNFSITETEKIKIFIIYLKKPMIISYKEVMKIEIHFDLQFNISQVSIQALGEDKQMLPDQTKISSELFSKSDKEDRESPSGLERETEVSLQKTSLL

SEQ ID NO: 6014 - protein, 614 aa, Homo sapiens
MGDWMTVTDPGLSSESKTISQYTSETKMSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEVQKLQNIIASRATQYNHDMKRKEREYNKLKERLHQLVMNKKDKKIAMDILNYVGRADGKRGSWRTGKTEARNEDEMYKILLNDYEYRQKQILMENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQLATAYDDDTTSLLRDCYLLEEKERLKEEWSLFKEQKKNFERERRSFTEAAIRLGLERKAFEEERASWLKQQFLNMTTFDHQNSENVKLFSAFSGSSDWDNLIVHSRQPQKKPHSVSNGSPVCMSKLTKSLPASPSTSDFCQTRSCISEHSSINVLNITAEEIKPNQVGGECTNQKWSVASRPGSQEGCYSGCSLSYTNSHVEKDDLP

SEQ ID NO: 6015 - protein, 560 aa, Homo sapiens
MGDWMTVTDPGLSSESKTISQYTSETKMSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEVQKLQNIIASRATQYNHDMKRKEREYNKLKERLHQLVMNKKDKKIAMDILNYVGRADGKRGSWRTGKTEARNEDEMYKILLNDYEYRQKQILMENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQLATAYDDDTTSLLRDCYLLEEKERLKEEWSLFKEQKKNFERERRSFTEAAIRLGLERKAFEEERASWLKQQFLNMTTFDHQNSENVKLFSAFSGSSDWDNLIVHSRQPQKKPHSVSNGSPVCMSKLTKSLPASPSTSDFCQTRSCISEHRAKN

SEQ ID NO: 6016 - protein, 180 aa, Homo sapiens
MGDWMTVTDPGLSSESKTISQYTSETKMSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEV

SEQ ID NO: 6017 - protein, 587 aa, Homo sapiens
MSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEVQKLQNIIASRATQYNHDMKRKEREYNKLKERLHQLVMNKKDKKIAMDILNYVGRADGKRGSWRTGKTEARNEDEMYKILLNDYEYRQKQILMENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQLATAYDDDTTSLLRDCYLLEEKERLKEEWSLFKEQKKNFERERRSFTEAAIRLGLERKAFEEERASWLKQQFLNMTTFDHQNSENVKLFSAFSGSSDWDNLIVHSRQPQKKPHSVSNGSPVCMSKLTKSLPASPSTSDFCQTRSCISEHSSINVLNITAEEIKPNQVGGECTNQKWSVASRPGSQEGCYSGCSLSYTNSHVEKDDLP

SEQ ID NO: 6018 - protein, 504 aa, Homo sapiens
MGDWMTVTDPESKTISQYTSETKMSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEVQKLQNIIASRATQYNHDMKRKEREYNKLKERLHQLVMNKKDKKIAMDILNYVGRADGKRGSWRTGKTEARNEDEMYKILLNDYEYRQKQILMENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQLATAYDDDTTSLLRDCYLLEEKERLKEEWSLFKEQKKNFERERRSFTEAAIRLGLEIGFLLLSVLHKKSLLGIHHSSTVSRCGVRRQCNQDYICCLKKKGI

SEQ ID NO: 6019 - protein, 223 aa, Homo sapiens
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGNREAQEKEERRGTAHRWSSQNTHNIGRFSLSTSMGAVHGTPKTITHNRDPKGGNMPGPTDCVRENSW

SEQ ID NO: 6020 - protein, 188 aa, Homo sapiens
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGPKRGEHAWTHRLRERKQLVIYEEISDPEEDDE

SEQ ID NO: 6021 - protein, 188 aa, Homo sapiens
MNGDDAFARRPRDDAQISEKLRKAFDDIAKYFSKKEWEKMKSSEKIVYVYMKLNYEVMTKLGFKVTLPPFMRSKRAADFHGNDFGNDRNHRNQVERPQMTFGSLQRIFPKIMPKKPAEEENGLKEVPEASGPQNDGKQLCPPGNPSTLEKINKTSGPKRGKHAWTHRLRERKQLVVYEEISDPEEDDE

SEQ ID NO: 6022 - protein, 153 aa, Homo sapiens
MNGDDAFARRPRDDAQISEKLRKAFDDIAKYFSKKEWEKMKSSEKIVYVYMKLNYEVMTKLGFKVTLPPFMRSKRAADFHGNDFGNDRNHRNQVERPQMTFGSLQRIFPKDPKGGNMPGPTDCVRESSWWFMKRSATLRKMTSNSPRGYDTCP

SEQ ID NO: 6023 - protein, 229 aa, Homo sapiens
MNGDDAFVRRPRVGSQIPEKMQKHPWRQVCDRGIHLVNLSPFWKVGREPASSIKALLCGRGEARAFDDIAKYFSEKEWEKMKASEKIIYVYMKRKYEAMTKLGFKATLPPFMRNKRVADFQGNDFDNDPNRGNQVEHPQMTFGRLQGIFPKITPEKPAEEGNDSKGVPEASGPQNNGKQLRPSGKLNTSEKVNKTSGPKRGKHAWTHRVRERKQLVIYEEISDPQEDDE

SEQ ID NO: 6024 - protein, 188 aa, Homo sapiens
MNGDDAFVRRPRVGSQIPEKMQKAFDDIAKYFSEKEWEKMKASEKIIYVYMKRKYEAMTKLGFKATLPPFMRNKRVADFQGNDFDNDPNRGNQVEHPQMTFGRLQGIFPKITPEKPAEEGNDSKGVPEASGPQNNGKQLRPSGKLNTSEKVNKTSGPKRGKHAWTHRVRERKQLVIYEEISDPQEDDE

SEQ ID NO: 6025 - protein, 188 aa, Homo sapiens; identical to SEQ ID NO: 6024

SEQ ID NO: 6026 - protein, 128 aa, Homo sapiens
LITSAAECPHATEVSLEFGNLYQQRKILMYSLSVEHPQMTFGRLQGIFPKITPEKPAEEGNDSKGVPEASGPQNNGKQLRPSGKLNTSEKVNKTSGPKRGKHAWTHRVRERKQLVIYEEISDPQEDDE

SEQ ID NO: 6027 - protein, 90 aa, Homo sapiens
MTFGRLQRIIPKIMPEKPAEEGSDSKGVPEASGPQNDGKKLCPPGKASSSEKIHERSGPKRGKHAWTHRLRERKQLVIYEEISDPEEDDK

SEQ ID NO: 6028 - protein, 188 aa, Homo sapiens
MNGDDAFAKRPRDDAKASEKRSKAFDDIAKYFSKEEWEKMKFSEKISCVHMKRKYEAMTKLGFNVTLSLFMRNKRATDSQRNDSDNDRNRGNEVERPQMTFGRLQRIIPKIMPEKPAEEGSDSKGVPEASGPQNDGKKLCPPGKASSSEKIHERSGPKRGKHAWTHRLRERKQLVIYEEISDPEEDDK

SEQ ID NO: 6029 - protein, 188 aa, Homo sapiens
MNGDDAFARRPRAGAQIPEKIQKSFDDIAKYFSKKEWEKMKSLEKISYVYMKRKYEAMTKLGFKATLPPFMHNTGATDLQGNDFDNDRNQGNQVERPQMTFCRLQRIFPKIMPKKPAEEGNDSKGVPEASGSQNDGKHLCPPGKPSTSEKINKTSGPKRGKHAWTHRLRERKQLVIYEEISDPEEDDE

SEQ ID NO: 6030 - protein, 188 aa, Homo sapiens
MNGDDAFARRPRAGSQIPEKIQKAFDDIAKYFSKKEWEKMKSSEKIIYVYMKRKYEAMTKLGFKATLPPFMCNTGATDLQGNDFDNDRNHRNQVERSQMTFGRLQGIFPKIMPKKPAEVGNDSKEVPEASGLQNDGKQLCPPGKPTTSEKINKASGPKRGKHAWTHRLRERKQLVIYEEISDPEEDDE

SEQ ID NO: 6031 - protein, 188 aa, Homo sapiens; identical to SEQ ID NO: 6030

SEQ ID NO: 6032 - protein, 1826 aa, Homo sapiens
MRPGCDLLLRAAATVTAAIMSDSDSEEDSSGGGPFTLAGILFGNISGAGQLEGESVLDDECKKHLAGLGALGLGSLITELTANEELTGTGGALVNDEGWIRSTEDAVDYSDINEVAEDESQRHQQTMGSLQPLYHSDYDEDDYDADCEDIDCKLMPPPPPPPGPMKKDKDQDAITCVSESGEDIILPSIIAPSFLASEKVDFSSYSDSESEMGPQEATQAESEDGKLTLPLAGIMQHDATKLLPSVTELFPEFRPGKVLRFLHLFGPGKNVPSVWRSARRKRKKHRELIQEEQIQEVECSVESEVSQKSLWNYDYAPPPPPEQCLADDEITMMVPVESKFSQSTGDVDKVTDTKPRVAEWRYGPARLWYDMLGVSEDGSGFDYGFKLRKTQHEPVIKSRMMEEFRKLEESNGTDLLADENFLMVTQLHWEDSIIWDGEDIKHKGTKPQGASLAGWLPSIKTRNVMAYNVQQGFAPTLDDDKPWYSIFPIDNEDLVYGRWEDNIIWDAQAMPRLLEPPVLALDPNDENLILEIPDEKEEATSNSPSKESKKESSLKKSRILLGKTGVIREEPQQNMSQPEVKDPWNLSNDEYYFPKQQGLRGTFGGNIIQHSIPAMELWQPFFPTHMGPIKIRQFHRPPLKKYSFGALSQPGPHSVQPLLKHIKKKAKMREQERQASGGGELFFMRTPQDLTGKDGDLILAEYSEENGPLMMQVGMATKIKNYYKRKPGKDPGAPDCKYGETVYCHTSPFLGSLHPGQLLQALENNLFRAPVYLHKMPETDFLIIRTRQGYYIRELVDIFVVGQQCPLFEVPGPNSRRANMHIRDFLQVFIYRLFWKSKDRPRRIRMEDIKKAFPSHSESSIRKRLKLCADFKRTGMDSNWWVLKSDFRLPTEEEIRAKVSPEQCCAYYSMIAAKQRLKDAGYGEKSFFAPEEENEEDFQMKIDDEVHAAPWNTTRAFIAAMKGKCLLEVTGVADPTGCGEGFSYVKIPNKPTQQKDDKEPQAVKKTVTGTDADLRRLSLKNAKQLLRKFGVPEEEIKKLSRWEVIDVVRTMSTEQAHSGEGPMSKFARGSRFSVAEHQERYKEECQRIFDLQNKVLSSTEVLSTDTDSISAEDSDFEEMGKNIENMLQNKKTSSQLSREWEEQERKELRRMLLVAGSAASGNNHRDDVTASMTSLKSSATGHCLKIYRTFRDEEGKEYVRCETVRKPAVIDAYVRIRTTKDEKFIQKFALFDEKHREEMRKERRRIQEQLRRLKRNQEKEKLKGPPEKKPKKMKERPDLKLKCGACGAIGHMRTNKFCPLYYQTNVPPSKPVAMTEEQEEELEKTVIHNDNEELIKVEGTKIVFGKQLIENVHEVRRKSLVLKFPKQQLPPKKKRRVGTTVHCDYLNIPHKSIHRRRTDPMVTLSSILESIINDMRDLPNTHPFHTPVNAKVVKDYYKIITRPMDLQTLRENVRKCLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKMIVNPVDLETIRKNISKHKYQSRESFLDDVNLILANSVKYNGPESQYTKTAQEIVNICYQTITEYDEHLTQLEKDICTAKEAALEEAELESLDPMTPGPYTSQPPDMYDTNTSLSTSRDASVFQDESNLSVLDISTATPEKQMCQGQGRLGEEDSDVDVEGYDDEEEDGKPKPPAPEGGDGDLADEEEGTVQQPEASVLYEDLLISEGEDDEEDAGSDEEGDNPFSAIQLSESGSDSDVGYGGIRPKQPFMLQHASGEHKDGHGK

SEQ ID NO: 6033 - protein, 124 aa, Homo sapiens
MADEEEDPTFEEENEEIGGGAEGGQGKRKRLFSKELRCMMYGFGDDQNPYTESVDILEDLVIEFITEMTHKAMSIGRQGRVQVEDIVFLIRKDPRKFARVKDLLTMNEELKRARKAFDEANYGS

SEQ ID NO: 6034 - protein, 124 aa, Homo sapiens; identical to SEQ ID NO: 6033

SEQ ID NO: 6035 - protein, 1199 aa, Homo sapiens
MPLTGVEPARMNRKKGDKGFESPRPYKLTHQVVCINNINFQRKSVVGFVELTIFPTVANLNRIKLNSKQCRIYRVRINDLEAAFIYNDPTLEVCHSESKQRNLNYFSNAYAAAVSAVDPDAGNGELCIKVPSELWKHVDELKVLKIHINFSLDQPKGGLHFVVPSVEGSMAERGAHVFSCGYQNSTRFWFPCVDSYSELCTWKLEFTVDAAMVAVSNGDLVETVYTHDMRKKTFHYMLTIPTAASNISLAIGPFEILVDPYMHEVTHFCLPQLLPLLKHTTSYLHEVFEFYEEILTCRYPYSCFKTVFIDEAYVEVAAYASMSIFSTNLLHSAMIIDETPLTRRCLAQSLAQQFFGCFISRMSWSDEWVLKGISGYIYGLWMKKTFGVNEYRHWIKEELDKIVAYELKTGGVLLHPIFGGGKEKDNPASHLHFSIKHPHTLSWEYYSMFQCKAHLVMRLIENRISMEFMLQVFNKLLSLASTASSQKFQSHMWSQMLVSTSGFLKSISNVSGKDIQPLIKQWVDQSGVVKFYGSFAFNRKRNVLELEIKQDYTSPGTQKYVGPLKVTVQELDGSFNHTLQIEENSLKHDIPCHSKSRRNKKKKIPLMNGEEVDMDLSAMDADSPLLWIRIDPDMSVLRKVEFEQADFMWQYQLRYERDVVAQQESILALEKFPTPASRLALTDILEQEQCFYRVRMSACFCLAKIANSMVSTWTGPPAMKSLFTRMFCCKSCPNIVKTNNFMSFQSYFLQKTMPVAMALLRDVHNLCPKEVLTFILDLIKYNDNRKNKFSDNYYRAEMIDALANSVTPAVSVNNEVRTLDNLNPDVRLILEEITRFLNMEKLLPSYRHTITVSCLRAIRVLQKNGHVPSDPALFKSYAEYGHFVDIRIAALEAVVDYTKVDRSYEELQWLLNMIQNDPVPYVRHKILNMLTKNPPFTKNMESPLCNEALVDQLWKLMNSGTSHDWRLRCGAVDLYFTLFGLSRPSCLPLPELGLVLNLKEKKAVLNPTIIPESVAGNQEAANNPSSHPQLVGFQNPFSSSQDEEEIDMDTVHDSQAFISHHLNMLERPSTPGLSKYRPASSRSALIPQHSAGCDSTPTTKPQWSLELARKGTGKEQAPLEMSMHPAASAPLSVFTKESTASKHSDHHHHHHHEHKKKKKKHKHKHKHKHKHDSKEKDKEPFTFSSPASGRSIRSPSLSD

SEQ ID NO: 6036 - protein, 589 aa, Homo sapiens
MKRVRTEQIQMAVSCYLKRRQYVDSDGPLKQGLRLSQTAEEMAANLTVQSESGCANIVSAAPCQAEPQQYEVQFGRLRNFLTDSDSQHSHEVMPLLYPLFVYLHLNLVQNSPKSTVESFYSRFHGMFLQNASQKDVIEQLQTTQTIQDILSNFKLRAFLDNKYVVRLQEDSYNYLIRYLQSDNNTALCKVLTLHIHLDVQPAKRTDYQLYASGSSSRSENNGLEPPDMPSPILQNEAALEVLQESIKRVKDGPPSLTTICFYAFYNTEQLLNTAEISPDSKLLAAGFDNSCIKLWSLRSKKLKSEPHQVDVSRIHLACDILEEEDDEDDNAGTEMKILRGHCGPVYSTRFLADSSGLLSCSEDMSIRYWDLGSFTNTVLYQGHAYPVWDLDISPYSLYFASGSHDRTARLWSFDRTYPLRIYAGHLADVDCVKFHPNSNYLATGSTDKTVRLWSAQQGNSVRLFTGHRGPVLSLAFSPNGKYLASAGEDQRLKLWDLASGTLYKELRGHTDNITSLTFSPDSGLIASASMDNSVRVWDIRNTYCSAPADGSSSELVGVYTGQMSNVLSVQFMACNLLLVTGITQENQEH

SEQ ID NO: 6037 - protein, 84 aa, Homo sapiens
MKRVRTEQIQMAVSCYLKRRQYVDSDGPLKQGLRLSQTAEEMAANLTGNGGGSSGGVSLEQENSRQYPCGITSPLLKTVPERAD

SEQ ID NO: 6038 - protein, 325 aa, Homo sapiens
MKRVRTEQIQMAVSCYLKRRQYVDSDGPLKQGLRLSQTAEEMAANLTVQSESGCANIVSAAPCQAEPQQYEVQFGRLRNFLTDSDSQHSHEVMPLLYPLFVYLHLNLVQNSPKSTVESFYSRFHGMFLQNASQKDVIEQLQTTQTIQDILSNFKLRAFLDNKYVVRLQEDSYNYLIRYLQSDNNTALCKVLTLHIHLDVQPAKRTDYQLYASGSSSRSENNGLEPPDMPSPILQNEAALEVLQESIKRVKDGPPSLTTICFYAFYNTEQLLNTAEISPDSKLLAAGFDNSCIKLWSLRSKKLKSEPHQVDVSRIHLACDILEEEV

SEQ ID NO: 6039 - protein, 589 aa, Homo sapiens; identical to SEQ ID NO: 6036

SEQ ID NO: 6040 - protein, 622 aa, Homo sapiens
MSEREERRFVEIPRESVRLMAESTGLELSDEVAALLAEDVCYRLREATQNSSQFMKHTKRRKLTVEDFNRALRWSSVEAVCGYGSQEALPMRPAREGELYFPEDREVNLVELALATNIPKGCAETAVRVHVSYLDGKGNLAPQGSVPSAVSSLTDDLLKYYHQVTRAVLGDDPQLMKVALQDLQTNSKIGALLPYFVYVVSGVKSVSHDLEQLHRLLQVARSLFRNPHLCLGPYVRCLVGSVLYCVLEPLAASINPLNDHWTLRDGAALLLSHIFWTHGDLVSGLYQHILLSLQKILADPVRPLCCHYGAVVGLHALGWKAVERVLYPHLSTYWTNLQAVLDDYSVSNAQVKADGHKVYGAILVAVERLLKMKAQAAEPNRGGPGGRGCRRLDDLPWDSLLFQESSSGGGAEPSFGSGLPLPPGGAGPEDPSLSVTLADIYRELYAFFGDSLATRFGTGQPAPTAPRPPGDKKEPAAAPDSVRKMPQLTASAIVSPHGDESPRGSGGGGPASASGPAASESRPLPRVHRARGAPRQQGPGTGTRDVFQKSRFAPRGAPHFRFIIAGRQAGRRCRGRLFQTAFPAPYGPSPASRYVQKLPMIGRTSRPARRWALSDYSLYLPL

SEQ ID NO: 6041 - protein, 50 aa, Homo sapiens
MSEREERRFVEIPRESVRLMAESTGLELSDEVAALLAEDVCYRLREATQN

SEQ ID NO: 6042 - protein, 145 aa, Homo sapiens
MSEREERRFVEIPRESVRLMAESTGLELSDEVAALLAEDVCYRLREATQNSSQFMKHTKRRKLTVEDFNRALRWSSVEAVCGYGSQEALPMRPAREGELYFPEDREVNLVELALATNIPKGCAETAVRVHVSYLDGKGNLAPQGS

SEQ ID NO: 6043 - protein, 490 aa, Homo sapiens
MATEFIKSCCGGCFYGETEKHNFSVERDFKAAVPNSQNATISVPPLTSVSVKPQLGCTEDYLLSKLPSDGKEVPFVVPKFKLSYIQPRTQETPSHLEELEGSARASFGDRKVELSSSSQHGPSYDVYNPFYMYQHISPDLSRRFPPRSEVKRLYGSVCDLRTNKLPGSPGLSKSMFDLTNSSQRFIQRHDSLSSVPSSSSSRKNSQGSNRSLDTITLSGDERDFGRLNVKLFYNSSVEQIWITVLQCRDLSWPSSYGDTPTVSIKGILTLPKPVHFKSSAKEGSNAIEFMETFVFAIKLQNLQTVRLVFKIQTQTPRKKTIGECSMSLRTLSTQEMDYSLDITPPSKISVCHAELELGTCFQAVNSRIQLQILEARYLPSSSTPLTLSFFVKVGMFSSGELIYKKKTRLLKASNGRVKWGETMIFPLIQSEKEIVFLIKLYSRSSVRRKHFVGQIWISEDSNNIEAVNQWKETVINPEKVVIRWHKLNPS

SEQ ID NO: 6044 - protein, 490 aa, Homo sapiens; identical to SEQ ID NO: 6043

SEQ ID NO: 6045 - protein, 490 aa, Homo sapiens; identical to SEQ ID NO: 6043

SEQ ID NO: 6046 - protein, 426 aa, Homo sapiens
MATEFIKSCCGGCFYGETEKHNFSVERDFKAAVPNSQNATISVPPLTSVSVKPQLGCTEDYLLSKLPSDGKEVPFVVPKFKLSYIQPRTQETPSHLEELEGSARASFGDRKVELSSSSQHGPSYDVYNPFYMYQHISPDLSRRFPPRSEVKRLYGSVCDLRTNKLPGSPGLSKSMFDLTNSSQRFIQRHDSLSSVPSSSSSRKNSQGSNRSLDTITLSGDERDFGRLNVKLFYNSSVEQIWITVLQCRDLSWPSSYGDTPTVSIKGILTLPKPVHFKSSAKEGSNVCHAELELGTCFQAVNSRIQLQILEARYLPSSSTPLTLSFFVKVGMFSSGELIYKKKTRLLKASNGRVKWGETMIFPLIQSEKEIVFLIKLYSRSSVRRKHFVGQIWISEDSNNIEAVNQWKETVINPEKVVIRWHKLNPS

SEQ ID NO: 6047 - protein, 588 aa, Homo sapiens
MDLEEAEEFKERCTQCAAVSWGLTDEGKYYCTSCHNVTERYQEVTNTDLIPNTQIKALNRGLKKKNNTEKGWDWYVCEGFQYILYQQAEALKNLGVGPELKNDVLHNFWKRYLQKSKQAYCKNPVYTTGRKPTVLEDNLSHSDWASEPELLSDVSCPPFLESGAESQSDIHTRKPFPVSKASQSETSVCSGSLDGVEYSQRKEKGIVKMTMPQTLAFCYLSLLWQREAITLSDLLRFVEEDHIPYINAFQHFPEQMKLYGRDRGIFGIESWPDYEDIYKKTVEVGTFLDLPRFPDITEDCYLHPNILCMKYLMEVNLPDEMHSLTCHVVKMTGMGEVDFLTFDPIAKMAKTVKYDVQAVAIIVVVLKLLFLLDDSFEWSLSNLAEKHNEKNKKDKPWFDFRKWYQIMKKAFDEKKQKWEEARAKYLWKSEKPLYYSFVDKPVAYKKREMVVNLQKQFSTLVESTATAGKKSPSSFQFNWTEEDTDRTCFHGHSLQGVLKEKGQSLLTKNSLYWLSTQKFCRCYCTHVTTYEESNYSLSYQFILNLFSFLLRIKTSLLHEEVSLVEKKLFEKKYSVKRKKSRSKKVRRH

SEQ ID NO: 6048 - protein, 333 aa, Homo sapiens
MKLYGRDRGIFGIESWPDYEDIYKKTVEVGTFLDLPRFPDITEDCYLHPNILCMKYLMEVNLPDEMHSLTCHVVKMTGMGEVDFLTFDPIAKMAKTVKYDVQAVAIIVVVLKLLFLLDDSFEWSLSNLAEKHNEKNKKDKPWFDFRKWYQIMKKAFDEKKQKWEEARAKYLWKSEKPLYYSFVDKPVAYKKREMVVNLQKQFSTLVESTATAGKKSPSSFQFNWTEEDTDRTCFHGHSLQGVLKEKGQSLLTKNSLYWLSTQKFCRCYCTHVTTYEESNYSLSYQFILNLFSFLLRIKTSLLHEEVSLVEKKLFEKKYSVKRKKSRSKKVRRH

SEQ ID NO: 6049 - protein, 297 aa, Homo sapiens
MSRFKFIDIGINLTDPMFRGIYRGVQKHQDDLQDVIGRAVEIGVKKFMITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHCRNSHAEFLDIMKRNRDRCVGGVVHSFDGTKEAAAALIDLDLYIGFNGCSLKTEANLEVLKSIPSEKLMIETDAPWCGVKSTHAGSKYIRTAFPTKKKWESGHCLKDRNEPCHIIQILEIMSAVRDEDPLELANTLYNNTIKVFFPGI

SEQ ID NO: 6050 - protein, 250 aa, Homo sapiens
MITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHCRNSHAEFLDIMKRNRDRCVGGVVHSFDGTKEAAAALIDLDLYIGFNGCSLKTEANLEVLKSIPSEKLMIETDAPWCGVKSTHAGSKYIRTAFPTKKKWESGHCLKDRNEPCHIIQILEIMSAVRDEDPLELANTLYNNTIKVFFPGI

SEQ ID NO: 6051 - protein, 110 aa, Homo sapiens
MITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHCRNSHAEF

SEQ ID NO: 6052 - protein, 761 aa, Homo sapiens
MASERGKVKHNWSSTSEGCPRKRSCLREPCDVAPSSRPAQRSASRSGGPSSPKRLKAQKEDDVACSRRLSWGSSRRRNNSSSSFSPHFLGPGVGGAASKGCLIRNTRGFLSSGGSPLRPANASLEEMASLEEEACSLKVDSKDSSHNSTNSEFAAEAEGQNDTIEEPNKVQKRKRDRLRDQGSTMIYLKAIQGILGKSMPKRKGEAATRAKPSAAEHPSHGEGPARSEGPAKTAEGAARSVTVTAAQKEKDATPEVSMEEDKTVPERSSFYDRRVVIDPQEKPSEEPLGDRRTVIDKCSPPLEFLDDSDSHLEIQKHKDREVVMEHPSSGSDWSDVEEISTVRFSQEEPVSLKPSAVPEPSSFTTDYVMYPPHLYSSPWCDYASYWTSSPKPSSYPSTGSSSNDAAQVGKSSRSRMSDYSPNSTGSVQNTSRDMEASEEGWSQNSRSFRFSRSSEEREVKEKRTFQEEMPPRPCGGHASSSLPKSHLEPSLEEGFIDTHCHLDMLYSKLSFQGTFTKFRKIYSSSFPKEFQGCISDFCDPRTLTDCLWEELLKEDLVWGAFGCHPHFARYYSESQERNLLQALRHPKAVAFGEMGLDYSYKCTTPVPEQHKVFERQLQLAVSLKKPLVIHCREADEDLLEIMKKFVPPDYKIHRHCFTGSYPVIEPLLKYFPNMSVGFTAVLTYSSAWEAREALRQIPLERIIVETDAPYFLPRQVPKSLCQYAHPGLALHTVREIARVKDQPLSLTLAALRENTSRLYSL

SEQ ID NO: 6053 - protein, 761 aa, Homo sapiens; identical to SEQ ID NO: 6052

SEQ ID NO: 6054 - protein, 273 aa, Homo sapiens
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQQKLVKQLPLTSICLETDSPALGPEKQVRNEPWNISISAEYIAQVKGISVEEVIEVTTQNALKLFPKLRHLLQK

SEQ ID NO: 6055 - protein, 274 aa, Homo sapiens
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQKQKLVKQLPLTSICLETDSPALGPEKQVRNEPWNISISAEYIAQVKGISVEEVIEVTTQNALKLFPKLRHLLQK

SEQ ID NO: 6056 - protein, 253 aa, Homo sapiens
MRAAGVGLVDCHCHLSAPDFDRDLDDVLEKAKKANVVALVAVAEHSGEFEKIMQLSERYNGFVLPCLGVHPVQGLPPEDQRSVTLKVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQKQKLVKQLPLTSICLETDSPALGPEKQVRNEPWNISISAEYIAQVKGISVEEVIEVTTQNALKLFPKLRHLLQK

SEQ ID NO: 6057 - protein, 240 aa, Homo sapiens
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQLLSLFSKKQKLVKQLPLTSICLETDSPALGPEKQQNILPR

SEQ ID NO: 6058 - protein, 281 aa, Homo sapiens
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQLLSLFSKKQKLVKQLPLTSICLETDSPALGPEKQVRNEPWNISISAEYIAQVKGISVEEVIEVTTQNALKLFPKLRHLLQK

SEQ ID NO: 6059 - protein, 607 aa, Homo sapiens
MAEKRRGSPCSMLSLKAHAFSVEALIGAEKQQQLQKKRRKLGAEEAAGAVDDGGCSRGGGAGEKGSSEGDEGAALPPPAGATSGPARSGADLERGAAGGCEDGFQQGASPLASPGGSPKGSPARSLARPGTPLPSPQAPRVDLQGAELWKRFHEIGTEMIITKAGRRMFPAMRVKISGLDPHQQYYIAMDIVPVDNKRYRYVYHSSKWMVAGNADSPVPPRVYIHPDSPASGETWMRQVISFDKLKLTNNELDDQGHIILHSMHKYQPRVHVIRKDCGDDLSPIKPVPSGEGVKAFSFPETVFTTVTAYQNQQITRLKIDRNPFAKGFRDSGRNRMGLEALVESYAFWRPSLRTLTFEDIPGIPKQGNASSSTLLQGTGNGVPATHPHLLSGSSCSSPAFHLGPNTSQLCSLAPADYSACARSGLTLNRYSTSLAETYNRLTNQAGETFAPPRTPSYVGVSSSTSVNMSMGGTDGDTFSCPQTSLSMQISGMSPQLQYIMPSPSSNAFATNQTHQGSYNTFRLHSPCALYGYNFSTSPKLAASPEKIVSSQGSFLGSSPSGTMTDRQMLPPVEGVHLLSSGGQQSFFDSRTLGSLTLSSSQVSAHMV

SEQ ID NO: 6060 - protein, 305 aa, Homo sapiens
RGRHIWKLGFPKGGCEDGFQQGASPLASPGGSPKGSPARSLARPGTPLPSPQAPRVDLQGAELWKRFHEIGTEMIITKAGRRMFPAMRVKISGLDPHQQYYIAMDIVPVDNKRYRYVYHSSKWMVAGNADSPVPPRVYIHPDSPASGETWMRQVISFDKLKLTNNELDDQGHIILHSMHKYQPRVHVIRKDCGDDLSPIKPVPSGEGVKAFSFPETVFTTVTAYQNQQITRLKIDRNPFAKGFRDSGRNRMGLEALVESYAFWRPSLRTLTFEDIPGIPKQEYRDLKTDYIFPERDNLVSRETKL

SEQ ID NO: 6061 - protein, 682 aa, Homo sapiens
MQLEHCLSPSIMLSKKFLNVSSSYPHSGGSELVLHDHPIISTTDNLERSSPLKKITRGMTNQSDTDNFPDSKDSPGDVQRSKLSPVLDGVSELRHSFDGSAADRYLLSQSSQPQSAATAPSAMFPYPGQHGPAHPAFSIGSPSRYMAHHPVITNGAYNSLLSNSSPQGYPTAGYPYPQQYGHSYQGAPFYQFSSTQPGLVPGKAQVYLCNRPLWLKFHRHQTEMIITKQGRRMFPFLSFNISGLDPTAHYNIFVDVILADPNHWRFQGGKWVPCGKADTNVQGNRVYMHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFVSNYAKARFHPGAGAGPGPGTDRSVPHTNGLLSPQQAEDPGAPSPQRWFVTPANNRLDFAASAYDTATDFAGNAATLLSYAAAGVKALPLQAAGCTGRPLGYYADPSGWGARSPPQYCGTKSGSVLPCWPNSAAAAARMAGANPYLGEEAEGLAAERSPLPPGAAEDAKPKDLSDSSWIETPSSIKSIDSSDSGIYEQAKRRRISPADTPVSESSSPLKSEVLAQRDCEKNCAKDISGYYGFYSHS

SEQ ID NO: 6062 - protein, 395 aa, Homo sapiens
MHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFVSNYAKARFHPGAGAGPGPGTDRSVPHTNGLLSPQQAEDPGAPSPQRWFVTPANNRLDFAASAYDTATDFAGNAATLLSYAAAGVKALPLQAAGCTGRPLGYYADPSGWGARSPPQYCGTKSGSVLPCWPNSAAAAARMAGANPYLGEEAEGLAAERSPLPPGAAEDAKPKDLSDSSWIETPSSIKSIDSSDSGIYEQAKRRRISPADTPVSESSSPLKSEVLAQRDCEKNCAKDISGYYGFYSHS

SEQ ID NO: 6063 - protein, 351 aa, Homo sapiens
MHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRAGPGPGTDRSVPHTNGLLSPQQAEDPGAPSPQRWFVTPANNRLDFAASAYDTATDFAGNAATLLSYAAAGVKALPLQAAGCTGRPLGYYADPSGWGARSPPQYCGTKSGSVLPCWPNSAAAAARMAGANPYLGEEAEGLAAERSPLPPGAAEDAKPKDLSDSSWIETPSSIKSIDSSDSGIYEQAKRRRISPADTPVSESSSPLKSEVLAQRDCEKNCAKDISGYYGFYSHS

SEQ ID NO: 6064 - protein, 912 aa, Homo sapiens
MSLPIGSAEVASERVELWRSGFRWWQRCLCFCRYRRVAMAAVDSDVESLPRGGFRCCLCHVTTANRPSLDAHLGGRKHRHLVELRAARKAQGLRSVFVSGFPRDVDSAQLSEYFLAFGPVASVVMDKDKGVFAIVEMGDVGAREAVLSQSQHSLGGHRLRVRPREQKEFQSPASKSPKGAAPDSHQLAKALAEAADVGAQMIKLVGLRELSEAERQLRSLVVALMQEVFTEFFPGCVVHPFGSSINSFDVHGCDLDLFLDLGDLEEPQPVPKAPESPSLDSALASPLDPQALACTPASPPDSQPPASPQDSEALDFETPSSSLAPQTPDSALASETLASPQSLPPASPLLEDREEGDLGKASELAETPKEEKAEGAAMLELVGSILRGCVPGVYRVQTVPSARRPVVKFCHRPSGLHGDVSLSNRLALHNSRFLSLCSELDGRVRPLVYTLRCWAQGRGLSGSGPLLSNYALTLLVIYFLQTRDPPVLPTVSQLTQKAGEGEQVEVDGWDCSFPRDASRLEPSINVEPLSSLLAQFFSCVSCWDLRGSLLSLREGQALPVAGGLPSNLWEGLRLGPLNLQDPFDLSHNVAANVTSRVAGRLQNCCRAAANYCRSLQYQRRSSRGRDWGLLPLLQPSSPSSLLSATPIPLPLAPFTQLTAALVQVFREALGCHIEQATKRTRSEGGGTGESSQGGTSKRLKVDGQKNCCEEGKEEQQGCAGDGGEDRVEEMVIEVGEMVQDWAMQSPGQPGDLPLTTGKHGAPGEEGQPSHAALAERGPKGHEAAQEWSQGEAGKGASLPSSASWRCALWHRVWQGRRRARRRLQQQTKEGAGGGAGTRAGWLATEAQVTQELKGLSGGEERPETEPLLSFVASVSPADRMLTVTPLQDPQGLFPDLHHFLQVFLPQAIRHLK

SEQ ID NO: 6065 - protein, 874 aa, Homo sapiens
MAAVDSDVESLPRGGFRCCLCHVTTANRPSLDAHLGGRKHRHLVELRAARKAQGLRSVFVSGFPRDVDSAQLSEYFLAFGPVASVVMDKDKGVFAIVEMGDVGAREAVLSQSQHSLGGHRLRVRPREQKEFQSPASKSPKGAAPDSHQLAKALAEAADVGAQMIKLVGLRELSEAERQLRSLVVALMQEVFTEFFPGCVVHPFGSSINSFDVHGCDLDLFLDLGDLEEPQPVPKAPESPSLDSALASPLDPQALACTPASPPDSQPPASPQDSEALDFETPSSSLAPQTPDSALASETLASPQSLPPASPLLEDREEGDLGKASELAETPKEEKAEGAAMLELVGSILRGCVPGVYRVQTVPSARRPVVKFCHRPSGLHGDVSLSNRLALHNSRFLSLCSELDGRVRPLVYTLRCWAQGRGLSGSGPLLSNYALTLLVIYFLQTRDPPVLPTVSQLTQKAGEGEQVEVDGWDCSFPRDASRLEPSINVEPLSSLLAQFFSCVSCWDLRGSLLSLREGQALPVAGGLPSNLWEGLRLGPLNLQDPFDLSHNVAANVTSRVAGRLQNCCRAAANYCRSLQYQRRSSRGRDWGLLPLLQPSSPSSLLSATPIPLPLAPFTQLTAALVQVFREALGCHIEQATKRTRSEGGGTGESSQGGTSKRLKVDGQKNCCEEGKEEQQGCAGDGGEDRVEEMVIEVGEMVQDWAMQSPGQPGDLPLTTGKHGAPGEEGQPSHAALAERGPKGHEAAQEWSQGEAGKGASLPSSASWRCALWHRVWQGRRRARRRLQQQTKEGAGGGAGTRAGWLATEAQVTQELKGLSGGEERPETEPLLSFVASVSPADRMLTVTPLQDPQGLFPDLHHFLQVFLPQAIRHLK

SEQ ID NO: 6066 - protein, 164 aa, Homo sapiens
MCPPVSMRYEEEGMSYLYASWMYQLQHGDQLSICFTCFKAAFLDFKDLLESEDWEEDNWDPELMEHTEAESEQEGSSGMELSWGQSPGQPVQGGSEAWGPGTLAAAPEGLEDAGLDPHFVPTELWPQEAVPLGLGLEDADWTQGLPWRFEELLTCSHWPSFFPS

SEQ ID NO: 6067 - protein, 411 aa, Homo sapiens
MLSLREQQLQVWFKNRRAKLARERRLQQQPQRVPGQRGRGARAAPLVPAASASAPQRGPSGILPAAEPTICSLHQAWGGPGCRAQKGIPAALSPGPGPIPAPIPGPAQIPGPLPGSIPGPIPGPAQIPSPIPAPIPGPISGPVQIPGPFRGPIPGPISGPAPIPGPISGPFSGPNPGPIPGPNPGPIPGPISGPIPGPISVPIPGPIPGPISGPISGPNPGPIPGPIPGPISGPNPGPIPGPISGPNPGLIPGPIPGPISGPGPIIGPIPSPAQIPGPGRLQGPGPILSPGRMRSPGSLPGLAPILGPGSGPGSGSVPAPIPGPGSLPAPAPLWPQSPDASDFLPDTQLFPHFTELLLPLDPLEGSSVSTMTSQYQEGDDSMGKKHSGSQPQEEGGSVNENHSGPRLLLDL

SEQ ID NO: 6068 - protein, 508 aa, Homo sapiens
MDEAGNHHSEQTITRTENQTPHALAHRRMGPCLSCSQLYSQYLGLSQTHSSPPLALDPPRRQRQERTVYTESQQKVLEFYFQKDQYPNYDQRLNLAEMLSLREQQLQVWFKNRRAKLARERRLQQQPQRVPGQRGRGARAAPLVPAASASAPQRGPSGILPAAEPTICSLHQAWGGPGCRAQKGIPAALSPGPGPIPAPIPGPAQIPGPLPGSIPGPIPGPAQIPSPIPAPIPGPISGPVQIPGPFRGPIPGPISGPAPIPGPISGPFSGPNPGPIPGPNPGPIPGPISGPIPGPISVPIPGPIPGPISGPISGPNPGPIPGPIPGPISGPNPGPIPGPISGPNPGLIPGPIPGPISGPGPIIGPIPSPAQIPGPGRLQGPGPILSPGRMRSPGSLPGLAPILGPGSGPGSGSVPAPIPGPGSLPAPAPLWPQSPDASDFLPDTQLFPHFTELLLPLDPLEGSSVSTMTSQYQEGDDSMGKKHSGSQPQEEGGSVNENHSGPRLLLDL

SEQ ID NO: 6069 - protein, 401 aa, Homo sapiens
MLSLREQQLQVWFKNRRAKLARERRLQQQPQRVPGQRGRGARAAPLVPAASASAPQRGPSGILPAAEPTICSLHQAWGGPGCRAQKGIPAALSPGPGPIPAPIPGPAQIPGPLPGSIPGPIPGPAQIPSPIPAPIPGPISGPVQIPGPFRGPIPGPISGPFSGPNPGPIPGPNPGPIPGPISGPIPGPISVPIPGPIPGPISGPISGPNPGPIPGPIPGPISGPNPGPIPGPISGPNPGLIPGPIPGPISGPGPIIGPIPSPAQIPGPGRLQGPGPILSPGRMRSPGSLPGLAPILGPGSGPGSGSVPAPIPGPGSLPAPAPLWPQSPDASDFLPDTQLFPHFTELLLPLDPLEGSSVSTMTSQYQEGDDSMGKKHSGSQPQEEGGSVNENHSGPRLLLDL

SEQ ID NO: 6070 - protein, 401 aa, Homo sapiens
MVLAQSRVSAGVGSPHCSGSGGGGSDSFPWPASHPGNPQCSFSTAFLASPRLSRGTLAYLPPAPWSSLATPSALLGSSCAPPPPPARCPQPRALSPELGTKAGPRRPHRWELPRSPSQGAQGPAPRRRLLETMKGIVAASGSETEDEDSMDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 6071 - protein, 272 aa, Homo sapiens
MKGKKGIVAASGSETEDEDSMDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 6072 - protein, 252 aa, Homo sapiens
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 6073 - protein, 252 aa, Homo sapiens; identical to SEQ ID NO: 6072

SEQ ID NO: 6074 - protein, 252 aa, Homo sapiens; identical to SEQ ID NO: 6072

SEQ ID NO: 6075 - protein, 252 aa, Homo sapiens; identical to SEQ ID NO: 6072

SEQ ID NO: 6076 - protein, 272 aa, Homo sapiens; identical to SEQ ID NO: 6071

SEQ ID NO: 6077 - protein, 252 aa, Homo sapiens; identical to SEQ ID NO: 6072

SEQ ID NO: 6078 - protein, 286 aa, Homo sapiens
MTCSGKSCALARSSLTSSQGIVAASGSETEDEDSMDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 6079 - protein, 92 aa, Homo sapiens
MDIPLDLSSSAGSGKRRRRGNLPKESVQILRDWLYEHRYNAYPSEQEKALLSQQTHLSTLQVCNWFINARRRLLPDMLRKDGKDPNQFTISR

SEQ ID NO: 6080 - protein, 133 aa, Homo sapiens
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLG

SEQ ID NO: 6081 - protein, 246 aa, Homo sapiens
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMEL

SEQ ID NO: 6082 - protein, 219 aa, Homo sapiens
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPT

SEQ ID NO: 6083 - protein, 131 aa, Homo sapiens
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPT

SEQ ID NO: 6084 - protein, 138 aa, Homo sapiens
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSP

SEQ ID NO: 6085 - protein, 252 aa, Homo sapiens; identical to SEQ ID NO: 6072

SEQ ID NO: 6086 - protein, 168 aa, Homo sapiens
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSL

SEQ ID NO: 6087 - protein, 309 aa, Homo sapiens
MPRHCSAAGCCTRDTRETRNRGISFHRLPKKDNPRRGLWLANCQRLDPSGQGLWDPASEYIYFCSKHFEEDCFELVGISGYHRLKEGAVPTIFESFSKLRRTTKTKGHSYPPGPAEVSRLRRCRKRCSEGRGPTTPFSPPPPADVTCFPVEEASAPATLPASPAGRLEPGLSSPFSDLLGPLGAQADEAGCSAQPSPERQPSPLEPRPVSPSAYMLRLPPPAGAYIQNEHSYQVGSALLWKRRAEAALDALDKAQRQLQACKRREQRLRLRLTKLQQERAREKRAQADARQTLKEHVQDFAMQLSSSMA

SEQ ID NO: 6088 - protein, 309 aa, Homo sapiens; identical to SEQ ID NO: 6087

SEQ ID NO: 6089 - protein, 379 aa, Homo sapiens
MGDSRRRSLGNQPSSEAAGRSEREQDGDPRGLQSSVYESRRVTDPERQDLDNAELGPEDPEEELPPEEVAGEEFPETLDPKEALSELERVLDKDLEEDIPEISRLSISQKLPSTTMTKARKRRRRRRLMELAEPKINWQVLKDRKGRCGKGYAWISPCKMSLHFCLCWPSVYWTERFLEDTTLTITVPAVSRRVEELSRPKRFYLEYYNNNRTTPVWPIPRSSLEYRASSRLKELAAPKIRDNFWSMPMSEVSQVSRAAQMAVPSSRILQLSKPKAPATLLEEWDPVPKPKPHVSDHNRLLHLARPKAQSDKCVPDRDPRWEVLDVTKKVVASPRIISLAKPKVRKGLNEGYDRRPLASMSLPPPKASPEKCDQPRPGL

SEQ ID NO: 6090 - protein, 355 aa, Homo sapiens
MGDSRRRSLGNQPSSEAAGRSEREQDGDPRGLQSSVYESRRVTDPERQDLDNAELGPEDPEEELPPEEVAGEEFPETLDPKEALSELERVLDKDLEEDIPEISRLSISQKLPSTTMTKARKRRRRRRLMELAEPKINWQVLKDRPSVYWTERFLEDTTLTITVPAVSRRVEELSRPKRFYLEYYNNNRTTPVWPIPRSSLEYRASSRLKELAAPKIRDNFWSMPMSEVSQVSRAAQMAVPSSRILQLSKPKAPATLLEEWDPVPKPKPHVSDHNRLLHLARPKAQSDKCVPDRDPRWEVLDVTKKVVASPRIISLAKPKVRKGLNEGYDRRPLASMSLPPPKASPEKCDQPRPGL

SEQ ID NO: 6091 - protein, 149 aa, Homo sapiens
MSFLLPKLTSKKEVDQAIKSTAEKVLVLRFGRDEDPVCLQLDDILSKTSSDLSKMAAIYLVDVDQTAVYTQYFDISYIPSTVFFFNGQHMKVDYGSPDHTKFVGSFKTKQDFIDLIEVIYRGAMRGKLIVQSPIDPKNIPKYDLLYQDI

SEQ ID NO: 6092 - protein, 149 aa, Homo sapiens; identical to SEQ ID NO: 6091

SEQ ID NO: 6093 - protein, 149 aa, Homo sapiens; identical to SEQ ID NO: 6091

SEQ ID NO: 6094 - protein, 296 aa, Homo sapiens
MERAVPLAVPLGQTEVFQALQRLHMTIFSQSVSPCGKFLAAGNNYGQIAIFSLSSALSSEAKEESKKPVVTFQAHDGPVYSMVSTDRHLLSAGDGEVKAWLWAEMLKKGCKELWRRQPPYRTSLEVPEINALLLVPKENSLILAGGDCQLHTMDLETGTFTRVLRGHTDYIHCLALRERSPEVLSGGEDGAVRLWDLRTAKEVQTIEVYKHEECSRPHNGRWIGCLATDSDWMVCGGGPALTLWHLRSSTPTTIFPIRAPQKHVTFYQDLVLTAAGNSCRVDVFTNLGYRAFSLSF

SEQ ID NO: 6095 - protein, 341 aa, Homo sapiens
MERAVPLAVPLGQTEVFQALQRLHMTIFSQSVSPCGKFLAAGNNYGQIAIFSLSSALSSEAKEESKKPVVTFQAHDGPVYSMVSTDRHLLSAGDGEVKAWLWAEMLKKGCKELWRRQPPYRTSLEVPEINALLLVPKENSLILAGGDCQLHTMDLETGTFTRVLRGHTDYIHCLALRERSPEVLSGGEDGAVRLWDLRTAKEVQTIEVYKHEECSRPHNGRWIGCLATDSDWMVCGGGPALTLWHLRSSTPTTIFPIRAPQKHVTFYQDLILSAGQGRCVNQWQLSGELKAQVPGSSPGLLSLSLNQQPAAPECKVLTAAGNSCRVDVFTNLGYRAFSLSF

SEQ ID NO: 6096 - protein, 955 aa, Homo sapiens
MSKTNKSKSGSRSSRSRSASRSRSRSFSKSRSRSRSLSRSRKRRLSSRSRSRSYSPAHNRERNHPRVYQNRDFRGHNRGYRRPYYFRGRNRGFYPWGQYNRGGYGNYRSNWQNYRQAYSPRRGRSRSRSPKRRSPSPRSRSHSRNSDKSSSDRSRRSSSSRSSSNHSRVESSKRKSAKEKKSSSKDSRPSQAAGDNQGDEAKEQTFSGGTSQDTKASESSKPWPDATYGTGSASRASAVSELSPRERSPALKSPLQSVVVRRRSPRPSPVPKPSPPLSSTSQMGSTLPSGAGYQSGTHQGQFDHGSGSLSPSKKSPVGKSPPSTGSTYGSSQKEESAASGGAAYTKRYLEEQKTENGKDKEQKQTNTDKEKIKEKGSFSDTGLGDGKMKSDSFAPKTDSEKPFRGSQSPKRYKLRDDFEKKMADFHKEEMDDQDKDKAKGRKESEFDDEPKFMSKVIGANKNQEEEKSGKWEGLVYAPPGKEKQRKTEELEEESFPERSKKEDRGKRSEGGHRGFVPEKNFRVTAYKAVQEKSSSPPPRKTSESRDKLGAKGDFPTGKSSFSITREAQVNVRMDSFDEDLARPSGLLAQERKLCRDLVHSNKKEQEFRSIFQHIQSAQSQRSPSELFAQHIVTIVHHVKEHHFGSSGMTLHERFTKYLKRGTEQEAAKNKKSPEIHRRIDISPSTFRKHGLAHDEMKSPREPGYKAEGKYKDDPVDLRLDIERRKKHKERDLKRGKSRESVDSRDSSHSRERSAEKTEKTHKGSKKQKKHRRARDRSRSSSSSSQSSHSYKAEEYTEETEEREESTTGFDKSRLGTKDFVGPSERGGGRARGTFQFRARGRGWGRGNYSGNNNNNSNNDFQKRNREEEWDPEYTPKSKKYYLHDDREGEGSDKWVSRGRGRGAFPRGRGRFMFRKSSTSPKWAHDKFSGEEGEIEDDESGTENREEKDNIQPTTE

SEQ ID NO: 6097 - protein, 955 aa, Homo sapiens; identical to SEQ ID NO: 6096

SEQ ID NO: 6098 - protein, 40 aa, Homo sapiens
MSKTNKSKSGSRSSRSRSASRSRSRSFSKSRSRSRSLSRS

SEQ ID NO: 6099 - protein, 471 aa, Homo sapiens
MELSSKKKLHALSLAEKIQVLELLDESKMSQSEVARRFQVSQPQISRICKNKEKLLADWCSGTANRERKRKRESKYSGIDEALLCWYHIARAKAWDVTGPMLLHKAKELADIMGQDFVPSIGWLVRWKRRNNVGFGARHVLAPSFPPEPPPPGLTSQAQLPLSLKDFSPEDVFGCAELPLLYRAVPGSFGACDQVQVLLCANSRGTEKRRVLLGGLQAAPRCFFGIRSEALPASYHPDLGIPWLEWLAQFDRDMGQQGRQVALLLAARVVEELAGLPGLYHVKLLPLAASSTTPPLPSSVVRAFKAHYRHRLLGKLAAIQSERDGTSLAEAGAGITVLDALHVASAAWAKVPPQLIFSSFIQEGLAPGKTPPSSHKTSEMPPVPGGLSLEEFSRFVDLEGEEPRSGVCKEEIGTEDEKGDREGAFEPLPTKADALRALGTLRRWFECNSTSPELFEKFYDCEEEVERLCCL

SEQ ID NO: 6100 - protein, 512 aa, Homo sapiens
MAEASVDASTLPVTVKKKKSLSIEEKIDIINAVESGKKKAEIAAEYGIKKNSLSSIMKNKDKVLEAFESLRFDPKRKRLRTAFYTDLEEALMRWYRIAQCLNVPVNGPMLRLKANDFAQKLGHNDFKCSNGWLDRFKSRYGLVFRAQPVEATGVPVDPSTVWYQNVLPYYLNDYHPKNVFNIKETGLLYRMLPTNTFAFKGETCSVGKLCKDRITLVVGTNMDGSEKLPLLVIGKKRTPHCFKGLKSLPVCYEANRMAWMTSDVFEQWMRKLDEEFQAQQRRVVIFVESFPAHPEVKNLKSIELAFFPSCLSSKCIAMKQGVIKSLKIKYRHCLIKKFLSSVEGSKEFTFSLLDAVDTLHLCWRAVTPETIVKSYEEAGFKSQKGESDITNAEKDTGLDLVADALGAGVEFPEGLSIEEYAALDDDLETCEAAPNGDSICTKESKSDETGFYTSDEEDDDGSPGTELPLPSKSEAITALDTLKKFLRSQDMNDGLQNSLADLENFINSLSPK

SEQ ID NO: 6101 - protein, 593 aa, Homo sapiens
MAFRKAYSIKDKLQAIERVKGGERQASVCRDFGVPGGTLRGWLKDEPKLRWFLEQLGGEVGTQRKKMRLANEEEIDRAVYAWFLALRQHGVPLSGPLIQAQAEAFARQIYGPECTFKASHGWFWRWQKRHGISSQRFYGEAGPPAPSPAPGPPVKEEPALPSGAGPLPDRAPAPPPPAEGGYGDEQIYSASVTGLYWKLLPEQAAPPGAGDPGAGGCGRRWRGDRVTVLLAANLTGSHKLKPLVIGRLPDPPSLRHHNQDKFPASYRYSPDAWLSRPLLRGWFFEEFVPGVKRYLRRSCLQQKAVLLVAHPPCPSPAASMPALDSEDAPVRCRPEPLGPPEELQTPDGAVRVLFLSKGSSRAHIPAPLEQGVVAAFKQLYKRELLRLAVSCASGSPLDFMRSFMLKDMLYLAGLSWDLVQAGSIERCWLLGLRAAFEPRPGEDSAGQPAQAEEAAEHSRVLSDLTHLAALAYKCLAPEEVAEWLHLDDDGGPPEGCREEVGPALPPAAPPAPASLPSAMGGGEDEEEATDYGGTSVPTAGEAVRGLETALRWLENQDPREVGPLRLVQLRSLISMARRLGGIGHTPAGPYDGV

SEQ ID NO: 6102 - protein, 642 aa, Homo sapiens
MYPAGPPAGPVPRRGRRPLPGPPAPAPAPVPAARPPPPAPGPRPRVAVKMAFRKAYSIKDKLQAIERVKGGERQASVCRDFGVPGGTLRGWLKDEPKLRWFLEQLGGEVGTQRKKMRLANEEEIDRAVYAWFLALRQHGVPLSGPLIQAQAEAFARQIYGPECTFKASHGWFWRWQKRHGISSQRFYGEAGPPAPSPAPGPPVKEEPALPSGAGPLPDRAPAPPPPAEGGYGDEQIYSASVTGLYWKLLPEQAAPPGAGDPGAGGCGRRWRGDRVTVLLAANLTGSHKLKPLVIGRLPDPPSLRHHNQDKFPASYRYSPDAWLSRPLLRGWFFEEFVPGVKRYLRRSCLQQKAVLLVAHPPCPSPAASMPALDSEDAPVRCRPEPLGPPEELQTPDGAVRVLFLSKGSSRAHIPAPLEQGVVAAFKQLYKRELLRLAVSCASGSPLDFMRSFMLKDMLYLAGLSWDLVQAGSIERCWLLGLRAAFEPRPGEDSAGQPAQAEEAAEHSRVLSDLTHLAALAYKCLAPEEVAEWLHLDDDGGPPEGCREEVGPALPPAAPPAPASLPSAMGGGEDEEEATDYGGTSVPTAGEAVRGLETALRWLENQDPREVGPLRLVQLRSLISMARRLGGIGHTPAGPYDGV

SEQ ID NO: 6103 - protein, 521 aa, Homo sapiens
MANKGNKKRRQFSLEEKMKVVGAVDSGKRKGDVAKEFGITPSTLSTFLKDRTKFEEKVREASVGPQRKRMRSALYDDIDKAVFAWFQEIHAKNILVTGSVIRKKALNLANMLGYDNFQASVGWLNRFRDRHGIALKAVCREDSDRLMNGLGIDKINEWHAGEIIKLIADYSPDDIFNADETGVFFQLLPQHTLAAKGDHCRGGKKAKQRLTALFCCNASGTEKMRPLIVGRSASPHCLKNIHSLPCDYRANQWAWMTRDLFNEWLMQVDARMKRAERRILLLIDNCSAHNMLPHLERIQVGYLPSNCTAVLQPLNLGIIHTMKVLYQSHLLKQILLKLNSSEDQEEVDIKQAIDMIAAAWWSVKPSTVVKCWQKAGIVPMEFAECDTESAASEPDIAIEKLWHTVAIATCVPNEVNFQDFVTADDDLIISQDTDIIQDMVAGENTSEAGSEDEGEVSLPEQPKVTITEAISSVQKLRQFLSTCVDIPDAIFGQLNGIDEYLMKRVTQTLIDSKITDFLQTK

SEQ ID NO: 6104 - protein, 521 aa, Homo sapiens; identical to SEQ ID NO: 6103

SEQ ID NO: 6105 - protein, 227 aa, Homo sapiens
MPGCRISACGPGAQEGTAEQRSPPPPWDPMPSSQPPPPTPTLTPTPTPGQSPPLPDAAGASAGAAEDQELQRWRQGASGIAGLAGPGGGSGAAAGAGGRALELAEARRRLLEVEGRRRLVSELESRVLQLHRVFLAAELRLAHRAESLSRLSGGVAQAELYLAAHGSRLKKGPRRGRRGRPPALLASALGLGGCVPWGAGRLRRGHGPEPDSPFRRSPPRGPASPQR

SEQ ID NO: 6106 - protein, 50 aa, Homo sapiens
  MOD_RES (1)..(1): Any amino acid
XGRPPALLASALGLGGCVPWGAGRLRRGHGPEPDSPFRRSPPRGPASPQR

SEQ ID NO: 6107 - protein, 124 aa, Homo sapiens
YLLLEYCEGNDLDFYLKQHKLMSEKEARSIVMQIVNALRYLNEIKPPIIHYDLKPGNILLVDGTACGEIKITDFGLSKIMDDDSYGVDGMDLTSQGAGTYWYLPPECFVVGKEPPKISNKVDVW

SEQ ID NO: 6108 - protein, 413 aa, Homo sapiens
MSVQSSSGSLEGPPSWSQLSTSPTPGSAAAARSLLNHTPPSGRPREGAMDELHSLDPRRQELLEARFTGVASGSTGSTGSCSVGAKASTNNESSNHSFGSLGSLSDKESETPEKKQSESSRGRKRKAENQNESSQGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKR

SEQ ID NO: 6109 - protein, 766 aa, Homo sapiens
MSVQSSSGSLEGPPSWSQLSTSPTPGSAAAARSLLNHTPPSGRPREGAMDELHSLDPRRQELLEARFTGVASGSTGSTGSCSVGAKASTNNESSNHSFGSLGSLSDKESETPEKKQSESSRGRKRKAENQNESSQGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKEEAEIQAELERLERVRNLHIRELKRINNEDNSQFKDHPTLNERYLLLHLLGRGGFSEVYKAFDLYEQRYAAVKIHQLNKSWRDEKKENYHKHACREYRIHKELDHPRIVKLYDYFSLDTDTFCTVLEYCEGNDLDFYLKQHKLMSEKEARSIVMQIVNALRYLNEIKPPIIHYDLKPGNILLVDGTACGEIKITDFGLSKIMDDDSYGVDGMDLTSQGAGTYWYLPPECFVVGKEPPKISNKVDVWSVGVIFFQCLYGRKPFGHNQSQQDILQENTILKATEVQFPVKPVVSSEAKAFIRRCLAYRKEDRFDVHQLANDPYLLPHMRRSNSSGNLHMAGLTASPTPPSSSIITY

SEQ ID NO: 6110 - protein, 670 aa, Homo sapiens
MAVLFLYDLKTTGKTPEKKQSESSRGRKRKAENQNESSQGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKEEAEIQAELERLERVRNLHIRELKRINNEDNSQFKDHPTLNERYLLLHLLGRGGFSEVYKAFDLYEQRYAAVKIHQLNKSWRDEKKENYHKHACREYRIHKELDHPRIVKLYDYFSLDTDTFCTVLEYCEGNDLDFYLKQHKLMSEKEARSIVMQIVNALRYLNEIKPPIIHYDLKPGNILLVDGTACGEIKITDFGLSKIMDDDSYGVDGMDLTSQGAGTYWYLPPECFVVGKEPPKISNKVDVWSVGVIFFQCLYGRKPFGHNQSQQDILQENTILKATEVQFPVKPVVSSEAKAFIRRCLAYRKEDRFDVHQLANDPYLLPHMRRSNSSGNLHMAGLTASPTPPSSSIITY

SEQ ID NO: 6111 - protein, 718 aa, Homo sapiens
MDELHSLDPRRQELLEARFTGVASGSTGSTGSCSVGAKASTNNESSNHSFGSLGSLSDKESETPEKKQSESSRGRKRKAENQNESSQGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKEEAEIQAELERLERVRNLHIRELKRINNEDNSQFKDHPTLNERYLLLHLLGRGGFSEVYKAFDLYEQRYAAVKIHQLNKSWRDEKKENYHKHACREYRIHKELDHPRIVKLYDYFSLDTDTFCTVLEYCEGNDLDFYLKQHKLMSEKEARSIVMQIVNALRYLNEIKPPIIHYDLKPGNILLVDGTACGEIKITDFGLSKIMDDDSYGVDGMDLTSQGAGTYWYLPPECFVVGKEPPKISNKVDVWSVGVIFFQCLYGRKPFGHNQSQQDILQENTILKATEVQFPVKPVVSSEAKAFIRRCLAYRKEDRFDVHQLANDPYLLPHMRRSNSSGNLHMAGLTASPTPPSSSIITY

SEQ ID NO: 6112 - protein, 718 aa, Homo sapiens; identical to SEQ ID NO: 6111

SEQ ID NO: 6113 - protein, 772 aa, Homo sapiens
MMEELHSLDPRRQELLEARFTGVGVSKGPLNSESSNQSLCSVGSLSDKEVETPEKKQNDQRNRKRKAEPYETSQGKGTPRGHKISDYFEFAGGSAPGTSPGRSVPPVARSSPQHSLSNPLPRRVEQPLYGLDGSAAKEATEEQSALPTLMSVMLAKPRLDTEQLAQRGAGLCFTFVSAQQNSPSSTGSGNTEHSCSSQKQISIQHRQTQSDLTIEKISALENSKNSDLEKKEGRIDDLLRANCDLRRQIDEQQKMLEKYKERLNRCVTMSKKLLIEKSKQEKMACRDKSMQDRLRLGHFTTVRHGASFTEQWTDGYAFQNLIKQQERINSQREEIERQRKMLAKRKPPAMGQAPPATNEQKQRKSKTNGAENETPSSGNTELKDTAPALGAHSLLRLTLAEYHEQEEIFKLRLGHLKKEEAEIQAELERLERVRNLHIRELKRIHNEDNSQFKDHPTLNDRYLLLHLLGRGGFSEVYKAFDLTEQRYVAVKIHQLNKNWRDEKKENYHKHACREYRIHKELDHPRIVKLYDYFSLDTDSFCTVLEYCEGNDLDFYLKQHKLMSEKEARSIIMQIVNALKYLNEIKPPIIHYDLKPGNILLVNGTACGEIKITDFGLSKIMDDDSYNSVDGMELTSQGAGTYWYLPPECFVVGKEPPKISNKVDVWSVGVIFYQCLYGRKPFGHNQSQQDILQENTILKATEVQFPPKPVVTPEAKAFIRRCLAYRKEDRIDVQQLACDPYLLPHIRKSVSTSSPAGAAIASTSGASNNSSSN

SEQ ID NO: 6114 - protein, 718 aa, Homo sapiens
MMEELHSLDPRRQELLEARFTGVGVSKGPLNSESSNQSLCSVGSLSDKEVETPEKKQNDQRNRKRKAEPYETSQGKGTPRGHKISDYFERRVEQPLYGLDGSAAKEATEEQSALPTLMSVMLAKPRLDTEQLAQRGAGLCFTFVSAQQNSPSSTGSGNTEHSCSSQKQISIQHRQTQSDLTIEKISALENSKNSDLEKKEGRIDDLLRANCDLRRQIDEQQKMLEKYKERLNRCVTMSKKLLIEKSKQEKMACRDKSMQDRLRLGHFTTVRHGASFTEQWTDGYAFQNLIKQQERINSQREEIERQRKMLAKRKPPAMGQAPPATNEQKQRKSKTNGAENETLTLAEYHEQEEIFKLRLGHLKKEEAEIQAELERLERVRNLHIRELKRIHNEDNSQFKDHPTLNDRYLLLHLLGRGGFSEVYKAFDLTEQRYVAVKIHQLNKNWRDEKKENYHKHACREYRIHKELDHPRIVKLYDYFSLDTDSFCTVLEYCEGNDLDFYLKQHKLMSEKEARSIIMQIVNALKYLNEIKPPIIHYDLKPGNILLVNGTACGEIKITDFGLSKIMDDDSYNSVDGMELTSQGAGTYWYLPPECFVVGKEPPKISNKVDVWSVGVIFYQCLYGRKPFGHNQSQQDILQENTILKATEVQFPPKPVVTPEAKAFIRRCLAYRKEDRIDVQQLACDPYLLPHIRKSVSTSSPAGAAIASTSGASNNSSSN

SEQ ID NO: 6115 - protein, 750 aa, Homo sapiens
MMEELHSLDPRRQELLEARFTGVGVSKGPLNSESSNQSLCSVGSLSDKEVETPEKKQNDQRNRKRKAEPYETSQGKGTPRGHKISDYFEFAGGSAPGTSPGRSVPPVARSSPQHSLSNPLPRRVEQPLYGLDGSAAKEATEEQSALPTLMSVMLAKPRLDTEQLAQRGAGLCFTFVSAQQNSPSSTGSGNTEHSCSSQKQISIQHRQTQSDLTIEKISALENSKNSDLEKKEGRIDDLLRANCDLRRQIDEQQKMLEKYKERLNRCVTMSKKLLIEKSKQEKMACRDKSMQDRLRLGHFTTVRHGASFTEQWTDGYAFQNLIKQQERINSQREEIERQRKMLAKRKPPAMGQAPPATNEQKQRKSKTNGAENETLTLAEYHEQEEIFKLRLGHLKKEEAEIQAELERLERVRNLHIRELKRIHNEDNSQFKDHPTLNDRYLLLHLLGRGGFSEVYKAFDLTEQRYVAVKIHQLNKNWRDEKKENYHKHACREYRIHKELDHPRIVKLYDYFSLDTDSFCTVLEYCEGNDLDFYLKQHKLMSEKEARSIIMQIVNALKYLNEIKPPIIHYDLKPGNILLVNGTACGEIKITDFGLSKIMDDDSYNSVDGMELTSQGAGTYWYLPPECFVVGKEPPKISNKVDVWSVGVIFYQCLYGRKPFGHNQSQQDILQENTILKATEVQFPPKPVVTPEAKAFIRRCLAYRKEDRIDVQQLACDPYLLPHIRKSVSTSSPAGAAIASTSGASNNSSSN

SEQ ID NO: 6116 - protein, 718 aa, Homo sapiens; identical to SEQ ID NO: 6114

SEQ ID NO: 6117 - protein, 506 aa, Homo sapiens
MDVRLYPSAPAVGARPGAEPAGLAHLDYYHGGKFDGDSAYVGMSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 6118 - protein, 488 aa, Homo sapiens
MQQTRTEAVAGAFSRCLGFCGMRLGLLLLARHWCIAGVFPQKFDGDSAYVGMSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 6119 - protein, 196 aa, Homo sapiens
RRRRKRRTPMSRRSLCRPTHSSSETLRPPSRVRTPVPLSVTCPKSWPPCGTAWERNRSRTSRTSLSSPAARDPAHLAHPTPPAAGTGTAATPVGSVASAPAACSPGTNRSTSPNPASLPSLRLAGRHCSEPEGLTAEKRPWPEAGWPIGESSDTPIARGLSLFLNLPPDSAEAAHCPPPAQRTCRNLPPADLLAPG

SEQ ID NO: 6120 - protein, 464 aa, Homo sapiens
MSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 6121 - protein, 196 aa, Homo sapiens; identical to SEQ ID NO: 6119

SEQ ID NO: 6122 - protein, 464 aa, Homo sapiens; identical to SEQ ID NO: 6120

SEQ ID NO: 6123 - protein, 384 aa, Homo sapiens
MEQEREGFSEEVTFQIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 6124 - protein, 178 aa, Homo sapiens
MSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISG

SEQ ID NO: 6125 - protein, 121 aa, Homo sapiens
MAAARATTPADGEEPAPEAEALAAARERSSRFLSGLELVKQGAEARVFRGRFQGRAAVIKHRFPKGYRHPALEARLGRRRTVQEARALLRCRRAGKEYLPQLSFLWTMLPTAYIWKKLKAQ

SEQ ID NO: 6126 - protein, 253 aa, Homo sapiens
MAAARATTPADGEEPAPEAEALAAARERSSRFLSGLELVKQGAEARVFRGRFQGRAAVIKHRFPKGYRHPALEARLGRRRTVQEARALLRCRRAGISAPVVFFVDYASNCLYMEEIEGSVTVRDYIQSTMETEKTPQGLSNLAKTIGQVLARMHDEDLIHGDLTTSNMLLKPPLEQLNIVLIDFGLSFISALPEDKGVDLYVLEKAFLSTHPNTETVFEAFLKSYSTSSKKARPVLKKLDEVRLRGRKRSMVG

SEQ ID NO: 6127 - protein, 381 aa, Homo sapiens
MISAHRKLCLPGSSNSPASAFRVAGTTAVKMSDKNQIAARASLIEQLMSKRNFEDLGNHLTELETIYVTKEHLQETDVVRAVYRVLKNCPSVALKKKAKCLLSKWKAVYKQTHSKARNSPKLFPVRGNKEENSGPSHDPSQNETLGICSSNSLSSQDVAKLSEMIVPENRAIQLKPKEEHFGDGDPESTGKRSSELLDPTTPMRTKCIELLYAALTSSSTDQPKADLWQNFAREIEEHVFTLYSKNIKKYKTCIRSKVANLKNPRNSHLQQNLLSGTTSPREFAEMTVMEMANKELKQLRASYTESCIQEHYLPQVIDGTQTNKIKCRRCEKYNCKVTVIDRGTLFLPSWVRNSNPDEQMMTYVICNECGEQWYHSKWVCW

SEQ ID NO: 6128 - protein, 351 aa, Homo sapiens
MSDKNQIAARASLIEQLMSKRNFEDLGNHLTELETIYVTKEHLQETDVVRAVYRVLKNCPSVALKKKAKCLLSKWKAVYKQTHSKARNSPKLFPVRGNKEENSGPSHDPSQNETLGICSSNSLSSQDVAKLSEMIVPENRAIQLKPKEEHFGDGDPESTGKRSSELLDPTTPMRTKCIELLYAALTSSSTDQPKADLWQNFAREIEEHVFTLYSKNIKKYKTCIRSKVANLKNPRNSHLQQNLLSGTTSPREFAEMTVMEMANKELKQLRASYTESCIQEHYLPQVIDGTQTNKIKCRRCEKYNCKVTVIDRGTLFLPSWVRNSNPDEQMMTYVICNECGEQWYHSKWVCW

SEQ ID NO: 6129 - protein, 351 aa, Homo sapiens; identical to SEQ ID NO: 6128

SEQ ID NO: 6130 - protein, 351 aa, Homo sapiens; identical to SEQ ID NO: 6128

SEQ ID NO: 6131 - protein, 208 aa, Homo sapiens
MDKFVIRTPRIQNSPQKKDSGGKVYKQATIESLKRVVVVEDIKRWKTMLELPDQTKENLVEALQELKKKIPSREVLKSTRIGHTVNKMRKHSDSEVASLAREVYTEWKTFTEKHSNRPSIEVRSDPKTESLRKNAQKLLSEALELKMDHLLVENIERETFHLCSRLINGPYRRTVRALVFTLKHRAEIRAQVKSGSLPVGTFVQTHKK

SEQ ID NO: 6132 - protein, 238 aa, Homo sapiens
MAVFSGVLESALFLDQNTLQARQGSRSPLTMDKFVIRTPRIQNSPQKKDSGGKVYKQATIESLKRVVVVEDIKRWKTMLELPDQTKENLVEALQELKKKIPSREVLKSTRIGHTVNKMRKHSDSEVASLAREVYTEWKTFTEKHSNRPSIEVRSDPKTESLRKNAQKLLSEALELKMDHLLVENIERETFHLCSRLINGPYRRTVRALVFTLKHRAEIRAQVKSGSLPVGTFVQTHKK

SEQ ID NO: 6133 - protein, 246 aa, Homo sapiens
MDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQ

SEQ ID NO: 6134 - protein, 299 aa, Homo sapiens
MMGKEEEIARIARRLDKMVTKKSAEGAMDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWKFC

SEQ ID NO: 6135 - protein, 272 aa, Homo sapiens
MDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWKFC

SEQ ID NO: 6136 - protein, 242 aa, Homo sapiens
MMGKEEEIARIARRLDKMVTKKSAEGAMDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEEYILWVGAVGLGFWWSQEAAWPGALWWLLDATAQLSRGHLPGWSPAWVVRLSHLRRAPGPAEGLILSACGA

SEQ ID NO: 6137 - protein, 82 aa, Homo sapiens
MDLLRELKAMPITLHLLQSTRVGMSVNALRKQSSDEEVIALAKSLIKSWKKLLDASDAKARERGRGMPLPTSSRDASEAPDP

SEQ ID NO: 6138 - protein, 246 aa, Homo sapiens; identical to SEQ ID NO: 6133

SEQ ID NO: 6139 - protein, 270 aa, Homo sapiens
MDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWK

SEQ ID NO: 6140 - protein, 154 aa, Homo sapiens
MGQEEELLRIAKKLEKMVARKNTEGALDLLKKLHSCQMSIQLLQTTRIGVAVNGVRKHCSDKEVVSLAKVLIKNWKRLLDSPGPPKGEKGEEREKAKKKEKGLECSDWKPEAGLSPPRKKREDPKTRRDSVDSKSSASSSPKRPSVERACSLMQ

SEQ ID NO: 6141 - protein, 348 aa, Homo sapiens
MGQEEELLRIAKKLEKMVARKNTEGALDLLKKLHSCQMSIQLLQTTRIGVAVNGVRKHCSDKEVVSLAKVLIKNWKRLLDSPGPPKGEKGEEREKAKKKEKGLECSDWKPEAGLSPPRKKREDPKTRRDSVDSKSSASSSPKRPSVERSNSSKSKAESPKTPSSPLTPTFASSMCLLAPCYLTGDSVRDKCVEMLSAALKADDDYKDYGVNCDKMASEIEDHIYQELKSTDMKYRNRVRSRISNLKDPRNPGLRRNVLSGAISAGLIAKMTAEEMASDELRELRNAMTQEAIREHQMAKTGGTTTDLFQCSKCKKKNCTYNQVQTRSADEPMTTFVLCNECGNRWKFC

SEQ ID NO: 6142 - protein, 227 aa, Homo sapiens
MEKLFNENEGMPSNQGKIDNEEQPPHEGKPEVACILEDKKLENEGNTENTGKRVEEPLKDKEKPESAGKAKGEGKSERKGKSEMQGGSKTEGKPERGGRAEGEGEPDSEREPESEGEPESETRAAGKRPAEDDIPRKAKRKTNKGLAQYLKQYKEAIHDMNFSNEDMIREFDNMARVEDKRRKSKQKLGAFLWMQRNLQDPFYPRGPREFRGGCRAPRRDTEDIPYV

SEQ ID NO: 6143 - protein, 227 aa, Homo sapiens; identical to SEQ ID NO: 6142

SEQ ID NO: 6144 - protein, 200 aa, Homo sapiens
MEKPYNKNEGNLENEGKPEDEVEPDDEGKSDEEEKPDVEGKTECEGKREDEGEPGDEGQLEDEGSQEKQGRSEGEGKPQGEGKPASQAKPESQPRAAEKRPAEDYVPRKAKRKTDRGTDDSPKDSQEDLQERHLSSEEMMRECGDVSRAQEELRKKQKMGGFHWMQRDVQDPFAPRGQRGVRGVRGGGRGQRGLHDIPYL

SEQ ID NO: 6145 - protein, 200 aa, Homo sapiens; identical to SEQ ID NO: 6144

SEQ ID NO: 6146 - protein, 200 aa, Homo sapiens; identical to SEQ ID NO: 6144

SEQ ID NO: 6147 - protein, 358 aa, Homo sapiens
MPAGGQAPQLTPVIPAFWEARGLPNSKGRDKVHICQCEEWKGHISYVERDITTSEIKSLPQVSVRAFHAASGTLEWRKGNGYGRGKGWGWGRVESREAGPSVDRDGGLRVCCSQRSAKPEKEEQPVQNPRRSVKDRKRRGNLDMEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 6148 - protein, 186 aa, Homo sapiens
MEKLYSENEGMASNQGKMENEEQPQDERKPEVTCTLEDKKLENEGKTENKGKTGDEEMLKDKGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 6149 - protein, 215 aa, Homo sapiens
MEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 6150 - protein, 58 aa, Homo sapiens
MEKLYSENEGMASNQGKMENEEQPQDERKPEVTCTLEDKKLENEGKTENKGKTGDEEM

SEQ ID NO: 6151 - protein, 50 aa, Homo sapiens
MEKLYSENEGMASNQGKMENEEQPQDERKPEVTCTLEDKKLENEGKTENK

SEQ ID NO: 6152 - protein, 91 aa, Homo sapiens
MEKLYSENEGMASNQGKMENEEQPQDERKPEVTCTLEDKKLENEGKTENKGKTGDEEMLKDKGKPESEGEAKEGKSEREGESEMEGGSERE

SEQ ID NO: 6153 - protein, 215 aa, Homo sapiens; identical to SEQ ID NO: 6149

SEQ ID NO: 6154 - protein, 129 aa, Homo sapiens
MEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRK

SEQ ID NO: 6155 - protein, 215 aa, Homo sapiens; identical to SEQ ID NO: 6149

SEQ ID NO: 6156 - protein, 215 aa, Homo sapiens; identical to SEQ ID NO: 6149

SEQ ID NO: 6157 - protein, 76 aa, Homo sapiens
MEKLYSENEGMASNQGKMENEEQPQDERKPEVTCTLEDKKLENEGKTENKGKTGDEEMLKDKGKPESEGEAKEGKS

SEQ ID NO: 6158 - protein, 215 aa, Homo sapiens; identical to SEQ ID NO: 6149

SEQ ID NO: 6159 - protein, 206 aa, Homo sapiens
MEKLYKENEGKPENERNLESEGKPEDEGSTEDEGKSDEEEKPDMEGKTECEGKREDEGEPGDEGQLEDEGNQEKQGKSEGEDKPQSEGKPASQAKPESQPRAAEKRPAEDYVPRKAKRKTDRGTDDSPKDSQEDLQERHLSSEEMMRECGDVSRAQEELRKKQKMGGFHWMQRDVQDPFAPRGQRGVRGVRGGGRGQKDLEDVPYV

SEQ ID NO: 6160 - protein, 183 aa, Homo sapiens
MEKPYNKNEGNLENEGKPEDEVEPDDEGKSDEEEKPDAEGKTECEGKRKAEGEPGDEGQLEDKGSQEKQGKSEGEGKPQGEGKPASQAKPEGQPRAAEKRPAGDYVPRKAKRKTDRGTDDSPKDSQEDLQERHLSSEEMMRECGDVSRAQEELRKKQKMGGFHWMQRDVQDPFAQGDNGVSGE

SEQ ID NO: 6161 - protein, 183 aa, Homo sapiens; identical to SEQ ID NO: 6160

SEQ ID NO: 6162 - protein, 199 aa, Homo sapiens
MEKPYNKNEGNLENEGKPEDEVEPDDEGKSDEEEKPDAEGKTECEGKRKAEGEPGDEGQLEDKGSQEKQGKSEGEGKPQGEGKPASQAKPEGQPRAAEKRPAGDYVPRKAKRKTDRGTDDSPKDSQEDLQERHLSSEEMMRECGDVSRAQEELRKKQKMGGFHWMQRDVQDPFPRGQRGVRGVRGGGRGQRGLHDIPYL

SEQ ID NO: 6163 - protein, 117 aa, Homo sapiens
MQKSCEENEGKPQNMPKAEEDRPLEDVPQEAEGNPQPSEEGVSQEAEGNPRGGPNQPGQGFKEDTPVRHLDPEEMIRGVDELERLREEIRRVRNKFVMMHWKQRHSRSRPYPVCFRP

SEQ ID NO: 6164 - protein, 117 aa, Homo sapiens; identical to SEQ ID NO: 6163

SEQ ID NO: 6165 - protein, 74 aa, Homo sapiens
MQKSCEENEGKPQNMPKAEEDRPLEDVPQEDTPVRHLDPEEMIRGVDELERLREEIRRVRNKFVMMHWKQRHSR

SEQ ID NO: 6166 - protein, 384 aa, Homo sapiens
MPQLDSGGGGAGGGDDLGAPDELLAFQDEGEEQDDKSRDSAAGPERDLAELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTETNWPRELKDGNGQESLSMSSSSSPA

SEQ ID NO: 6167 - protein, 365 aa, Homo sapiens
MPQLDSGGGGAGGGDDLGAPDELLAFQDEGEEQDDKSRDSAAGPERDLAELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDNSLHYS

SEQ ID NO: 6168 - protein, 384 aa, Homo sapiens
MPQLDSGGGGAGGGDDLGAPDELLAFQDEGEEQDDKSRDSAAGPERDLAELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTGGKRNAFGTYPEKAAAPAPFLPMTVL

SEQ ID NO: 6169 - protein, 494 aa, Homo sapiens
MPQLDSGGGGAGGGDDLGAPDELLAFQDEGEEQDDKSRDSAAGPERDLAELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDPGSPKKCRARFGLNQQTDWCGPCRRKKKCIRYLPGEGRCPSPVPSDDSALGCPGSPAPQDSPSYHLLPRFPTELLTSPARHLHPQVSPLLSASQPQGPHRPPAAPCRAHRYSNRNLRDRWPSRHRTPGRLQEPTP

SEQ ID NO: 6170 - protein, 268 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDPGSPKKCRARFGLNQQTDWCGPCR

SEQ ID NO: 6171 - protein, 369 aa, Homo sapiens
MPQLDSGGGGAGGGDDLGAPDELLAFQDEGEEQDDKSRDSAAGPERDLAELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDGIPACTILSP

SEQ ID NO: 6172 - protein, 269 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTGGKRNAFGTYPEKAAAPAPFLPMTVL

SEQ ID NO: 6173 - protein, 481 aa, Homo sapiens
MPQLDSGGGGAGGGDDLGAPDELLAFQDEGEEQDDKSRDSAAGPERDLAELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDPGSPKKCRARFGLNQQTDWCGPCRRKKKCIRYLPGEGRCPSPVPSDDSALGCPGSPAPQDSPSYHLLPRFPTELLTSPAEPAPTSPGLSTALSLPTPGPPQAPRSTLQSTQVQQQESQRQVA

SEQ ID NO: 6174 - protein, 366 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDPGSPKKCRARFGLNQQTDWCGPCRRKKKCIRYLPGEGRCPSPVPSDDSALGCPGSPAPQDSPSYHLLPRFPTELLTSPAEPAPTSPGLSTALSLPTPGPPQAPRSTLQSTQVQQQESQRQVA

SEQ ID NO: 6175 - protein, 123 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVP

SEQ ID NO: 6176 - protein, 269 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTETNWPRELKDGNGQESLSMSSSSSPA

SEQ ID NO: 6177 - protein, 147 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEK

SEQ ID NO: 6178 - protein, 588 aa, Homo sapiens
MPQLGGGGGGGGGGSGGGGGSSAGAAGGGDDLGANDELIPFQDEGGEEQEPSSDSASAQRDLDEVKSSLVNESENQSSSSDSEAERRPQPVRDTFQKPRDYFAEVRRPQDSAFFKGPPYPGYPFLMIPDLSSPYLSNGPLSPGGARTYLQMKWPLLDVPSSATVKDTRSPSPAHLSNKVPVVQHPHHMHPLTPLITYSNDHFSPGSPPTHLSPEIDPKTGIPRPPHPSELSPYYPLSPGAVGQIPHPLGWLVPQQGQPMYSLPPGGFRHPYPALAMNASMSSLVSSRFSPHMVAPAHPGLPTSGIPHPAIVSPIVKQEPAPPSLSPAVSVKSPVTVKKEEEKKPHVKKPLNAFMLYMKEMRAKVVAECTLKESAAINQILGRKWHNLSREEQAKYYELARKERQLHSQLYPTWSARDNYGKKKKRKREKQLSQTQSQQQVQEAEGALASKSKKPCVQYLPPEKPCDSPASSHGSMLDSPATPSAALASPAAPAATHSEQAQPLSLTTKPETRAQLALHSAAFLSAKAAASSSGQMGSQPPLLSRPLPLGSMPTALLASPPSFPATLHAHQALPVLQAQPLSLVTKSAH

SEQ ID NO: 6179 - protein, 338 aa, Homo sapiens
MEYFMVPTQKVPSLQHFRKTEKEVIGGLCSLANIPLTPETQRDQERRIRREIANSNERRRMQSINAGFQSLKTLIPHTDGEKLSKAAILQQTAEYIFSLEQEKTRLLQQNTQLKRFIQELSGSSPKRRRAEDKDEGIGSPDIWEDEKAEDLRREMIELRQQLDKERSVRMMLEEQVRSLEAHMYPEKLKVIAQQVQLQQQQEQVRLLHQEKLEREQQQLRTQLLPPPAPTHHPTVIVPAPPPPPSHHINVVTMGPSSVINSVSTSRQNLDTIVQAIQHIEGTQEKQELEEEQRRAVIVKPVRSCPEAPTSDTASDSEASDSDAMDQSREEPSGDGELP

SEQ ID NO: 6180 - protein, 476 aa, Homo sapiens
MASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 6181 - protein, 562 aa, Homo sapiens
MSEEDRTFSFGPGTRKLGFMSQLSPACSVTLGKSLPLSGLGVFSSKMDAVPVILASPCQPLCFEEDTCLIYLLPLLIHREPAPAATMASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 6182 - protein, 490 aa, Homo sapiens
MTASSGWEPAPAATMASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 6183 - protein, 476 aa, Homo sapiens; identical to SEQ ID NO: 6180

SEQ ID NO: 6184 - protein, 268 aa, Homo sapiens
MASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDL

SEQ ID NO: 6185 - protein, 476 aa, Homo sapiens; identical to SEQ ID NO: 6180

SEQ ID NO: 6186 - protein, 244 aa, Homo sapiens
MASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIE

SEQ ID NO: 6187 - protein, 268 aa, Homo sapiens; identical to SEQ ID NO: 6184

SEQ ID NO: 6188 - protein, 223 aa, Homo sapiens
MASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELT

SEQ ID NO: 6189 - protein, 71 aa, Homo sapiens
MASRIGLRMQLMREQAQQEEQRERMQQQAVMHYMQQQQQQQQQQLGGPPTPAINTPVHFQSPPPVPGEVLK

SEQ ID NO: 6190 - protein, 391 aa, Homo sapiens
MASRIGLRMQLMREQAQQEEQRERMQQQAVMHYMQQQQQQQQQQLGGPPTPAINTPVHFQSPPPVPGEVLKLDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 6191 - protein, 79 aa, Homo sapiens
MASRIGLRMQLMREQAQQEEQRERMQQQAVMHYMQQQQQQQQQQLGGPPTPAINTPVHFQSPPPVPGEVLKVQSYLENP

SEQ ID NO: 6192 - protein, 32 aa, Homo sapiens
MASRIGLRMQLMREQAQQEEQRERMQQQAVMH

SEQ ID NO: 6193 - protein, 12 aa, Homo sapiens
MASRIGLRMQLM

SEQ ID NO: 6194 - protein, 71 aa, Homo sapiens; identical to SEQ ID NO: 6189

SEQ ID NO: 6195 - protein, 12 aa, Homo sapiens
MASRIGLRMQLM

SEQ ID NO: 6196 - protein, 347 aa, Homo sapiens
MTLDHQIINPTLKWSQPAVPSGGPLVQHAHTTLDSDAGLTENPLTKLLAIGKEDDNAQWHMEDVIEDIIGMESSFKEEGADSPLLMQRTLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQELEIQARTHGLPTLASLGTVDLGAHVTKQQSHPEQNSVDYCQQLTVSQGPSPELCDQAIAFSDPLSYFTDLSFSAALKEEQRLDGMLLDDTISPFGTDPLLSATSPAVSKESSRRSSFSSDDGDEL

SEQ ID NO: 6197 - protein, 318 aa, Homo sapiens
MTLDHQIINPTLKWSQPAVPSGGPLVQHAHTTLDSDAGLTENPLTKLLAIGKEDDNAQWHLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQELEIQARTHGLPTLASLGTVDLGAHVTKQQSHPEQNSVDYCQQLTVSQGPSPELCDQAIAFSDPLSYFTDLSFSAALKEEQRLDGMLLDDTISPFGTDPLLSATSPAVSKESSRRSSFSSDDGDEL

SEQ ID NO: 6198 - protein, 197 aa, Homo sapiens
MTLDHQIINPTLKWSQPAVPSGGPLVQHAHTTLDSDAGLTENPLTKLLAIGKEDDNAQWHLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQVFIRM

SEQ ID NO: 6199 - protein, 280 aa, Homo sapiens
MMKEKEKTIAIVKVIDTSKLKLLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQELEIQARTHGLPTLASLGTVDLGAHVTKQQSHPEQNSVDYCQQLTVSQGPSPELCDQAIAFSDPLSYFTDLSFSAALKEEQRLDGMLLDDTISPFGTDPLLSATSPAVSKESSRRSSFSSDDGDEL

SEQ ID NO: 6200 - protein, 316 aa, Homo sapiens
MLQALTGLQFQLKEQLGEKERRLQISQEISAHRTEFHMQFSYKPVLHRLVPARPQIYSSQLPSFTRVPAHLESSARPQLQKAQRQKVNSFMTLDHQIINPTLKWSQPAVPSGGPLVQHAHTTLDSDAGLTENPLTKLLAIGKEDDNAQWHMEDVIEDIIGMESSFKEEGADSPLLMQRTLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQVFIRM

SEQ ID NO: 6201 - protein, 483 aa, Homo sapiens
MTEVEYTQLQHILCSHMEAAADGELETRLNSALLAAAGPGAGAGGFAAGGQGGAAPVYPVLCPSALAADAPCLGHIDFQELRMMLLSEAGAAEKTSGGGDGARARADGAAKEGAGAAAAAAGPDGAPEARAKPAVRVRLEDRFNSIPAEPPPAPRGPEPPEPGGALNNLVTLIRHPSELMNVPLQQQNKCTALVKNKTAATTTALQFTYPLFTTNACSTSGNSNLSQTQSSSNSCSVLEAAKHQDIGLPRAFSFCYQQEIESTKQTLGSRNKVLPEQVWIKVGEAALCKQALKRNRSRMRQLDTNVERRALGEIQNVGEGATATQGAWQSSESSQANLGEQAQSGPQGGRSQRRERHNRMERDRRRRIRICCDELNLLVPFCNAETDKATTLQWTTAFLKYIQERHGDSLKKVLSTNSRYVMLWTCFLKMKSAVDGKNPQHAYRTANHKWLCLHEARSFAFEVSIWAHFQLFRVRIPEGFLSI

SEQ ID NO: 6202 - protein, 500 aa, Homo sapiens
MSGPGPREPPPEAGAAGGEAAVEGAGGGDAALGEPGLSFTTTDLSLVEMTEVEYTQLQHILCSHMEAAADGELETRLNSALLAAAGPGAGAGGFAAGGQGGAAPVYPVLCPSALAADAPCLGHIDFQELRMMLLSEAGAAEKTSGGGDGARARADGAAKEGAGAAAAAAGPDGAPEARAKPAVRVRLEDRFNSIPAEPPPAPRGPEPPEPGGALNNLVTLIRHPSELMNVPLQQQNKCTALVKNKTAATTTALQFTYPLFTTNACSTSGNSNLSQTQSSSNSCSVLEAAKHQDIGLPRAFSFCYQQEIESTKQTLGSRNKVLPEQVWIKVGEAALCKQALKRNRSRMRQLDTNVERRALGEIQNVGEGATATQGAWQSSESSQANLGEQAQSGPQGGRSQRRERHNRMERDRRRRIRICCDELNLLVPFCNAETDKATTLQWTTAFLKYIQERHGDSLKKEFESVFCGKTGRRLKLTRPDSLVTCPAQGSLQSSPSMEIK

SEQ ID NO: 6203 - protein, 335 aa, Homo sapiens
MATFVSELEAAKKNLSEALGDNVKQYWANLKLWFKQKISKEEFDLEAHRLLTQDNVHSHNDFLLAILTRCQILVSTPDGAGSLPWPGGSAAKPGKPKGKKKLSSVRQKFDHRFQPQNPLSGAQQFVAKDPQDDDDLKLCSHTMMLPTRGQLEGRMIVTAYEHGLDNVTEEAVSAVVYAVENHLKDILTSVVSRRKAYRLRDGHFKYAFGSNVTPQPYLKNSVVAYNNLIESPPAFTAPCAGQNPASHPPPDDAEQQAALLLACSGDTLPASLPPVNMYDLFEALQVHREVIPTHTVYALNIERIITKLWHPNHEELQQDKVHRQRLAAKEGLLLC

SEQ ID NO: 6204 - protein, 443 aa, Homo sapiens
MDRLGPFSNDPSDKPPCRGCSSYLMEPYIKCAECGPPPFFLCLQCFTRGFEYKKHQSDHTYEIMTSDFPVLDPSWTAQEEMALLEAVMDCGFGNWQDVANQMCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKIIRDHGLINLRKFQLMERRYPKEVQDLYETMRRFARIVGPVEHDKFIESHALEFELRREIKRLQEYRTAGITNFCSARTYDHLKKTREEERLKRTMLSEVLQYIQDSSACQQWLRRQADIDSGLSPSIPMASNSGRRSAPPLNLTGLPGTEKLNEKEKELCQMVRLVPGAYLEYKSALLNECNKQGGLRLAQARALIKIDVNKTRKIYDFLIREGYITKG

SEQ ID NO: 6205 - protein, 443 aa, Homo sapiens; identical to SEQ ID NO: 6204

SEQ ID NO: 6206 - protein, 305 aa, Homo sapiens
MDRLGPFSNDPSDKPPCRGCSSYLMEPYIKCAECGPPPFFLCLQCFTRGFEYKKHQSDHTYEIMTSDFPVLDPSWTAQEEMALLEAVMDCGFGNWQDVANQMCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKIIRDHGLINLRKFQLMERRYPKEVQDLYETMRRFARIVGPVEHDKFIESHACRWFLSLEQYLCVYIYINRRDNGVFYVKFYK

SEQ ID NO: 6207 - protein, 342 aa, Homo sapiens
MCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKIIRDHGLINLRKFQLMERRYPKEVQDLYETMRRFARIVGPVEHDKFIESHALEFELRREIKRLQEYRTAGITNFCSARTYDHLKKTREEERLKRTMLSEVLQYIQDSSACQQWLRRQADIDSGLSPSIPMASNSGRRSAPPLNLTGLPGTEKLNEKEKELCQMVRLVPGAYLEYKSALLNECNKQGGLRLAQARALIKIDVNKTRKIYDFLIREGYITKG

SEQ ID NO: 6208 - protein, 443 aa, Homo sapiens; identical to SEQ ID NO: 6204

SEQ ID NO: 6209 - protein, 1129 aa, Homo sapiens
MGDQQLYKTNHVAHGSENLFYQQPPLGVHSGLNHNYGNAVTGGGMDAPQASPISPHFPQDTRDGLGLPVGSKNLGQMDTSRQGGWGSHAGPGNHVQLRGNLANSNMMWGAPAQAEPTDGYQYTYSQASEIRTQKLTSGVLHKLDSFTQVFANQNLRIQVNNMAQVLHTQSAVMDGAPDSALRQLLSQKPMEPPAPAIPSRYQQVPQQPHPGFTGGLSKPALQVGQHPTQGHLYYDYQQPLAQVPVQGGQPLQAPQMLSQHMQQMQQHQYYPPQQQQQAGQQRISMQEIQTQPQQIRPSQPQPPPQQQQPQQLQLQQRQGSMQIPQYYQPQPMMQHLQEQQQQQMHLQPPSYHRDPHQYTPEQAHTVQLIPLGSMSQYYYQEPQQPYSHPLYQQSHLSQHQQREDSQLKTYSSDRQAQAMLSSHGDLGPPDTGMGDPASSDLTRVSSTLPHRPLLSPSGIHLNNMGPQHQQLSPSAMWPQMHLPDGRAQPGSPESSGQPKGAFGEQFDAKNKLTCSICLKEFKNLPALNGHMRSHGGMRASPNLKQEIPRKHQPSVPKAEEPLKTVQEKKKFRHRPEPLFIPPPPSYNPNPAASYSGATLYQSQLRSPRVLGDHLLLDPTHELPPYTPPPMLSPVRQGSGLFSNVLISGHGPGAHPQLPLTPLTPTPRVLLCRSNSIDGSNVTVTPGPGEQTVDVEPRINIGLRFQAEIPELQDISALAQDTHKATLVWKPWPELENHDLQQRVENLLNLCCSSALPGGGTNSEFALHSLFEAKGDVMVALEMLLLRKPVRLKCHPLANYHYAGSDKWTSLERKLFNKALATYSKDFIFVQKMVKSKTVAQCVEYYYTWKKIMRLGRKHRTRLAEIIDDCVTSEEEEELEEEEEEDPEEDRKSTKEEESEVPKSPEPPPVPVLAPTEGPPLQALGQPSGSFICEMPNCGADCRCHVTPFLPQVFSSRQALNGHARIHGGTNQVTKARGAIPSGKQKPGGTQSGYCSVKSSPSHSTTSGETDPTTIFPCKECGKVFFKIKSRNAHMKTHRQQEEQQRQKAQKAAFAAEMAATIERTTGPVGAPGLLPLDQLSLIKPIKDVDILDDDVVQQLGGVMEEAEVVDTDLLLDDQDSVLLQGDAEL

SEQ ID NO: 6210 - protein, 1200 aa, Homo sapiens
MGDQQLYKTNHVAHGSENLFYQQPPLGVHSGLNHNYGNAVTGGGMDAPQASPISPHFPQDTRDGLGLPVGSKNLGQMDTSRQGGWGSHAGPGNHVQLRGNLANSNMMWGAPAQAEPTDGYQYTYSQASEIRTQKLTSGVLHKLDSFTQVFANQNLRIQVNNMAQVLHTQSAVMDGAPDSALRQLLSQKPMEPPAPAIPSRYQQVPQQPHPGFTGGLSKPALQVGQHPTQGHLYYDYQQPLAQVPVQGGQPLQAPQMLSQHMQQMQQHQYYPPQQQQQAGQQRISMQEIQTQPQQIRPSQPQPPPQQQQPQQLQLQQRQGSMQIPQYYQPQPMMQHLQEQQQQQMHLQPPSYHRDPHQYTPEQAHTVQLIPLGSMSQYYYQEPQQPYSHPLYQQSHLSQHQQREDSQLKTYSSDRQAQAMLSSHGDLGPPDTGMGDPASSDLTRVSSTLPHRPLLSPSGIHLNNMGPQHQQLSPSAMWPQMHLPDGRAQPGSPESSGQPKGAFGEQFDAKNKLTCSICLKEFKNLPALNGHMRSHGGMRASPNLKQEEGEKVLPPQPQPPLPPPPPPPPPPQLPPEAESLTPMVMPVSVPVKLLPPKPSSQGFTNSTVAAPSARDKPASSMSDDEMPVLEIPRKHQPSVPKAEEPLKTVQEKKKFRHRPEPLFIPPPPSYNPNPAASYSGATLYQSQLRSPRVLGDHLLLDPTHELPPYTPPPMLSPVRQGSGLFSNVLISGHGPGAHPQLPLTPLTPTPRVLLCRSNSIDGSNVTVTPGPGEQTVDVEPRINIGLRFQAEIPELQDISALAQDTHKATLVWKPWPELENHDLQQRVENLLNLCCSSALPGGGTNSEFALHSLFEAKGDVMVALEMLLLRKPVRLKCHPLANYHYAGSDKWTSLERKLFNKALATYSKDFIFVQKMVKSKTVAQCVEYYYTWKKIMRLGRKHRTRLAEIIDDCVTSEEEEELEEEEEEDPEEDRKSTKEEESEVPKSPEPPPVPVLAPTEGPPLQALGQPSGSFICEMPNCGAVFSSRQALNGHARIHGGTNQVTKARGAIPSGKQKPGGTQSGYCSVKSSPSHSTTSGETDPTTIFPCKECGKVFFKIKSRNAHMKTHRQQEEQQRQKAQKAAFAAEMAATIERTTGPVGAPGLLPLDQLSLIKPIKDVDILDDDVVQQLGGVMEEAEVVDTDLLLDDQDSVLLQGDAEL

SEQ ID NO: 6211 - protein, 1220 aa, Homo sapiens
MGDQQLYKTNHVAHGSENLFYQQPPLGVHSGLNHNYGNAVTGGGMDAPQASPISPHFPQDTRDGLGLPVGSKNLGQMDTSRQGGWGSHAGPGNHVQLRGNLANSNMMWGAPAQAEPTDGYQYTYSQASEIRTQKLTSGVLHKLDSFTQVFANQNLRIQVNNMAQVLHTQSAVMDGAPDSALRQLLSQKPMEPPAPAIPSRYQQVPQQPHPGFTGGLSKPALQVGQHPTQGHLYYDYQQPLAQVPVQGGQPLQAPQMLSQHMQQMQQHQYYPPQQQQQAGQQRISMQEIQTQPQQIRPSQPQPPPQQQQPQQLQLQQRQGSMQIPQYYQPQPMMQHLQEQQQQQMHLQPPSYHRDPHQYTPEQAHTVQLIPLGSMSQYYYQEPQQPYSHPLYQQSHLSQHQQREDSQLKTYSSDRQAQAMLSSHGDLGPPDTGMGDPASSDLTRVSSTLPHRPLLSPSGIHLNNMGPQHQQLSPSAMWPQMHLPDGRAQPGSPESSGQPKGAFGEQFDAKNKLTCSICLKEFKNLPALNGHMRSHGGMRASPNLKQEEGEKVLPPQPQPPLPPPPPPPPPPQLPPEAESLTPMVMPVSVPVKLLPPKPSSQGFTNSTVAAPSARDKPASSMSDDEMPVLVRMTLSPPHSPQGAAPRTPAEIPRKHQPSVPKAEEPLKTVQEKKKFRHRPEPLFIPPPPSYNPNPAASYSGATLYQSQLRSPRVLGDHLLLDPTHELPPYTPPPMLSPVRQGSGLFSNVLISGHGPGAHPQLPLTPLTPTPRVLLCRSNSIDGSNVTVTPGPGEQTVDVEPRINIGLRFQAEIPELQDISALAQDTHKATLVWKPWPELENHDLQQRVENLLNLCCSSALPGGGTNSEFALHSLFEAKGDVMVALEMLLLRKPVRLKCHPLANYHYAGSDKWTSLERKLFNKALATYSKDFIFVQKMVKSKTVAQCVEYYYTWKKIMRLGRKHRTRLAEIIDDCVTSEEEEELEEEEEEDPEEDRKSTKEEESEVPKSPEPPPVPVLAPTEGPPLQALGQPSGSFICEMPNCGAVFSSRQALNGHARIHGGTNQVTKARGAIPSGKQKPGGTQSGYCSVKSSPSHSTTSGETDPTTIFPCKECGKVFFKIKSRNAHMKTHRQQEEQQRQKAQKAAFAAEMAATIERTTGPVGAPGLLPLDQLSLIKPIKDVDILDDDVVQQLGGVMEEAEVVDTDLLLDDQDSVLLQGDAEL

SEQ ID NO: 6212 - protein, 748 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 6213 - protein, 805 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRERDKLNHKSLSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLKRDMGKLSETRLSEDEQCTLGLQRWFCRLWFMNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 6214 - protein, 410 aa, Homo sapiens
MAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 6215 - protein, 805 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLKRDMGKLSETRLSEDEQCTLGLQRWFCRLWFMNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 6216 - protein, 704 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRERDKLNHKSLSPSASFRGAEKHRNSADYSSESKKQKTEEKEIAARYNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 6217 - protein, 773 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 6218 - protein, 213 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGEKKNKSDTPGSLKQQQLQAQHLSHGHGLPVPLTPHPSGLQPPAIPPIGSSAGLLALSSALGGQSHLPIKDEKKHHDNDHQRGE

SEQ ID NO: 6219 - protein, 282 aa, Homo sapiens
MSDVEENNFEGRESRSQSKSPTGTPARVKSESRSGSRSPSRVSKHSESHSRSRSKSRSRSRRHSHRRYTRSRSHSHSHRRRSRSRSYTPEYRRRRSRSHSPMSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTHSGGGGGGGGGGGGGGGGRRRDSYYDRGYDRGYDRYEDYDYRYRRRSPSPYYSRYRSRSRSRSYSPRRY

SEQ ID NO: 6220 - protein, 180 aa, Homo sapiens
MSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTHSGGGGGGGGGGGGGGGGRRRDSYYDRGYDRGYDRYEDYDYRYRRSPSPYYSRYRSRSRSRSYSPRRY

SEQ ID NO: 6221 - protein, 181 aa, Homo sapiens
MSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTHSGGGGGGGGGGGGGGGGRRRDSYYDRGYDRGYDRYEDYDYRYRRRSPSPYYSRYRSRSRSRSYSPRRY

SEQ ID NO: 6222 - protein, 835 aa, Homo sapiens
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGPLSKQGSGSSQPMEVQEGYGFGSGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 6223 - protein, 753 aa, Homo sapiens
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGPLSKQGSGSSQPMEVQEGYGFGSGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 6224 - protein, 500 aa, Homo sapiens
MEVSTNPSSNIDPGDYVEMNDSITHLPSKVVIQDITMELHCPLCNDWFRDPLMLSCGHNFCEACIQDFWRLQAKETFCPECKMLCQYNNCTFNPVLDKLVEKIKKLPLLKGHPQCPEHGENLKLFSKPDGKLICFQCKDARLSVGQSKEFLQISDAVHFFTEELAIQQGQLETTLKELQTLRNMQKEAIAAHKENKLHLQQHVSMEFLKLHQFLHSKEKDILTELREEGKALNEEMELNLSQLQEQCLLAKDMLVSIQAKTEQQNSFDFLKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 6225 - protein, 341 aa, Homo sapiens
MEEELAIQQGQLETTLKELQTLRNMQKEAIAAHKENKLHLQQHVSMEFLKLHQFLHSKEKDILTELREEGKALNEEMELNLSQLQEQCLLAKDMLVSIQAKTEQQNSFDFLKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 6226 - protein, 296 aa, Homo sapiens
MEFLKLHQFLHSKEKDILTELREEGKALNEEMELNLSQLQEQCLLAKDMLVSIQAKTEQQNSFDFLKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 6227 - protein, 279 aa, Homo sapiens
MEFLKLHQFLHSKEKDILTELREEGKALNEEMELNLSQLQEQCLLAKDMLDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 6228 - protein, 500 aa, Homo sapiens; identical to SEQ ID NO: 6224

SEQ ID NO: 6229 - protein, 296 aa, Homo sapiens; identical to SEQ ID NO: 6226

SEQ ID NO: 6230 - protein, 497 aa, Homo sapiens
MEGSGEQPGPQPQHPGDHRIRDGDFVVLKREDVFKAVQVQRRKKVTFEKQWFYLDNVIGHSYGTAFEVTSGGSLQPKKKREEPTAETKEAGTDNRNIVDDGKSQKLTQDDIKALKDKGIKGEEIVQQLIENSTTFRDKTEFAQDKYIKKKKKKYEAIITVVKPSTRILSIMYYAREPGKINHMRYDTLAQMLTLGNIRAGNKMIVMETCAGLVLGAMMERMGGFGSIIQLYPGGGPVRAATACFGFPKSFLSGLYEFPLNKVDSLLHGTFSAKMLSSEPKDSALVEESNGTLEEKQASEQENEDSMAEAPESNHPEDQETMETISQDPEHKGPKERGSKKDYIQEKQRRQEEQRKRHLEAAALLSERNADGLIVASRFHPTPLLLSLLDFVAPSRPFVVYCQYKEPLLECYTKLRERGGVINLRLSETWLRNYQVLPDRSHPKLLMSGGGGYLLSGFTVAMDNLKADTSLKSNASTLESHETEEPAAKKRKCPESDS

SEQ ID NO: 6231 - protein, 327 aa, Homo sapiens
MYYAREPGKINHMRYDTLAQMLTLGNIRAGNKMIVMETCAGLVLGAMMERMGGFGSIIQLYPGGGPVRAATACFGFPKSFLSGLYEFPLNKVDSLLHGTFSAKMLSSEPKDSALVEESNGTLEEKQASEQENEDSMAEAPESNHPEDQETMETISQDPEHKGPKERGSKKDYIQEKQRRQEEQRKRHLEAAALLSERNADGLIVASRFHPTPLLLSLLDFVAPSRPFVVYCQYKEPLLECYTKLRERGGVINLRLSETWLRNYQVLPDRSHPKLLMSGGGGYLLSGFTVAMDNLKADTSLKSNASTLESHETEEPAAKKRKCPESDS

SEQ ID NO: 6232 - protein, 320 aa, Homo sapiens
MSFVAYEELIKEGDTAILSLGHGAMVAVRVQRGAQTQTRHGVLRHSVDLIGRPFGSKVTCGRGGWVYVLHPTPELWTLNLPHRTQILYSTDIALITMMLELRPGSVVCESGTGSGSVSHAIIRTIAPTGHLHTVEFHQQRAEKAREEFQEHRVGRWVTVRTQDVCRSGFGVSHVADAVFLDIPSPWEAVGHAWDALKVEGGRFCSFSPCIEQVQRTCQALAARGFSELSTLEVLPQVYNVRTVSLPPPDLGTGTDGPAGSDTSPFRSGTPMKEAVGHTGYLTLARSWGELTQNPCPALPSARRPGQPRNQGGDPALWPPG

SEQ ID NO: 6233 - protein, 289 aa, Homo sapiens
MSFVAYEELIKEGDTAILSLGHGAMVAVRVQRGAQTQTRHGVLRHSVDLIGRPFGSKVTCGRGGWVYVLHPTPELWTLNLPHRTQILYSTDIALITMMLELRPGSVVCESGTGSGSVSHAIIRTIAPTGHLHTVEFHQQRAEKAREEFQEHRVGRWVTVRTQDVCRSGFGVSHVADAVFLDIPSPWEAVGHAWDALKVEGGRFCSFSPCIEQVQRTCQALAARGFSELSTLEVLPQVYNVRTVSLPPPDLGTGTDGPAGSDTSPFRSGTPMKEAVGHTGYLTFATKTPG

SEQ ID NO: 6234 - protein, 414 aa, Homo sapiens
MSGLDGGNKLPLAQTGGLAAPDHASGDPDRDQCQGLREETEATQVMANTGGGSLETVAEGGASQDPVDCGPALRVPVAGSRGGAATKAGQEDAPPSTKGLEAASAAEAADSSQKNGCQLGEPRGPAGQKALEACGAGGLGSQMIPGKKAKEVTTKKRAISAAVEKEGEAGAAMEEKKVVQKEKKVAGGVKEETRPRAPKINNCMDSLEAIDQELSNVNAQADRAFLQLERKFGRMRRLHMQRRSFIIQNIPGFWVTAFRNHPQLSPMISGQDEDMLRYMINLEVEELKHPRAGCKFKFIFQGNPYFRNEGLVKEYERRSSGRVVSLSTPIRWHRGQDPQAHIHRNREGNTIPSFFNWFSDHSLLEFDRIAEIIKGELWPNPLQYYLMGEGPRRGIRGPPRQPVESARSFRFQSG

SEQ ID NO: 6235 - protein, 417 aa, Homo sapiens
MSGRSRGRKSSRAKNRGKGRAKARVRPAPDDAPRDPDPSQYQSLGEDTQAAQVQAGAGWGGLEAAASAQLLRLGEEAACRLPLDCGLALRARAAGDHGQAAARPGPGKAASLSERLAADTVFVGTAGTVGRPKNAPRVGNRRGPAGKKAPETCSTAGRGPQVIAGGRQKKGAAGENTSVSAGEEKKEERDAGSGPPATEGSMDTLENVQLKLENMNAQADRAYLRLSRKFGQLRLQHLERRNHLIQNIPGFWGQAFQNHPQLASFLNSQEKEVLSYLNSLEVEELGLARLGYKIKFYFDRNPYFQNKVLIKEYGCGPSGQVVSRSTPIQWLPGHDLQSLSQGNPENNRSFFGWFSNHSSIESDKIVEIINEELWPNPLQFYLLSEGARVEKGKEKEGRQGPGKQPMETTQPGVSQSN

SEQ ID NO: 6236 - protein, 410 aa, Homo sapiens
MSLPESPHSPATLDYALEDPHQGQRSREKSKATEVMADMFDGRLEPIVFPPPRLPEEGVAPQDPADGGHTFHILVDAGRSHGAIKAGQEVTPPPAEGLEAASASLTTDGSLKNGFPGEETHGLGGEKALETCGAGRSESEVIAEGKAEDVKPEECAMFSAPVDEKPGGEEMDVAEENRAIDEVNREAGPGPGPGPLNVGLHLNPLESIQLELDSVNAEADRALLQVERRFGQIHEYYLEQRNDIIRNIPGFWVTAFRHHPQLSAMIRGQDAEMLSYLTNLEVKELRHPRTGCKFKFFFQRNPYFRNKLIVKVYEVRSFGQVVSFSTLIMWRRGHGPQSFIHRNRHVICSFFTWFSDHSLPESDRIAQIIKEDLWSNPLQYYLLGEDAHRARRRLVREPVEIPRPFGFQCG

SEQ ID NO: 6237 - protein, 804 aa, Homo sapiens
MAAHRPGPLKQQNKAHKGGRHRGRGSAQRDGKGRLALKTLSKKVRKELSRVDQRHRASQLRKQKKEAVLAEKRQLGGKDGPPHQVLVVPLHSRISLPEAMQLLQDRDTGTVHLNELGNTQNFMLLCPRLKHRWFFTSARPGDLHVVLDMAKVADTILFLLDPLEGWDSTGDYCLSCLFAQGLPTYTLAVQGISGLPLKKQIDTRKKLSKAVEKRFPHDKLLLLDTQQEAGMLLRQLANQKQQHLAFRDRRAYLFAHAVDFVPSEENNLVGTLKISGYVRGQTLNVNRLLHIVGYGDFQMKQIDAPGDPFPLNPRGIKPQKDPDMAMEICATDAVDDMEEGLKVLMKADPGRQESLQAEVIPDPMEGEQTWPTEEELSEAKDFLKESSKVVKKVPKGTSSYQAEWILDGGSQSGGEGDEYEYDDMEHEDFMEEESQDESSEEEEEYETMTIGESVHDDLYDKKVDEEAEAKMLEKYKQERLEEMFPDEVDTPRDVAARIRFQKYRGLKSFRTSPWDPKENLPQDYARIFQFQNFTNTRKSIFKEVEEKEVEGAEVGWYVTLHVSEVPVSVVECFRQGTPLIAFSLLPHEQKMSVLNMVVRRDPGNTEPVKAKEELIFHCGFRRFRASPLFSQHTAADKHKLQRFLTADMALVATVYAPITFPPASVLLFKQKSNGMHSLIATGHLMSVDPDRMVIKRVVLSGHPFKIFTKMAVVRYMFFNREDVLWFKPVELRTKWGRRGHIKEPLGTHGHMKCSFDGKLKSQDTVLMNLYKRVFPKWTYDPYVPEPVPWLKSEISSTVPQGGME

SEQ ID NO: 6238 - protein, 18 aa, Homo sapiens
CKQSCVSIASCEAAELNL

SEQ ID NO: 6239 - protein, 772 aa, Homo sapiens
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLCLNLRNLPWFDEVDANSFFPRCYCLGAEDDKKAFIEDFWLTAARNVLKLVVKSEWKSYPIQAVEEEASGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPAVEVPQYVGIRLLVEGFTIKKPMAMCHRRMGVRPAVPLLTQRGSGEARHHFPSLHTKAQLPSPHVLRHQGQVLRRQHSKLVGTKALSTTGKALRTLPTAKVFISLPPNLDFKVAPSILKPRKAPALLCLRGPQLEVPCCLCPLKSEQFLAPVGRSRPKANSRPDCDKPRAEACPMKRLSPLKPLPLVGTFQRRRGLGDMKLGKPLLRFPTALVLDPTPNKKKQVKYLGLDSIAVGGSRVDGARPCTPGSTARA

SEQ ID NO: 6240 - protein, 240 aa, Homo sapiens
MFQRLNKMFVGEVSSSSNQEPEFNEKEDDEWILVDFIDTCTGFSAEEEEEEEDISEESPTEHPSVFSCLPASLECLADTSDSCFLQFESCPMEESWFITPPPCFTAGGLTTIKVETSPMENLLIEHPSMSVYAVHNSCPGLSEATRGTDELHSPSSPRVEAQNEMGQHIHCYVAALAAHTTFLEQPKSFRPSQWIKEHSERQPLNRNSLRRQNLTRDCHPRQVKHNGWVVHQPCPRQYNY

SEQ ID NO: 6241 - protein, 185 aa, Homo sapiens
MFQRLNKMFVGEVSSSSNQEPEFNEKEDDEWILVDFIDTCTGFSAEEEEEEEDISEESPTEHPSVFSCLPASLECLADTSDSCFLQFESCPMEESWFITPPPCFTAGGLTTIKVETSPMENLLIEHPSMSVYAVHNSCPGLSEATRGTDELHSPSSPRYSQDCHPRQVKHNGWVVHQPCPRQYNY

SEQ ID NO: 6242 - protein, 164 aa, Homo sapiens
MFQRLNKMFVGEVSSSSNQEPEFNEKEDDEWILVDFIDTCTGFSAEEEEEEEDISEESPTEHPSVFSCLPASLECLADTSDSCFLQFESCPMEESWFITPPPCFTAGGLTTIKVETSPMENLLIEHPSMSVYAVHNSCPGLSEATRGTDELHSPSSPRARKSCL

SEQ ID NO: 6243 - protein, 220 aa, Homo sapiens
MFQRLSSLFFSTPSPPEDPDCPRAFVSEEDEVDGWLIIDLPDSYAAPPSPGAAPAPAGRPPPAPSLMDESWFVTPPACFTAEGPGLGPARLQSSPLEDLLIEHPSMSVYVTGSTIVLEPGSPSPLPDAALPDGDLSEGELTPARREPRAARHAAPLPARAALLEKAGQVRRLQRARQRAERHALSAKAVQRQNRARESRPRRSKNQSSFIYQPCQRQFNY

SEQ ID NO: 6244 - protein, 220 aa, Homo sapiens; identical to SEQ ID NO: 6243

SEQ ID NO: 6245 - protein, 77 aa, Homo sapiens
MFQRLSSLFFSTPSPPEDPDCPRAFVSEEDEVDGWLIIDLPDSYAAPPSPGAAPAPAGRPPPAPSLMDESWFVTPPA

SEQ ID NO: 6246 - protein, 88 aa, Homo sapiens
MFQRLSSLFFSTPSPPEDPDCPRAFVSEEDEVDGWLIIDLPEGPGLGPARLQSSPLEDLLIEHPSMSVYVTGSTIVLEPGSPSPLPDA

SEQ ID NO: 6247 - protein, 304 aa, Homo sapiens
MATWKSPCFLYCLFILGPRLTGQNNSVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 6248 - protein, 362 aa, Homo sapiens
MELGSCLEGGREAAEEEGEPEVKKRRLLCVEFASVASCDAAVAQCFLAENDWEMERALNSYFEPPVEESALERRPETISEPKTYVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 6249 - protein, 284 aa, Homo sapiens
MELGSCLEGGREAAEEEGEPEVKKRRLLCVEFASVASCDAAVAQCFLAENDWEMERALNSYFEPYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 6250 - protein, 392 aa, Homo sapiens
MRERHDTGACAEPRVGLLFRLKGRCRGGRKMELGSCLEGGREAAEEEGEPEVKKRRLLCVEFASVASCDAAVAQCFLAENDWEMERALNSYFEPPVEESALERRPETISEPKTYVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 6251 - protein, 475 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLVSPPSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKYCDPDSYHRRDFW

SEQ ID NO: 6252 - protein, 1029 aa, Homo sapiens
MADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 6253 - protein, 620 aa, Homo sapiens
MLLCYRHLKTKRILRRNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 6254 - protein, 1029 aa, Homo sapiens; identical to SEQ ID NO: 6252

SEQ ID NO: 6255 - protein, 1028 aa, Homo sapiens
MADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQANSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 6256 - protein, 161 aa, Homo sapiens
MADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPS

SEQ ID NO: 6257 - protein, 1078 aa, Homo sapiens
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGRECMHGALSKPAVVRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQSFEKQGFHSGTPAASFNLPSALGSGGPINPATAAAYPPAPFMHILTPHQQPHSQILHHHLQQDGQDILNFVDDQLGE

SEQ ID NO: 6258 - protein, 983 aa, Homo sapiens
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGRKYPPPYKHFWTAES

SEQ ID NO: 6259 - protein, 1087 aa, Homo sapiens
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQQSFEKQGFHSGTPAASFNLPSALGSGGPINPATAAAYPPAPFMHILTPHQQPHSQILHHHLQQDGQTGSGQRSQTSSIPQKPQTNKSAYNSYSWGAN

SEQ ID NO: 6260 - protein, 350 aa, Homo sapiens
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGRECMHGALSKPAVVRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMV

SEQ ID NO: 6261 - protein, 280 aa, Homo sapiens
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQ

SEQ ID NO: 6262 - protein, 383 aa, Homo sapiens
  MOD_RES (1)..(1): Any amino acid
XVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQQSFEKQGFHSGTPAASFNLPSALGSGGPINPATAAAYPPAPFMHILTPHQQPHSQILHHHLQQDGQLPYLQMILCCQRQQEEQTGSGQRSQTSSIPQKPQTNKSAYNSYSWGAN

SEQ ID NO: 6263 - protein, 1087 aa, Homo sapiens; identical to SEQ ID NO: 6259

SEQ ID NO: 6264 - protein, 600 aa, Homo sapiens
MPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQQSFEKQGFHSGTPAASFNLPSALGSGGPINPATAAAYPPAPFMHILTPHQQPHSQILHHHLQQDGQLPYLQMILCCQRQQEEQTGSGQRSQTSSIPQKPQTNKSAYNSYSWGAN

SEQ ID NO: 6265 - protein, 399 aa, Homo sapiens
  MOD_RES (1)..(1): Any amino acid
XQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQQSFEKQGFHSGTPAASFNLPSALGSGGPINPATAAAYPPAPFMHILTPHQQPHSQILHHHLQQDGQDILNFVDDQLGE

SEQ ID NO: 6266 - protein, 265 aa, Homo sapiens
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRVRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAE

SEQ ID NO: 6267 - protein, 182 aa, Homo sapiens
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRG

SEQ ID NO: 6268 - protein, 234 aa, Homo sapiens
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGT

SEQ ID NO: 6269 - protein, 662 aa, Homo sapiens
MPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQQSFEKQGFHSGTPAASFNLPSALGSGGPINPATAAAYPPAPFMHILTPHQQPHSQILHHHLQQDGQLPYLQMILCCQRQQEEQTGSGQRSQTSSIPQKPQTNKSAYNSYSWPTEALTLFSRSHLLRGLLSLETMETASKRKECGGFPLPPTPSGPPHASASCLSHSYTIPTLLYVL

SEQ ID NO: 6270 - protein, 530 aa, Homo sapiens
MEDDSLYLRGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQPNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSSTPTHQESMNTGTLASLRGRARRSKGKNKHSKRALLVCQ

SEQ ID NO: 6271 - protein, 530 aa, Homo sapiens; identical to SEQ ID NO: 6270

SEQ ID NO: 6272 - protein, 530 aa, Homo sapiens; identical to SEQ ID NO: 6270

SEQ ID NO: 6273 - protein, 530 aa, Homo sapiens; identical to SEQ ID NO: 6270

SEQ ID NO: 6274 - protein, 530 aa, Homo sapiens; identical to SEQ ID NO: 6270

SEQ ID NO: 6275 - protein, 530 aa, Homo sapiens; identical to SEQ ID NO: 6270

SEQ ID NO: 6276 - protein, 530 aa, Homo sapiens; identical to SEQ ID NO: 6270

SEQ ID NO: 6277 - protein, 2798 aa, Homo sapiens
MTSIHFVVHPLPGTEDQLNDRLREVSEKLNKYNLNSHPPLNVLEQATIKQCVVGPNHAAFLLEDGRVCRIGFSVQPDRLELGKPDNNDGSKLNSNSGAGRTSRPGRTSDSPWFLSGSETLGRLAGNTLGSRWSSGVGGSGGGSSGRSSAGARDSRRQTRVIRTGRDRGSGLLGSQPQPVIPASVIPEELISQAQVVLQGKSRSVIIRELQRTNLDVNLAVNNLLSRDDEDGDDGDDTASESYLPGEDLMSLLDADIHSAHPSVIIDADAMFSEDISYFGYPSFRRSSLSRLGSSRVLLLPLERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 6278 - protein, 527 aa, Homo sapiens
MAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 6279 - protein, 2799 aa, Homo sapiens
MTSIHFVVHPLPGTEDQLNDRLREVSEKLNKYNLNSHPPLNVLEQATIKQCVVGPNHAAFLLEDGRVCRIGFSVQPDRLELGKPDNNDGSKLNSNSGAGRTSRPGRTSDSPWFLSGSETLGRLAGNTLGSRWSSGVGGSGGGSSGRSSAGARDSRRQTRVIRTGRDRGSGLLGSQPQPVIPASVIPEELISQAQVVLQGKSRSVIIRELQRTNLDVNLAVNNLLSRDDEDGDDGDDTASESYLPGEDLMSLLDADIHSAHPSVIIDADAMFSEDISYFGYPSFRRSSLSRLGSSRVLLLPLERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 6280 - protein, 2792 aa, Homo sapiens
MTSIHFVVHPLPGTEDQLNDRLREVSEKLNKYNLNSHPPLNVLEQATIKQCVVGPNHAAFLLEDGRVCRIGFSVQPDRLELGKPDNNDGSKLNSNSGAGRTSRPGRTSDSPWFLSGSETLGRLAGNTLGSRWSSGVGGSGGGSSGRSSAGARDSRRQTRVIRTGRDRGSGLLGSQPQPVIPASVIPEELISQAQVVLQGKSRSVIIRELQRTNLDVNLAVNNLLSRDDEDGDDGDDTASESYLPGEDLMSLLDADIHSAHPSVIIDADAMFSEDISYFGYPSFRRSSLSRLGSSRERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 6281 - protein, 530 aa, Homo sapiens
MEDDSLYLGGEWQFNHFSKLTSSRPDAAFAEIQRTSLPEKSPLSSEARVDLCDDLAPVARQLAPRKKLPLSSRRPAAVGAGLQNMGNTCYENASLQCLTYTPPLANYMLSREHSQTCQRPKCCMLCTMQAHITWALHSPGHVIQPSQALAAGFHRGKQEDAHEFLMFTVDAMKKACLPGHKQVDHHSKDTTLIHQIFGGCWRSQIKCLHCHGISDTFDPYLDIALDIQAAQSVKQALEQLVKPEELNGENAYHCGLCLQRAPASKTLTLHTSAKVLILVLKRFSDVTGNKLAKNVQYPECLDMQPYMSQQNTGPLVYVLYAVLVHAGWSCHDGHYFSYVKAQEGQWYKMDDAKVTACSITSVLSQQAYVLFYIQKSEWERHSESVSRGREPRALGAEDTDRRATQGELKRDHPCLQAPELDERLVERATQESTLDHWKFPQEQNKTKPEFNVRKVEGTLPPNVLVIHQSKYKCGMKNHHPEQQSSLLNLSSTTRTDQESVNTGTLASLQGRTRRSKGKNKHSKRALLVCQ

SEQ ID NO: 6282 - protein, 979 aa, Homo sapiens
MSPLKIHGPIRIRSMQTGITKWKEGSFEIVEKENKVSLVVHYNTGGIPRIFQLSHNIKNVVLRPSGAKQSRLMLTLQDNSFLSIDKVPSKDAEEMRLFLDAVHQNRLPAAMKPSQGSGSFGAILGSRTSQKETSRQLSYSDNQASAKRGSLETKDDIPFRKVLGNPGRGSIKTVAGSGIARTIPSLTSTSTPLRSGLLENRTEKRKRMISTGSELNEDYPKENDSSSNNKAMTDPSRKYLTSSREKQLSLKQSEENRTSGLLPLQSSSFYGSRAGSKEHSSGGTNLDRTNVSSQTPSAKRSLGFLPQPVPLSVKKLRCNQDYTGWNKPRVPLSSHQQQQLQGFSNLGNTCYMNAILQSLFSLQSFANDLLKQGIPWKKIPLNALIRRFAHLLVKKDICNSETKKDLLKKVKNAISATAERFSGYMQNDAHEFLSQCLDQLKEDMEKLNKTWKTEPVSGEENSPDISATRAYTCPVITNLEFEVQHSIICKACGEIIPKREQFNDLSIDLPRRKKPLPPRSIQDSLDLFFRAEELEYSCEKCGGKCALVRHKFNRLPRVLILHLKRYSFNVALSLNNKIGQQVIIPRYLTLSSHCTENTKPPFTLGWSAHMAISRPLKASQMVNSCITSPSTPSKKFTFKSKSSLALCLDSDSEDELKRSVALSQRLCEMLGNEQQQEDLEKDSKLCPIEPDKSELENSGFDRMSEEELLAAVLEISKRDASPSLSHEDDDKPTSSPDTGFAEDDIQEMPENPDTMETEKPKTITELDPASFTEITKDCDENKENKTPEGSQGEVDWLQQYDMEREREEQELQQALAQSLQEQEAWEQKEDDDLKRATELSLQEFNNSFVDALGSDEDSGNEDVFDMEYTEAEAEELKRNAETGNLPHSYRLISVVSHIGSTSSSGHYISDVYDIKKQAWFTYNDLEVSKIQEAAVQSDRDRSGYIFFYMHKEIFDELLETEKNSQSLSTEVGKTTRQAL

SEQ ID NO: 6283 - protein, 979 aa, Homo sapiens; identical to SEQ ID NO: 6282

SEQ ID NO: 6284 - protein, 979 aa, Homo sapiens; identical to SEQ ID NO: 6282

SEQ ID NO: 6285 - protein, 153 aa, Homo sapiens
MAELPHRIIKETQRLLAEPVPGIKAEPDESNARYFHVVIAGESKDSPFEGGTFKRELLLAEEYPMAAPKVRFMTKIYHPNVDKLERISLDILKDKWSPALQIRTVLLSIQALLNAPNPDDPLANDVVEQWKTNEAQAIETARAWTRLYAMNSI

SEQ ID NO: 6286 - protein, 449 aa, Homo sapiens
MADGEEPMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 6287 - protein, 463 aa, Homo sapiens
MADGEEPEKKRRRIEELLAEKMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 6288 - protein, 286 aa, Homo sapiens
MLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 6289 - protein, 802 aa, Homo sapiens
MWIQVRTIDGSKTCTIEDVSRKATIEELRERVWALFDVRPECQRLFYRGKQLENGYTLFDYDVGLNDIIQLLVRPDPDHLPGTSTQIEAKPCSNSPPKVKKAPRVGPSNQPSTSARARLIDPGFGIYKVNELVDARDVGLGAWFEAHIHSVTRASDGQSRGKTPLKNGSSCKRTNGNIKHKSKENTNKLDSVPSTSNSDCVAADEDVIYHIQYDEYPESGTLEMNVKDLRPRARTILKWNELNVGDVVMVNYNVESPGQRGFWFDAEITTLKTISRTKKELRVKIFLGGSEGTLNDCKIISVDEIFKIERPGAHPLSFADGKFLRRNDPECDLCGGDPEKKCHSCSCRVCGGKHEPNMQLLCDECNVAYHIYCLNPPLDKVPEEEYWYCPSCKTDSSEVVKAGERLKMSKKKAKMPSASTESRRDWGRGMACVGRTRECTIVPSNHYGPIPGIPVGSTWRFRVQVSEAGVHRPHVGGIHGRSNDGAYSLVLAGGFADEVDRGDEFTYTGSGGKNLAGNKRIGAPSADQTLTNMNRALALNCDAPLDDKIGAESRNWRAGKPVRVIRSFKGRKISKYAPEEGNRYDGIYKVVKYWPEISSSHGFLVWRYLLRRDDVEPAPWTSEGIERSRRLCLRLQYPAGYPSDKEGKKPKGQSKKQPSGTTKRPISDDDCPSASKVYKASDSAEAIEAFQLTPQQQHLIREDCQNQKLWDEVLSHLVEGPNFLKKLEQSFMCVCCQELVYQPVTTECFHNVCKDCLQRSFKAQVFSCPACRHDLGQNYIMIPNEILQTLLDLFFPGYSKGR

SEQ ID NO: 6290 - protein, 136 aa, Homo sapiens
MWIQVRTIDGSKTCTIEDVSRKATIEELRERVWALFDVRPECQRLFYRGKQLENGYTLFDYDVGLNDIIQLLVRPDPDHLPGTSTQIEAKPCSNSPPKVKKAPRVGPSNQPSTSARARLIDPGFGIYKGLALSPRL

SEQ ID NO: 6291 - protein, 112 aa, Homo sapiens
MNVKDLRPRARTILKWNELNVGDVVMVNYNVESPGQRGFWFDAEITTLKTISRTKKELRVKIFLGGSEGTLNDCKIISVDEIFKIERPGAHPLSFADGKFLRRNDPECDLCG

SEQ ID NO: 6292 - protein, 541 aa, Homo sapiens
MVINLCLPQFRPRIHCNKISADGYEVENLISEDLTKRSHGFRTEYFIKPPVYVTVSFPFNVEICRINIDLTAGGGQNVTGLEMYTSASSSRVSWNTPQCRTLGPAEPSVPDKEAFTLVGKVLLKNQSQVVFSHRGFKARPPFGAMEATLPSPAVVAQELWNKGALSLSHVAHLRICITHVTGGGIPCIKRLEVWGQPAKTCSQEVIDSILLVTSENLPQDVALQAPALPMESDCDPGDQPESQQAPSSLQKLAEIIQDVPEEFLDPITLEIMPCPMLLPSGKVIDQSTLEKCNRSEATWGRVPSDPFTGVAFTPHSQPLPHPSLKARIDHFLLQHSIPGCHLLGRAQTALAVIPSSIVLPSQKRKIEQAEHVPDSNFGVNASCFSATSPLVLPTTSEHTAKKMKATNEPSLTHMDCSTGPLSHEQKLSQSLEIALASTLGSMPSFTARLTRGQLQHLGTRGSNTSWRPGTGSEQPGSILGPECASCKRVFSPYFKKEPVYQLPCGHLLCRPCLGEKQRSLPMTCTACQRPVASQDVLRVHF

SEQ ID NO: 6293 - protein, 487 aa, Homo sapiens
MVINLCLPQFRPRIHCNKISADGYEVENLISEDLTKRSHGFRTEYFIKPPVYVTVSFPFNVEICRINIDLTAGGGQNVTGLEMYTSASSSRVSWNTPQCRTLGPAEPSVPDKEAFTLVGKVLLKNQSQVVFSHRGFKARPPFGAMEATLPSPAVVAQELWNKGALSLSHVAHLRICITHVTGGGIPCIKRLEVWGQPAKTCSQEVIDSILLVTSENLPQDVALQAPALPMESDCDPGDQPESQQAPSSLQKLAEIIQDVPEEFLDPITLEIMPCPMLLPSGKVIDQSTLEKCNRSEATWGRVPSDPFTGVAFTPHSQPLPHPSLKARIDHFLLQHSIPGCHLLGRAQTALAVIPSSIVLPSQKRKIEQAEHVPDSNFGVNASCFSATSPLVLPTTSEHTAKKMKATNEPSLTHMDCSTEQPGSILGPECASCKRVFSPYFKKEPVYQLPCGHLLCRPCLGEKQRSLPMTCTACQRPVASQDVLRVHF

SEQ ID NO: 6294 - protein, 88 aa, Homo sapiens
MVINLCLPQFRPRIHCNKISADGYEVENLISEDLTKRSHGFRTEYFIKPPVYVTVSFPFNVEICRINIDLTAGGGQNVTGLEMYTSAS

SEQ ID NO: 6295 - protein, 534 aa, Homo sapiens
MARGLQVPLPRLATGLLLLLSVQPWAESGKVLVVPTDGSPWLSMREALRELHARGHQAVVLTPEVNMHIKEEKFFTLTAYAVPWTQKEFDRVTLGYTQGFFETEHLLKRYSRSMAIMNNVSLALHRCCVELLHNEALIRHLNATSFDVVLTDPVNLCGAVLAKYLSIPAVFFWRYIPCDLDFKGTQCPNPSSYIPKLLTTNSDHMTFLQRVKNMLYPLALSYICHTFSAPYASLASELFQREVSVVDLVSYASVWLFRGDFVMDYPRPIMPNMVFIGGINCANGKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 6296 - protein, 531 aa, Homo sapiens
MMDGRLLEHPHAQFGGSLGGVVGFPYPLGHHHVYELAGHQLQSAAAAASVPFSIDGLLGGSCAAAASVVNPTPLLPAACGVGGDGQPFKLSDSGDPDKESPGCKRRRTRTNFTGWQLEELEKAFNESHYPDVFMREALALRLDLVESRVQVWFQNRRAKWRKKENTKKGPGRPAHNSHPTTCSGEPMDPEEIARKELEKMEKKKRKHEKKLLKSQGRHLHSPGGLSLHSAPSSDSDSGGGGLSPEPPEPPPPAAKGPGAHASGAAGTAPAPPGEPPAPGTCDPAFYPSQRSGAGPQPRPGRPADKDAASCGPGAAVAAVERGAAGLPKASPFSVESLLSDSPPRRKAASNAAAAAAAGLDFAPGLPCAPRTLIGKGHFLLYPITQPLGFLVPQAALKGGAGLEPAPKDAPPAPAVPPAPPAQASFGAFSGPGGAPDSAFARRSPDAVASPGAPAPAPAPFRDLASAAATEGGGGDCADAGTAGPAPPPPAPSPRPGPRPPSPAEEPATCGVPEPGAAAGPSPPEGEELDMD

SEQ ID NO: 6297 - protein, 346 aa, Homo sapiens
MDMLDPGLDPAASATAAAAASHDKGPEAEEGVELQEGGDGPGAEEQTAVAITSVQQAAFGDHNIQYQFRTETNGGQVTYRVVQVTDGQLDGQGDTAGAVSVVSTAAFAGGQQAVTQVGVDGAAQRPGPAAASVPPGPAAPFPLAVIQNPFSNGGSPAAEAVSGEARFAYFPASSVGDTTAVSVQTTDQSLQAGGQFYVMMTPQDVLQTGTQRTIAPRTHPYSPKIDGTRTPRDERRRAQHNEVERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 6298 - protein, 279 aa, Homo sapiens
MDMLDPGLDPAASATAAAAASHDKGPEAEEGVELQEGGDGPGAEEQTAVAITSVQQAAFGDHNIQYQFRTETNGGQAVIQNPFSNGGSPAAEAVSGEARFAYFPASSVGDTTAVSVQTTDQSLQAGGQFYVMMTPQDVLQTGTQRTIAPRTHPYSPKIDGTRTPRDERRRAQHNEVERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 6299 - protein, 215 aa, Homo sapiens
MDMLDPGLDPAASATAAAAASHDKGPEAEEGVELQEGGDGPGAEEQTAVAITSVQQAAFGDHNIQYQFRTETNGGQTGTQRTIAPRTHPYSPKIDGTRTPRDERRRAQHNEVERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 6300 - protein, 2271 aa, Homo sapiens
MGVPKRKASGGQDGAASSAGAAKRARKEELTGVRFKAQLKDPQGPGPGLEAFVSAAKKLPREDVYDVVEGYIKISVECVEIFQLLSGEKRPESETMLIFQVFEAILLRTASDLSHFHVVGTNIVKKLMNNHMKLICESLYASGYRLARACLSLMTAMVTQGPEAARDVCSHFDLNKKTLYTLVTKRDSKGVYDVRQAYVQFALSFLIAGDDSTIVQVLEVKEFIPCIFSSGIKEDRISTINILLSTLKTKVVHNKNITKTQKVRFFTGQLLNHIASLYNWNGITDVNPENVKVSAEEAGKTMVRELVHNFLMDLCCSLKHGINFYDASLGTFGRGGNLTLLHFLLGLKTAADDDLVADLVVNILKVCPDLLNKYFKEVTFSFIPRAKSTWLNNIKLLNKIYEAQPEISRAFQTREFIPLPRLLAMVMVTTVPLVCNKSMFTQALNLDSTSVRHTALSLISVILKRALKTVDHCLNKEVWQESGVYTAVMMEEFVQLFREALSKILPDLNTVVWVWQSLKKQETKQDDKKGQKRSDGPPAACDAHQCDDAETILLKAVLLQVICLYQKVVPHVVMQYNFDFSKLLKGVISEQGLREEVPPILQHHMLKVALELPASKFLWLKAQEGPDAEIIGGERSVFYLLMKMFVTSSHLQLKSLTKLLIMKILRDTGVFEHTWKELELWLEHLENTMEEDKETVIQFLERILLTLVANPYSYTDKASDFVQEASMLQATMTKQEADDMSIPISHIDDVLDMVDVLVEGSEGLDEEIGFTLSEDMILLTFPFSAVVPAALEARNKLLLGTGNEAAENVVTYLTAVLTDLLHTQRDPLALCLLLQAYDKLEPPCLVPCCQQLSRFNRYYSLWIPEQAREAWLLQAQGSPSPPALPLASSFTALLQAAYESQALRDEHIQVQLQATMPHLSMQQVLLAAKQVLLYLRSTVENFGQLGRSVGPPLLQLFLDLLRRLVVHCEQLDAQNQQRCEAARAEADLFLDMESVASLELANDQTLEEVLVAILRHPTLEGWFLALEQQALPPHTLSPVLVKLLATHFSAGVLQLLAASAPILQNIGQLGLLARYSEAITQSVLKELQNRRAGPATSPPKTPPQLEALQELHPYMEGAQLREVTLALLSLPETHLVTQQPTKSPGKERHLNALGKTLVQLLTCSPQDQLQSGELLWSSEYVRGLGALLPTLAVDELDTVLLHTLQRDPVLAPAVGADLLDYCLARRTQAALSIAALLLQESCTHLLWFEQWCLQAGPGLGLQGDLDDFLPLIHVYLQCRTRSHFTRPAGVSSAVIPVLRKTLWRQLQSRLLSTDSPPASGLYQEILAQLVPFARAKDLSVLMDRLPSLLHTPSSHKRWIVADSISAALEGSAEELCAWRRTLLESCVKWLIVSFSGGQQDDDNTQNQEKEMLLRLNALLHALNEVDPGDWQKFVKKGLKFRYQDHTFLKMLLTAVQLLYSPESSVRTKLIQLPVVYVMLMQHSLFLPTLLTSDGEESPDSQVKEALVDLMLTVVEMCPSVCESSHFAVLLGAYGATLSVLDQKILLLLRAYEQNKLSLINFRVLLWGPAAVEHHKTCRSLGRSLWQQPSVGDILRLLDRDRMMQTILHFPQNRRLLPPEDTQELIFKDKSRVDLDGLYDPCFLLQLFSELTRPEFVVDCRKFLDSNALGLTVTALSSYDPQMRAIAYHVLAAYYSHLEGARFQEQSQLLYLLDVVRNGIRTQDMRLTFTLALFIAKAALQILKPEEHMYLKVSNFLLSHEYLNMDKVPGFYQFFYSSDFEQKTEQKWVFGVLRQGIRDKQCYELCARRGIFHIILSFFHSPLCDEAAQNWILEILQNAAQVARSAYEIIRDYSLLTWILHILESKFLETPLLSNVISLLHTLWVTNLGDKAVEWESQRLCQPSSQEPAKRLALHLVNEFLYVLIVLMKHLRPTLAPVQLTNFFGTLDSVLRYRATVIQAFRDMNRFTVNETVLSTKDVLVLLHKWSLIERDLKLQEDLRAAIEKAQARELMKMLKDKNKPVMPARAKGPRGRKRRPGEAEEMADPELMASTLETCKGLLRSILTYWRPVIPGPDPTQEPVDSASPESDAPGPVYAAASLAVSWVLRSVAEHPLSRAEAAGLIGWLKSHILPHPVVVADLLKDSAVRSSIFRLYSRLCGAEGLAGPVQEVACLFNTVMLQLVAAQGRAGSPFHPAMEALSLSSLSEKDEATQASAAFLVSLYIKDIWLGAQRPDTLLTHVRMVCEAADDAPSSEEEAIVVLCKDAASAASDA

SEQ ID NO: 6301 - protein, 1524 aa, Homo sapiens
MAAVYSGISLKLKSKTTSWEDKLKLAHFAWISHQCFLPNKEQVLLDWARQSLVAFYKKKLELKEDIVERLWIYIDNILHSRKLQNLLKNGKTINLQISLVKIINERVAEFSLSGSQRNICAVLRCCQGILSTPALAVIYTAKQELMVALLSQLCWSACRQPEGAVVAQLFEVIHLALGHYLLILQQQVNPRRAFGDVTAHLLQPCLVLRHLLSGGTWTQAGQGQLRQVLSRDIRSQIEAMFRGGIFQPELLSSYKEGLLDQQQGDVKTGAMKNLLAPMDTVLNRLVDAGYCAASLHTSVVANSVALLYKLFLDSYFKEGNQLLCFQVLPRLFGCLKISHLQEEQSKALSTSDWTTELLVVEQLLNSVANNNIYNIAADRIRHEEAQFRFYRHVAELLINHAQAPIPAWFRCLKTLISLNHLILEPDLDDLLASAWIDAEVTEFRTKKAQEALIRTVFQTYAKLRQVPRLFEEVLGVICRPAAEALRQPVLASGPSTVLSACLLELPPSQILDTWSLVLEKFQSLVLPYLQSDADMALKSLSLSLLLHCIMFNMRSLDSSTPLPIVRRTQCMMERMMRELVQPLLALLPDTPGPEPELWLQKVSDSVLLLSYTWAQVDAMFSLNCSQYHSMSGPLIGVALEISNLPSLLPGVKTQHWKKIEKFTAQFSSLGTYCLEQLYLQKMKRTLMQTSFRSEGAIQSLRCDAAFIIGSGRKSLNQRTTASWDGQVGMVSGLTYPVAHWHLIVSNLTILISYLCPDDVGYLASVLLRTLPMGKAQEVSIDEEAYITLEKISKAFLHSPLFPEMQSLHSAFLTCVTTSCSSILCSGAQRDSGLVSQQLPWLFEKDHMVVGHWENRFAKAGPEGIEPRGEIAQNLLSLVKSDFPIQLEGEQLESILGLLEVISALQLDSLLPPYHVHYFLVLLSMAVTKLGCSCSSSLALKFLTTCYQLLGYLQKGKSARSVFKIMYGSDIFEVVLTSLFRASSRFLIEMDDPAWLEFLQVIGTFLEELMQMLIQMKLSLVLNFRKITAFLSSSKPYTEAASSKQLENQNPQGRQLLLVSLTRLCHVLGPFLKEQKLGQEAPAALSELLQQVVLQTGAVLQLCSVPGARGWRLPSVLISSVSTLLEADLGQHCRDGGADISQGSDRTLLSHVALYQGVYSQILLELPALAGHDQSFQAALQFLTLFFLAPELHPKKDSVFTSMFHSVRRVLADPEIPVQVTQDIEPHLGALFTQMLEVGTTEDLRLVMQCILQGLDVSNMWKADVQAVVSAVTLLRLLLNCPLSGEKASLLWRACPQIVTALTLLNREASQEQPVSLTVVGPVLDVLAALLRQGEEAIGNPHHVSLAFSILLTVPLDHLKPLEYGSVFPRLHNVLFSILQCHPKVMLKAIPSFLNSFNRLVFSVMREGRQKDKGSIDDLPTVLKCARLVERMYSHIAARAEEFAVFSPFMVAQYVLEVQKVTLYPAVKSLLQEGIYLILDLCIEPDVQFLRASLQPGMRDIFKELYNDYLKYHKAKHEGEKRYTA

SEQ ID NO: 6302 - protein, 84 aa, Homo sapiens
MLKAIPSFLNSFNRLVFSVMREGRQKDKGSIDDLPTVLKCARLVERMYSHIAARAEEFAVFSPFMVAQYVLEVQKVTLYPAVKS

SEQ ID NO: 6303 - protein, 603 aa, Homo sapiens
MKGDFRKKKSEARTPLEQEIFNLLHKNKQPVTDPLLTPVEKASLRAMSLEEAKMRRAELQRARALQSYYEAKARREKKIKSKKYHKVVKKGKAKKALKEFEQLRKVNPAAALEELEKIEKARMMERMSLKHQNSGKWAKSKAIMAKYDLEARQAMQEQLSKNKELTQKLQVASESEEEEGGTEDVEELLVPDVVNEVQMNADGPNPWMLRSCTSDTKEAATQEDPEQLPELEAHGVSESEGEERPVAEEEILLREFEERRSLRKRSELSQDAEPAGSQETKDSGSQEVLSELRVLSQKLKENHQSRKQKASSEGTIPQVQREEPAPEEEEPLLLQRPERVQTLEELEELGKEECFQNKELPRPVLEGQQSERTPNNRPDAPKEKKKKEQMIDLQNLLTTQSPSVKSLAVPTIEELEDEEERNHRQMIKEAFAGDDVIRDFLKEKREAVEASKPKDVDLTLPGWGEWGGVGLKPSAKKRRRFLIKAPEGPPRKDKNLPNVIINEKRNIHAAAHQVRVLPYPFTHHWQFERTIQTPIGSTWNTQRAFQKLTTPKVVTKPGHIINPIKAEDVGYRSSSRSDLSVIQRNPKRITTRHKKQLKKCSVD

SEQ ID NO: 6304 - protein, 717 aa, Homo sapiens
MRGTMMERESIKSFWKQSVPLMERIGSGEKLVLADLLEPVKTSSSLATVKKQLSRVKSKKTVELPLNKEEIERIHREVAFNKTAQVLSKWDPVVLKNRQAEQLVFPLEKEEPAIAPIEHVLSGWKARTPLEQEIFNLLHKNKQPVTDPLLTPVEKASLRAMSLEEAKMRRAELQRARALQSYYEAKARREKKIKSKKYHKVVKKGKAKKALKEFEQLRKVNPAAALEELEKIEKARMMERMSLKHQNSGKWAKSKAIMAKYDLEARQAMQEQLSKNKELTQKLQVASESEEEEGGTEDVEELLVPDVVNEVQMNADGPNPWMLRSCTSDTKEAATQEDPEQLPELEAHGVSESEGEERPVAEEEILLREFEERRSLRKRSELSQDAEPAGSQETKDSGSQEVLSELRVLSQKLKENHQSRKQKASSEGTIPQVQREEPAPEEEEPLLLQRPERVQTLEELEELGKEECFQNKELPRPVLEGQQSERTPNNRPDAPKEKKKKEQMIDLQNLLTTQSPSVKSLAVPTIEELEDEEERNHRQMIKEAFAGDDVIRDFLKEKREAVEASKPKDVDLTLPGWGEWGGVGLKPSAKKRRRFLIKAPEGPPRKDKNLPNVIINEKRNIHAAAHQVRVLPYPFTHHWQFERTIQTPIGSTWNTQRAFQKLTTPKVVTKPGHIINPIKAEDVGYRSSSRSDLSVIQRNPKRITTRHKKQLKKCSVD

SEQ ID NO: 6305 - protein, 771 aa, Homo sapiens
MTANRLAESLLALSQQEELADLPKDYLLSESEDEGDNDGERKHQKLLEAISSLDGKNRRKLAERSEASLKVSEFNVSSEGSGEKLVLADLLEPVKTSSSLATVKKQLSRVKSKKTVELPLNKEEIERIHREVAFNKTAQVLSKWDPVVLKNRQAEQLVFPLEKEEPAIAPIEHVLSGWKARTPLEQEIFNLLHKNKQPVTDPLLTPVEKASLRAMSLEEAKMRRAELQRARALQSYYEAKARREKKIKSKKYHKVVKKGKAKKALKEFEQLRKVNPAAALEELEKIEKARMMERMSLKHQNSGKWAKSKAIMAKYDLEARQAMQEQLSKNKELTQKLQVASESEEEEGGTEDVEELLVPDVVNEVQMNADGPNPWMLRSCTSDTKEAATQEDPEQLPELEAHGVSESEGEERPVAEEEILLREFEERRSLRKRSELSQDAEPAGSQETKDSGSQEVLSELRVLSQKLKENHQSRKQKASSEGTIPQVQREEPAPEEEEPLLLQRPERVQTLEELEELGKEECFQNKELPRPVLEGQQSERTPNNRPDAPKEKKKKEQMIDLQNLLTTQSPSVKSLAVPTIEELEDEEERNHRQMIKEAFAGDDVIRDFLKEKREAVEASKPKDVDLTLPGWGEWGGVGLKPSAKKRRRFLIKAPEGPPRKDKNLPNVIINEKRNIHAAAHQVRVLPYPFTHHWQFERTIQTPIGSTWNTQRAFQKLTTPKVVTKPGHIINPIKAEDVGYRSSSRSDLSVIQRNPKRITTRHKKQLKKCSVD

SEQ ID NO: 6306 - protein, 719 aa, Homo sapiens
MTANRLAESLLALSQQEELADLPKDYLLSESEDEGDNDGERKHQKLLEAISSLDGKNRRKLAERSEASLKVSEFNVSSEGSGEKLVLADLLEPVKTSSSLATVKKQLSRVKSKKTVELPLNKEEIERARTPLEQEIFNLLHKNKQPVTDPLLTPVEKASLRAMSLEEAKMRRAELQRARALQSYYEAKARREKKIKSKKYHKVVKKGKAKKALKEFEQLRKVNPAAALEELEKIEKARMMERMSLKHQNSGKWAKSKAIMAKYDLEARQAMQEQLSKNKELTQKLQVASESEEEEGGTEDVEELLVPDVVNEVQMNADGPNPWMLRSCTSDTKEAATQEDPEQLPELEAHGVSESEGEERPVAEEEILLREFEERRSLRKRSELSQDAEPAGSQETKDSGSQEVLSELRVLSQKLKENHQSRKQKASSEGTIPQVQREEPAPEEEEPLLLQRPERVQTLEELEELGKEECFQNKELPRPVLEGQQSERTPNNRPDAPKEKKKKEQMIDLQNLLTTQSPSVKSLAVPTIEELEDEEERNHRQMIKEAFAGDDVIRDFLKEKREAVEASKPKDVDLTLPGWGEWGGVGLKPSAKKRRRFLIKAPEGPPRKDKNLPNVIINEKRNIHAAAHQVRVLPYPFTHHWQFERTIQTPIGSTWNTQRAFQKLTTPKVVTKPGHIINPIKAEDVGYRSSSRSDLSVIQRNPKRITTRHKKQLKKCSVD

SEQ ID NO: 6307 - protein, 320 aa, Homo sapiens
MKGDFRKKKSEARTPLEQEIFNLLHKNKQPVTDPLLTPVEKASLRAMSLEEAKMRRAELQRARALQSYYEAKARREKKIKSKKYHKVVKKGKAKKALKEFEQLRKVNPAAALEELEKIEKARMMERMSLKHQNSGKWAKSKAIMAKYDLEARQAMQEQLSKNKELTQKLQVASESEEEEGGTEDVEELLVPDVVNEVQMNADGPNPWMLRSCTSDTKEAATQEDPEQLPELEAHGVSESEGEERPVAEEEILLREFEERRSLRKRSELSQDAEPAGSQETKDSGSQEVLSELRVLSQKLKENHQSRKQKASSEGTIPQVQ

SEQ ID NO: 6308 - protein, 766 aa, Homo sapiens
MNVNQVAENLALSHQEELVDLPKNYPLSENEDEGDSDGERKHQKLLEAIISLDGKNRRKLAERSEASLKVSEFSVSSEGSGEKLGLADLLEPVKTSSSLATVKKQLNRVKSKKVVELPLNKEKIEQIHREVAFSKTSQVLSKWDPIILKNQQAEQLVFPLGKEQPAIAPIEHALSGWKARTPLEQEIFNLLHKNKQPVTDPLLTPMEKASLQAMSLEEAKMHRAELQRARALQSYYEAKARKEKKIKSKKYHKVVKKGKAKKALKEFEQLQKVNPTVALEEMEKIENARMMERMSLKHQNSGKWAKSKAIMAKYDLEARQAMQEQLAKNKELTQKLQVASESEEEEGGTEVEELLVPHVANEVQMNVDGPNPWMFRSCTSDTKEAATQEDPEQVPELAAHEVSASEAEERPVAEEEILLREFEERQSLRKRSELNQDAEPASSQETKDSSSQEVLSELRALSQKLKEKHQSRKQKASSEGTVPQVQREEPAPEEAEPLLLQRSERVQTLEELEELGKEDCFQNKELPRPVLEGQQSERTPNNRPDAPKEKKEKEQLINLQNFLTTQSPSVRSLAVPTIIEELEDEEERDQRQMIKEAFAGDDVIRDFLKEKREAVEASKPKDVDLTLPGWGEWGGVGLKPSAKKRRQFLIKAPEGPPRKDKNLPNVIISEKRNIHAAAHQVQVLPYPFTHHRQFERTIQTPIGSTWNTQRAFQKLTTPKVVTKPGHIIKPIKAEDVGYQSSSRSDLPVIQRNPKRITTRHNKEEKL

SEQ ID NO: 6309 - protein, 518 aa, Homo sapiens
MAGYKPVAIQTYPILGEKITQDTLYWNNYKTPVQIKEFGAVSKVDFSPQPPYNYAVTASSRIHIYGRYSQEPIKTFSRFKDTAYCATFRQDGRLLVAGSEDGGVQLFDISGRAPLRQFEGHTKAVHTVDFTADKYHVVSGADDYTVKLWDIPNSKEILTFKEHSDYVRCGCASKLNPDLFITGSYDHTVKMFDARTSESVLSVEHGQPVESVLLFPSGGLLVSAGGRYVKVWDMLKGGQLLVSLKNHHKTVTCLCLSSSGQRLLSGSLDRKVKVYSTTSYKVVHSFDYAASILSLALAHEDETIVVGMTNGILSVKHRKSEAKKESLPRRRRPAYRTFIKGKNYMKQRDDILINRPAKKHLELYDRDLKHFRISKALDRVLDPTCTIKTPEITVSIIKELNRRGVLANALAGRDEKEISHVLNFLIRNLSQPRFAPVLINAAEIIIDIYLPVIGQSPVVDKKFLLLQGLVEKEIDYQRELLETLGMMDMLFATMRRKEGTSVLEHTSDGFPENKKIES

SEQ ID NO: 6310 - protein, 499 aa, Homo sapiens
MAGYKPVAIQTYPILGEKITQDTLYWNNYKPPYNYAVTASSRIHIYGRYSQEPIKTFSRFKDTAYCATFRQDGRLLVAGSEDGGVQLFDISGRAPLRQFEGHTKAVHTVDFTADKYHVVSGADDYTVKLWDIPNSKEILTFKEHSDYVRCGCASKLNPDLFITGSYDHTVKMFDARTSESVLSVEHGQPVESVLLFPSGGLLVSAGGRYVKVWDMLKGGQLLVSLKNHHKTVTCLCLSSSGQRLLSGSLDRKVKVYSTTSYKVVHSFDYAASILSLALAHEDETIVVGMTNGILSVKHRKSEAKKESLPRRRRPAYRTFIKGKNYMKQRDDILINRPAKKHLELYDRDLKHFRISKALDRVLDPTCTIKTPEITVSIIKELNRRGVLANALAGRDEKEISHVLNFLIRNLSQPRFAPVLINAAEIIIDIYLPVIGQSPVVDKKFLLLQGLVEKEIDYQRELLETLGMMDMLFATMRRKEGTSVLEHTSDGFPENKKIES

SEQ ID NO: 6311 - protein, 7 aa, Homo sapiens
MAGYKPV

SEQ ID NO: 6312 - protein, 545 aa, Homo sapiens
  MOD_RES (1)..(1): Any amino acid
XVIFARRSVRCVCRRLLEGPCDFYASAAELCRVGSWHSPINCPWVEVSRRTLWGSVETPVQIKEFGAVSKVDFSPQPPYNYAVTASSRIHIYGRYSQEPIKTFSRFKDTAYCATFRQDGRLLVAGSEDGGVQLFDISGRAPLRQFEGHTKAVHTVDFTADKYHVVSGADDYTVKLWDIPNSKEILTFKEHSDYVRCGCASKLNPDLFITGSYDHTVKMFDARTSESVLSVEHGQPVESVLLFPSGGLLVSAGGRYVKVWDMLKGGQLLVSLKNHHKTVTCLCLSSSGQRLLSGSLDRKVKVYSTTSYKVVHSFDYAASILSLALAHEDETIVVGMTNGILSVKHRKSEAKKESLPRRRRPAYRTFIKGKNYMKQRDDILINRPAKKHLELYDRDLKHFRISKALDRVLDPTCTIKTPEITVSIIKELNRRGVLANALAGRDEKEISHVLNFLIRNLSQPRFAPVLINAAEIIIDIYLPVIGQSPVVDKKFLLLQGLVEKEIDYQRELLETLGMMDMLFATMRRKEGTSVLEHTSDGFPENKKIES

SEQ ID NO: 6313 - protein, 65 aa, Homo sapiens
MAGYKPVAIQTYPILGEKITQDTLYWNNYKTPVQIKEFGAVSKVDFSPQPPYNYAVTASSRIHIY

SEQ ID NO: 6314 - protein, 328 aa, Homo sapiens
MFDARTSESVLSVEHGQPVESVLLFPSGGLLVSAGGRYVKVWDMLKGGQLLVSLKNHHKTVTCLCLSSSGQRLLSGSLDRKVKVYSTTSYKVVHSFDYAASILSLALAHEDETIVVGMTNGILSVKHRKSEAKKESLPRRRRPAYRTFIKGKNYMKQRDDILINRPAKKHLELYDRDLKHFRISKALDRVLDPTCTIKTPEITVSIIKELNRRGVLANALAGRDEKEISHVLNFLIRNLSQPRFAPVLINAAEIIIDIYLPVIGQSPVVDKKFLLLQGLVEKEIDYQRELLETLGMMDMLFATMRRKEGTSVLEHTSDGFPENKKIES

SEQ ID NO: 6315 - protein, 249 aa, Homo sapiens
MKITRQKHAKKHLGFFRNNFGVREPYQILLDGTFCQAALRGRIQLREQLPRYLMGETQLCTTRCVLKELETLGKDLYGAKLIAQKCQVRNCPHFKNAVSGSECLLSMVEEGNPHHYFVATQDQNLSVKVKKKPGVPLMFIIQNTMVLDKPSPKTIAFVKAVESGQLVSVHEKESIKHLKEEQGLVKNTEQSRRKKRKKISGPNPLSCLKKKKKAPDTQSSASEKKRKRKRIRNRSNPKVLSEKQNAEGE

SEQ ID NO: 6316 - protein, 145 aa, Homo sapiens
MKITRQKHAKKHLGFFRNNFGVREPYQILLDGTFCQAALRGRIQLREQLPRYLMGETQLCTTRCVLKELETLGKDLYGAKLIAQKCQVRNCPHFKNAVSGSECLLSMVEEGNPHHYFVATQYIPRMYTFCTNYGGQQYVIDALIG

SEQ ID NO: 6317 - protein, 597 aa, Homo sapiens
MAEIIQERIEDRLPELEQLERIGLFSHAEIKAIIKKASDLEYKIQRRTLFKEDFINYVQYEINLLELIQRRRTRIGYSFKKDEIENSIVHRVQGVFQRASAKWKDDVQLWLSYVAFCKKWATKTRLSKVFSAMLAIHSNKPALWIMAAKWEMEDRLSSESARQLFLRALRFHPECPKLYKEYFRMELMHAEKLRKEKEEFEKASMDVENPDYSEEILKGELAWIIYKNSVSIIKGAEFHVSLLSIAQLFDFAKDLQKEIYDDLQALHTDDPLTWDYVARRELEIESQTEEQPTTKQAKAVEVGRKEERCCAVYEEAVKTLPTEAMWKCYITFCLERFTKKSNSGFLRGKRLERTMTVFRKAHELKLLSECQYKQLSVSLLCYNFLREALEVAVAGTELFRDSGTMWQLKLQVLIESKSPDIAMLFEEAFVHLKPQVCLPLWISWAEWSEGAKSQEDTEAVFKKALLAVIGADSVTLKNKYLDWAYRSGGYKKARAVFKSLQESRPFSVDFFRKMIQFEKEQESCNMANIREYYERALREFGSADSDLWMDYMKEELNHPLGRPENCGQIYWRAMKMLQGESAEAFVAKHAMHQTGHL

SEQ ID NO: 6318 - protein, 474 aa, Homo sapiens
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYRFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKFVDKPGPFVGPCGHWIRPSETLQKYLKVVMALTYEEKPPYAMLRNNLEALLQDLRVSPYDPIGLPMVP

SEQ ID NO: 6319 - protein, 424 aa, Homo sapiens
MISFCPDCGKSIQAAFKFCPYCGNSLPVEEHVGSQTFVNPHVSSFQGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYRFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKFVDKPGPFVGPCGHWIRPSETLQKYLKVVMALTYEEKPPYAMLRNNLEALLQDLRVSPYDPIGLPMVP

SEQ ID NO: 6320 - protein, 284 aa, Homo sapiens
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLSTSGRSCTRPHCWPSLPAWVSVFTRTNTGSWCYPAWGGAFSRPWMSAQSMCCQRGLCCRWPAGCWMPWSSSMRMSMFMEM

SEQ ID NO: 6321 - protein, 243 aa, Homo sapiens
MKLHPPPPSPVTQDHRSKSSHSNWFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKFVDKPGPFVGPCGHWIRPSETLQKYLKVVMALTYEEKPPYAMLRNNLEALLQDLRVSPYDPIGLPMVP

SEQ ID NO: 6322 - protein, 214 aa, Homo sapiens
MSPKPRASGPPAKAKEAGKRKSSSQPSPSDPKKKTTKVAKKGKAVRRGRRGKKGAATKMAAVTAPEAESGPAAPGPSDQPSQELPQHELPPEEPVSEVEEPLSQESQVEEPLSQESEVEEPLSQESQVEEPLSQESEVEEPLSQESQVEEPLSQESEVEEPLSQESQVEEPLSQESEMEEPLSQESQVEEPLSQESEMEEPLSQESEMEELPSV

SEQ ID NO: 6323 - protein, 186 aa, Homo sapiens
MSPKPRASGPPAKAKEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEMEEPLSQESQVEEPLSQESEMEELPSV

SEQ ID NO: 6324 - protein, 216 aa, Homo sapiens
MSPKPRASGPPAKAKEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEVEEPLSQESQVEEPLSQESEMEEPLSQESQVEEPLSQESEMEEPLSQESEMEELPSV

SEQ ID NO: 6325 - protein, 186 aa, Homo sapiens
MSPKPRASGPPAKAKEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEVEEPLSQESEVEEPLSQESEMEELPSV

SEQ ID NO: 6326 - protein, 258 aa, Homo sapiens
MRLSSSPPRGPQQLSSFGSVDWLSQSSCSGPTHTPRPADFSLGSLPGPGQTSGAREPPQAVSIKEAAGSSNLPAPERTMAGLSKEPNTLRAPRVRTAFTMEQVRTLEGVFQHHQYLSPLERKRLAREMQLSEVQIKTWFQNRRMKHKRQMQDPQLHSPFSGSLHAPPAFYSTSSGLANGLQLLCPWAPLSGPQALMLPPGSFWGLCQVAQEALASAGASCCGQPLASHPPTPGRPSLGPALSTGPRGLCAMPQTGDAF

SEQ ID NO: 6327 - protein, 186 aa, Homo sapiens
MFGKPDKMDVRCHSDAEAARVSKNAHKESRESKGAEGNLPAAFLKEPQGAFSASGAAEDCNKSKSNSAADPDYCRRILVRDAKGSIREIILPKGLDLDRPKRTRTSFTAEQLYRLEMEFQRCQYVVGRERTELARQLNLSETQANSEENNERFKRGIKKQKKKRKKEPANDESRRGDSGGRGWQPL

SEQ ID NO: 6328 - protein, 334 aa, Homo sapiens
MFGKPDKMDVRCHSDAEAARVSKNAHKESRESKGAEGNLPAAFLKEPQGAFSASGAAEDCNKSKSNSAADPDYCRRILVRDAKGSIREIILPKGLDLDRPKRTRTSFTAEQLYRLEMEFQRCQYVVGRERTELARQLNLSETQVKVWFQNRRTKQKKDQGKDSELRSVVSETAATCSVLRLLEQGRLLSPPGLPALLPPCATGALGSALRGPSLPALGAGAAAGSAAAAAAAAPGPAGAASPHPPAVGGAPGPGPAGPGGLHAGAPAAGHSLFSLPVPSLLGSVASRLSSAPLTMAGSLAGNLQELSARYLSSSAFEPYSRTNNKEGAEKKALD

SEQ ID NO: 6329 - protein, 236 aa, Homo sapiens
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTDTRTIFVAIFSCISILLLFLSVFIIYRCSQHSSSSEESTKRTSHSKLPEQEAAEADLSNMERVSLSTADPQGVTYAELSTSALSEAASDTTQEPPGSHEYAALKV

SEQ ID NO: 6330 - protein, 148 aa, Homo sapiens
MRKRMGPTRLPRLECSGAITAHCSLDLPGPDKHDELEAPSMKTDTRTIFVAIFSCISILLLFLSVFIIYRCSQHSSSSEESTKRTSHSKLPEQEAAEADLSNMERVSLSTADPQGVTYAELSTSALSEAASDTTQEPPGSHEYAALKV

SEQ ID NO: 6331 - protein, 205 aa, Homo sapiens
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTGSSSEESTKRTSHSKLPEQEAAEADLSNMERVSLSTADPQGVTYAELSTSALSEAASDTTQEPPGSHEYAALKV

SEQ ID NO: 6332 - protein, 143 aa, Homo sapiens
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTVAHVCNTRTLGR

SEQ ID NO: 6333 - protein, 423 aa, Homo sapiens [sequence omitted]

SEQ ID NO: 6334 - protein, 677 aa, Homo sapiens
MAAGGGGSCDPLAPAGVPCAFSPHSQAYFALASTDGHLRVWETANNRLHQEYVPSAHLSGTCTCLAWAPARLQAKESPQRKKRKSEAVGMSNQTDLLALGTAVGSILLYSTVKGELHSKLISGGHDNRVNCIQWHQDSGCLYSCSDDKHIVEWNVQTCKVKCKWKGDNSSVSSLCISPDGKMLLSAGRTIKLWVLETKEVYRHFTGHATPVSSLMFTTIRPPNESQPFDGITGLYFLSGAVHDRLLNVWQVRSENKEKSAVMSFTVTDEPVYIDLTLSENKEEPVKLAVVCRDGQVHLFEHILNGYCKKPLTSNCTIQIATPGKGKKSTPKPIPILAAGFCSDKMSLLLVYGSWFQPTIERVALNSREPHMCLVRDISNCWAPKVETAITKVRTPVMNSEAKVLVPGIPGHHAAIKPAPPQTEQVESKRKSGGNEVSIEERLGAMDIDTHKKGKEDLQTNSFPVLLTQGLESNDFEMLNKVLQTRNVNLIKKTVLRMPLHTIIPLLQELTKRLQGHPNSAVLMVQWLKCVLTVHASYLSTLPDLVPQLGTLYQLMESRVKTFQKLSHLHGKLILLITQVTASEKTKGATSPGQKAKLVYEEESSEEESDDEIADKDSEDNWDEDEEESESEKDEDVEEEDEDAEGKDEENGEDRDTASEKELNGDSDLDPENESEEE

SEQ ID NO: 6335 - protein, 334 aa, Homo sapiens
MATEEKKPETEAARAQPTPSSSATQSKPTPVKPNYALKFTLAGHTKAVSSVKFSPNGEWLASSSADKLIKIWGAYDGKFEKTISGHKLGISDVAWSSDSNLLVSASDDKTLKIWDVSSGKCLKTLKGHSNYVFCCNFNPQSNLIVSGSFDESVRIWDVKTGKCLKTLPAHSDPVSAVHFNRDGSLIVSSSYDGLCRIWDTASGQCLKTLIDDDNPPVSFVKFSPNGKYILAATLDNTLKLWDYSKGKCLKTYTGHKNEKYCIFANFSVTGGKWIVSGSEDNLVYIWNLQTKEIVQKLQGHTDVVISTACHPTENIIASAALENDKTIKLWKSDC

SEQ ID NO: 6336 - protein, 334 aa, Homo sapiens; identical to SEQ ID NO: 6335

SEQ ID NO: 6337 - protein, 385 aa, Homo sapiens
MAAAAARWNHVWVGTETGILKGVNLQRKQAANFTAGGQPRREEAVSALCWGTGGETQMLVGCADRTVKHFSTEDGIFQGQRHCPGGEGMFRGLAQADGTLITCVDSGILRVWHDKDKDTSSDPLLELRVGPGVCRMRQDPAHPHVVATGGKENALKIWDLQGSEEPVFRAKNVRNDWLDLRVPIWDQDIQFLPGSQKLVTCTGYHQVRVYDPASPQRRPVLETTYGEYPLTAMTLTPGGNSVIVGNTHGQLAEIDLRQGRLLGCLKGLAGSVRGLQCHPSKPLLASCGLDRVLRIHRIQNPRGLEHKVYLKSQLNCLLLSGRDNWEDEPQEPQEPNKVPLEDTETDELWASLEAAAKRKLSGLEQPQGALQTRRRKKKRPGSTSP

SEQ ID NO: 6338 - protein, 366 aa, Homo sapiens
MAAAAARWNHVWVGTETGILKGVNLQRKQAANFTAGGQPRREEAVSALCWGTGGETQMLVGCADRTVKHFSTEDGIFQGQRHCPGGEGMFRGLAQADGTLITCVDSGILRVWHDKDKDTSSDPLLELRVGPGVCRMRQDPAHPHVVATGGKENALKIWDLQGSEEPVFRAKNVRNDWLDLRVPIWDQDIQFLPGSQKLVTCTGYHQVRVYDPASPQRRPVLETTYGEYPLTAMTLTPGGNSVIVGNTHGQLAEIDLRQGRLLGCLKGLAGSVRGLQCHPSKPLLASCGLDRVLRIHRIQNPRGLEHKDEPQEPQEPNKVPLEDTETDELWASLEAAAKRKLSGLEQPQGALQTRRRKKKRPGSTSP

SEQ ID NO: 6339 - protein, 385 aa, Homo sapiens; identical to SEQ ID NO: 6337

SEQ ID NO: 6340 - protein, 385 aa, Homo sapiens; identical to SEQ ID NO: 6337

SEQ ID NO: 6341 - protein, 38 aa, Homo sapiens
  MOD_RES (1)..(1): Any amino acid
XWASLEAAAKRKLSGLEQPQGALQTRRRKKKRPGSTSP

SEQ ID NO: 6342 - protein, 57 aa, Homo sapiens
MAAAAARWNHVWVGTETGILKGVNLQRKQAANFTAGGQPRREEAVSALCWGTGGETQ

SEQ ID NO: 6343 - protein, 830 aa, Homo sapiens
MVEEENIRVVRCGGSELNFRRAVFSADSKYIFCVSGDFVKVYSTVTEECVHILHGHRNLVTGIQLNPNNHLQLYSCSLDGTIKLWDYIDGILIKTFIVGCKLHALFTLAQAEDSVFVIVNKEKPDIFQLVSVKLPKSSSQEVEAKELSFVLDYINQSPKCIAFGNEGVYVAAVREFYLSVYFFKKKTTSRFTLSSSRNKKHAKNNFTCVACHPTEDCIASGHMDGKIRLWRNFYDDKKYTYTCLHWHHDMVMDLAFSVTGTSLLSGGRESVLVEWRDATEKNKEFLPRLGATIEHISVSPAGDLFCTSHSDNKIIIIHRNLEASAVIQGLVKDRSIFTGLMIDPRTKALVLNGKPGHLQFYSLQSDKQLYNLDIIQQEYINDYGLIQIELTKAAFGCFGNWLATVEQRQEKETELELQMKLWMYNKKTQGFILNTKINMPHEDCITALCFCNAEKSEQPTLVTASKDGYFKVWILTDDSDIYKKAVGWTCDFVGSYHKYQATNCCFSEDGSLLAVSFEEIVTIWDSVTWELKCTFCQRAGKIRHLCFGRLTCSKYLLGATENGILCCWNLLSCALEWNAKLNVRVMEPDPNSENIAAISQSSVGSDLFVFKPSEPRPLYIQKGISREKVQWGVFVPRDVPESFTSEAYQWLNRSQFYFLTKSQSLLTFSTKSPEEKLTPTSKQLLAEESLPTTPFYFILGKHRQQQDEKLNETLENELVQLPLTENIPAISELLHTPAHVLPSAAFLCSMFVNSLLLSKETKSAKEIPEDVDMEEEKESEDSDEENDFTEKVQDTSNTGLGEDIIHQLSKSEEKELRKFRKIDYSWIAAL

SEQ ID NO: 6344 - protein, 384 aa, Homo sapiens
MVKLIHTLADHGDDVNCCAFSFSLLATCSLDKTIRLYSLRDFTELPHSPLKFHTYAVHCCCFSPSGHILASCSTDGTTVLWNTENGQMLAVMEQPSGSPVRVCQFSPDSTCLASGAADGTVVLWNAQSYKLYRCGSVKDGSLAACAFSPNGSFFVTGSSCGDLTVWDDKMRCPHSEKAHDLGITCCDFSSQPVSDGEQGLQFFRLASCGQDCQVKIWIVSFTHILARRTEHQLKQFTEDWSEEDVSTWLCAQDLKDLVGIFKMNNIDGKELLNLTKESLADDLKIESLGLRSKVLRKIEELRTKVKSLSSGIPDEFICPITRELMKDPVIASDGYSYEKEAMENWISKKKRTSPMTNLVLPSAVLTPNRTLKMAINRWLETHQK

SEQ ID NO: 6345 - protein, 476 aa, Homo sapiens
MVKLIHTLADHGDDVNCCAFSFSLLATCSLDKTIRLYSLRDFTELPHSPLKFHTYAVHCCCFSPSGHILASCSTDGTTVLWNTENGQMLAVMEQPSGSPVRVCQFSPDSTCLASGAADGTVVLWNAQSYKLYRCGSVKDGSLAACAFSPNGSFFVTGSSCGDLTVWDDKMRCPHSEKAHDLGITCCDFSSQPVSDGEQGLQFFRLASCGQDCQVKIWIVSFTHILGFELKYKSTLSGHCAPVLACAFSHDGQMLVSGSVDKSVIVYDTNTENILHTLTQHTRYVTTCAFAPNTLLLATGSMDKTVNIWQFDLETLCQARRTEHQLKQFTEDWSEEDVSTWLCAQDLKDLVGIFKMNNIDGKELLNLTKESLADDLKIESLGLRSKVLRKIEELRTKVKSLSSGIPDEFICPITRELMKDPVIASDGYSYEKEAMENWISKKKRTSPMTNLVLPSAVLTPNRTLKMAINRWLETHQK

SEQ ID NO: 6346 - protein, 476 aa, Homo sapiens; identical to SEQ ID NO: 6345

SEQ ID NO: 6347 - protein, 476 aa, Homo sapiens; identical to SEQ ID NO: 6345

SEQ ID NO: 6348 - protein, 794 aa, Homo sapiens
MEGSLAGSLAAPDRPQGPERLPGPAPRENIEGGAEAAEGEGGIFRSTRYLPVTKEGPRDILDGRGGISVANFDPGTFSLMRCDFCGAGFDTRAGLSSHARAHLRDFGITNWELTVSPINILQELLATSAAEQPPSPLGREPGGPPGSFLTSRRPRLPLTVPFPPTWAEDPGPAYGDASGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 6349 - protein, 1651 aa, Homo sapiens
MEGSLAGSLAAPDRPQGPERLPGPAPRENIEGGAEAAEGEGGIFRSTRYLPVTKEGPRDILDGRGGISGTPDGRGPWEHPLVQEAGEGILSERRFEDSVIVRTMKPHAELEGSRRFLHHRGEPRLLEKHAQGRPRFDWLQDEDEQGSPQDAGLHLDLPAQPPPLAPFRRVFVPVEDTPKTLDMAVVGGREDLEDLEGLAQPSEWGLPTSASEVATQTWTVNSEASVERLQPLLPPIRTGPYLCELLEEVAEGVASPDEDEDEEPAVFPCIECSIYFKQKEHLLEHMSQHRRAPGQEPPADLAPLACGECGWAFADPTALEQHRQLHQASREKIIEEIQKLKQVPGDEGREARLQCPKCVFGTNSSRAYVQHAKLHMREPPGQTTKEPFGGSSGAGSPSPEASALLYQPYGAAVGLSACVFCGFPAPSESLLREHVRLVHAHPHWEEDGEAYEEDPASQPGTSQDAHACFPDTAVDYFGKAEPSLAPMWRENPAGYDPSLAFGPGCQQLSIRDFPLSKPLLHGTGQRPLGRLAFPSTLASTPYSLQLGRNKSTVHPQGLGERRRPWSEEEEEEEEEEDVVLTSEMDFSPENGVFSPLATPSLIPQAALELKQAFREALQAVEATQGQQQQLRGMVPIVLVAKLGPQVMAAARVPPRLQPEELGLAGAHPLDFLLLDAPLGGPLGLDTLLDGDPAMALKHEERKCPYCPDRFHNGIGLANHVRGHLNRVGVSYNVRHFISAEEVKAIERRFSFQKKKKKVANFDPGTFSLMRCDFCGAGFDTRAGLSSHARAHLRDFGITNWELTVSPINILQELLATSAAEQPPSPLGREPGGPPGSFLTSRRPRLPLTVPFPPTWAEDPGPAYGDAQSLTTCEVCGACFETRKGLSSHARSHLRQLGVAESESSGAPIDLLYELVKQKGLPDAHLGLPPGLAKKSSSLKEVVAGAPRPGLLSLAKPLDAPAVNKAIKSPPGFSAKGLGHPPSSPLLKKTPLALAGSPTPKNPEDKSPQLSLSPRPASPKAQWPQSEDEGPLNLTSGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 6350 - protein, 835 aa, Homo sapiens
MVAMDLGSPSLPKKSLPVPGALEQVASRLSSKVAAEVPHGSKQELQDLKAQSLTTCEVCGACFETRKGLSSHARSHLRQLGVAESESSGAPIDLLYELVKQKGLPDAHLGLPPGLAKKSSSLKEVVAGAPRPGLLSLAKPLDAPAVNKAIKSPPGFSAKGLGHPPSSPLLKKTPLALAGSPTPKNPEDKSPQLSLSPRPASPKAQWPQSEDEGPLNLTSGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 6351 - protein, 965 aa, Homo sapiens
MDLGSPSLPKKSLPVPGALEQVASRLSSKVAAEVPHGSKQELQDLKAQSLTTCEVCGACFETRKGLSSHARSHLRQLGVAESESSGAPIDLLYELVKQKGLPDAHLGLPPGLAKKSSSLKEVVAGAPRPGLLSLAKPLDAPAVNKAIKSPPGFSAKGLGHPPSSPLLKKTPLALAGSPTPKNPEDKSPQLSLSPRPASPKAQWPQSEDEGPLNLTLDSDGGRELDCQLCGAWFETRKGLSSHARAHLRHLGVSDPDAKGSPIDVLHGLIRRDGVQIRLPPRRGALAHPGRPPPTSAALSLLPPPPPAKKAKLKAAGMASPWGKQDLSAAAAAGIFWASDVEPSPLNLSSGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 6352 - protein, 281 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLEKKERHRRQGREVRPDTQYTGRKRKPRF

SEQ ID NO: 6353 - protein, 123 aa, Homo sapiens
MADPQSCFMTRQKPGNTFASEGSLNTAGRPGVGKRQVAPVAGVARKGRRIWGSRMIDIQTRMAGRALELLYLPENKPCYLLDIGCGTGLSGSYLSDEGHYWVGLDISPAMLGPGIPSCPAAVP

SEQ ID NO: 6354 - protein, 298 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNEREGGAFERRGIRGHQTRRFPLRMSRRGMVRKSRAWVLEKKERHRRQGREVRPDTQYTGRKRKPRF

SEQ ID NO: 6355 - protein, 376 aa, Homo sapiens
MADYWKSQPKKFCDYCKCWIADNRPSVEFHERGKNHKENVAKRISEIKQKSLDKAKEEEKASKEFAAMEAAALKAYQEDLKRLGLESEILEPSITPVTSTIPPTSTSNQQKEKKEKKKRKKDPSKGRWVEGITSEGYHYYYDLISGASQWEKPEGFQGDLKKTAVKTVWVEGLSEDGFTYYYNTETGESRWEKPDDFIPHTSDLPSSKVNENSLGTLDESKSSDSHSDSDGEQEAEEGGVSTETEKPKIKFKEKNKNSDGGSDPETQKEKSIQKQNSLGSNEEKSKTLKKSNPYGEWQEIKQEVESHEEVDLELPSTENEYVSTSEADGGGEPKVVFKEKTVTSLGVMADGVAPVFKKRRTENGKSRNLRQRGDDQ

SEQ ID NO: 6356 - protein, 355 aa, Homo sapiens
MADYWKSQPKKFCDYCKCWIADNRPIKQKSLDKAKEEEKASKEFAAMEAAALKAYQEDLKRLGLESEILEPSITPVTSTIPPTSTSNQQKEKKEKKKRKKDPSKGRWVEGITSEGYHYYYDLISGASQWEKPEGFQGDLKKTAVKTVWVEGLSEDGFTYYYNTETGESRWEKPDDFIPHTSDLPSSKVNENSLGTLDESKSSDSHSDSDGEQEAEEGGVSTETEKPKIKFKEKNKNSDGGSDPETQKEKSIQKQNSLGSNEEKSKTLKKSNPYGEWQEIKQEVESHEEVDLELPSTENEYVSTSEADGGGEPKVVFKEKTVTSLGVMADGVAPVFKKRRTENGKSRNLRQRGDDQ

SEQ ID NO: 6357 - protein, 117 aa, Homo sapiens
MSLTSDASSPRSYVSPRISTPQTNTVPIKPLISTPPVSSQPKVSTPVVKQGPVSQSATQQPVTADKSKVMNLSLLEVFSAQVAREVHHLVPIILLIVVMHQMQQLYHRILLPDPRVH

SEQ ID NO: 6358 - protein, 544 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGKSTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 6359 - protein, 647 aa, Homo sapiens
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 6360 - protein, 602 aa, Homo sapiens
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 6361 - protein, 233 aa, Homo sapiens
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKK

SEQ ID NO: 6362 - protein, 204 aa, Homo sapiens
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHP

SEQ ID NO: 6363 - protein, 347 aa, Homo sapiens
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTA

SEQ ID NO: 6364 - protein, 436 aa, Homo sapiens
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQDIPLHEGIQMERDTHRSKWEVKGSLCQKADKQQECLVWNGSIMVQRLLQPSG

SEQ ID NO: 6365 - protein, 173 aa, Homo sapiens
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQ

SEQ ID NO: 6366 - protein, 59 aa, Homo sapiens
MRDAGDPSPPNKMLRRSDSPENKYSDSTGHSKAKNVHTHRVRERDGGTSYSPQENSHNH

SEQ ID NO: 6367 - protein, 36 aa, Homo sapiens
MRDAGDPSPPNKMLRRSDSPENKYSDSTGHSKAKNV

SEQ ID NO: 6368 - protein, 301 aa, Homo sapiens [sequence omitted]

SEQ ID NO: 6369 - protein, 1822 aa, Homo sapiens [sequence omitted]

SEQ ID NO: 6370 - protein, 2146 aa, Homo sapiens
MYPNWGRYGGSSHYPPPPVPPPPPVALPEASPGPGYSSSTTPAAPSSSGFMSFREQHLAQLQQLQQMHQKQMQCVLQPHHLPPPPLPPPPVMPGGGYGDWQPPPPPMPPPPGPALSYQKQQQYKHQMLHHQRDGPPGLVPMELESPPESPPVPPGSYMPPSQSYMPPPQPPPSYYPPTSSQPYLPPAQPSPSQSPPSQSYLAPTPSYSSSSSSSQSYLSHSQSYLPSSQASPSRPSQGHSKSQLLAPPPPSAPPGNKTTVQQEPLESGAKNKSTEQQQAAPEPDPSTMTPQEQQQYWYRQHLLSLQQRTKVHLPGHKKGPVVAKDTPEPVKEEVTVPATSQVPESPSSEEPPLPPPNEEVPPPLPPEEPQSEDPEEDARLKQLQAAAAHWQQHQQHRVGFQYQGIMQKHTQLQQILQQYQQIIQPPPHIQTMSVDMQLRHYEMQQQQFQHLYQEWEREFQLWEEQLHSYPHKDQLQEYEKQWKTWQGHMKATQSYLQEKVNSFQNMKNQYMGNMSMPPPFVPYSQMPPPLPTMPPPVLPPSLPPPVMPPALPATVPPPGMPPPVMPPSLPTSVPPPGMPPSLSSAGPPPVLPPPSLSSAGPPPVLPPPSLSSTAPPPVMPLPPLSSATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRGPGLVKQEDFRDKMMGRREDSREKMNRGEGSRDRGLVRPGSSREKVPGGLQGSQDRGAAGSRERGPPRRAGSQERGPLRRAGSRERIPPRRAGSRERGPPRGPGSRERGLGRSDFGRDRGPFRPEPGDGGEKMYPYHRDEPPRAPWNHGEERGHEEFPLDGRNAPMERERLDDWDRERYWRECERDYQDDTLELYNREDRFSAPPSRSHDGDRRGPWWDDWERDQDMDEDYNREMERDMDRDVDRISRPMDMYDRSLDNEWDRDYGRPLDEQESQFRERDIPSLPPLPPLPPLPPLDRYRDDRWREERNREHGYDRDFRDRGELRIREYPERGDTWREKRDYVPDRMDWERERLSDRWYPSDVDRHSPMAEHMPSSHHSSEMMGSDASLDSDQGLGGVMVLSQRQHEIILKAAQELKMLREQKEQLQKMKDFGSEPQMADHLPPQESRLQNTSSRPGMYPPPGSYRPPPPMGKPPGSIVRPSAPPARSSVPVTRPPVPIPPPPPPPPLPPPPPVIKPQTSAVEQERWDEDSFYGLWDTNDEQGLNSEFKSETAAIPSAPVLPPPPVHSSIPPPGPVPMGMPPMSKPPPVQQTVDYGHGRDISTNKVEQIPYGERITLRPDPLPERSTFETEHAGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEVYLAEMSADNQTCGKRNIHGRKLKEINKMADHWETAPRHMMRLDIRSLLQDAAIEEVEMEDFDANIEEQKEEKKDAEEEESELGYIPKSKWEMDTSEAKLDKLDGLRTGTKRKRDWEAIASRMEDYLQLPDDYDTRASEPGKKRVRWADLEEKKDADRKRAIGFVVGQTDWEKITDESGHLAEKALNRTKYI

SEQ ID NO: 6371 - protein, 1854 aa, Homo sapiens
MTPQEQQQYWYRQHLLSLQQRTKVHLPGHKKGPVVAKDTPEPVKEEVTVPATSQVPESPSSEEPPLPPPNEEVPPPLPPEEPQSEDPEEDARLKQLQAAAAHWQQHQQHRVGFQYQGIMQKHTQLQQILQQYQQIIQPPPHIQTMSVDMQLRHYEMQQQQFQHLYQEWEREFQLWEEQLHSYPHKDQLQEYEKQWKTWQGHMKATQSYLQEKVNSFQNMKNQYMGNMSMPPPFVPYSQMPPPLPTMPPPVLPPSLPPPVMPPALPATVPPPGMPPPVMPPSLPTSVPPPGMPPSLSSAGPPPVLPPPSLSSAGPPPVLPPPSLSSTAPPPVMPLPPLSSATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRGPGLVKQEDFRDKMMGRREDSREKMNRGEGSRDRGLVRPGSSREKVPGGLQGSQDRGAAGSRERGPPRRAGSQERGPLRRAGSRERIPPRRAGSRERGPPRGPGSRERGLGRSDFGRDRGPFRPEPGDGGEKMYPYHRDEPPRAPWNHGEERGHEEFPLDGRNAPMERERLDDWDRERYWRECERDYQDDTLELYNREDRFSAPPSRSHDGDRRGPWWDDWERDQDMDEDYNREMERDMDRDVDRISRPMDMYDRSLDNEWDRDYGRPLDEQESQFRERDIPSLPPLPPLPPLPPLDRYRDDRWREERNREHGYDRDFRDRGELRIREYPERGDTWREKRDYVPDRMDWERERLSDRWYPSDVDRHSPMAEHMPSSHHSSEMMGSDASLDSDQGLGGVMVLSQRQHEIILKAAQELKMLREQKEQLQKMKDFGSEPQMADHLPPQESRLQNTSSRPGMYPPPGSYRPPPPMGKPPGSIVRPSAPPARSSVPVTRPPVPIPPPPPPPPLPPPPPVIKPQTSAVEQERWDEDSFYGLWDTNDEQGLNSEFKSETAAIPSAPVLPPPPVHSSIPPPGPVPMGMPPMSKPPPVQQTVDYGHGRDISTNKVEQIPYGERITLRPDPLPERSTFETEHAGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEVYLAEMSADNQTCGKRNIHGRKLKEINKMADHWETAPRHMMRLDIRSLLQDAAIEEVEMEDFDANIEEQKEEKKDAEEEESELGYIPKSKWEMDTSEAKLDKLDGLRTGTKRKRDWEAIASRMEDYLQLPDDYDTRASEPPRPRGASLCVTLLPRFSSCFVSTALVFFKVLQCPQEVLESCCTQARR

SEQ ID NO: 6372 - protein, 727 aa, Homo sapiens
MAADSREEKDGELNVLDDILTEVPEQDDELYNPESEQDKNEKKGSKRKSDRMESTDTKRQKPSVHSRQLVSKPLSSSVSNNKRIVSTKGKSATEYKNEEYQRSERNKRLDADRKIRLSSSASREPYKNQPEKTCVRKRDPERRAKSPTPDGSERIGLEVDRRASRSSQSSKEEVNSEEYGSDHETGSSGSSDEQGNNTENEEEGVEEDVEEDEEVEEDAEEDEEVDEDGEEEEEEEEEEEEEEEEEEEEYEQDERDQKEEGNDYDTRSEASDSGSESVSFTDGSVRSGSGTDGSDEKKKERKRARGISPIVFDRSGSSASESYAGSEKKHEKLSSSVRAVRKDQTSKLKYVLQDARFFLIKSNNHENVSLAKAKGVWSTLPVNEKKLNLAFRSARSVILIFSVRESGKFQGFARLSSESHHGGSPIHWVLPAGMSAKMLGGVFKIDWICRRELPFTKSAHLTNPWNEHKPVKIGRDGQEIELECGTQLCLLFPPDESIDLYQVIHKMRHKRRMHSQPRSRGRPSRREPVRDVGRRRPEDYDIHNSRKKPRIDYPPEFHQRPGYLKDPRYQEVDRRFSGVRRDVFLNGSYNDYVREFHNMGPPPPWQGMPPYPGMEQPPHHPYYQHHAPPPQAHPPYSGHHPVPHEARYRDKRVHDYDMRVDDFLRRTQAVVSGRRSRPRERDRERERDRPRDNRRDRERDRGRDRERERERLCDRDRDRGERGRYRR

SEQ ID NO: 6373 - protein, 709 aa, Homo sapiens
MAADSREEKDGELNVLDDILTEVPEQDDELYNPESEQDKNEKKGSKRKSDRMESTDTKRQKPSVHSRQLVSKPLSSSVSNNKRIVSTKGKSATEYKNEEYQRSERNKRLDADRKIRLSSSASREPYKNQPEKTCVRKRDPERRAKSPTPDGSERIGLEVDRRASRSSQSSKEEVNSEEYGSDHETGSSGSSDEQGNNTENEEEGVEEDVEEDEEVEEDAEEDEEVDEDGEEEEEEEEEEEEEEEEEEEEYEQDERDQKEEGNDYDTRSEASDSGSESVSFTDGSVRSGSGTDGSDEKKKERKRARGISPIVFDRSGSSASESYADQTSKLKYVLQDARFFLIKSNNHENVSLAKAKGVWSTLPVNEKKLNLAFRSARSVILIFSVRESGKFQGFARLSSESHHGGSPIHWVLPAGMSAKMLGGVFKIDWICRRELPFTKSAHLTNPWNEHKPVKIGRDGQEIELECGTQLCLLFPPDESIDLYQVIHKMRHKRRMHSQPRSRGRPSRREPVRDVGRRRPEDYDIHNSRKKPRIDYPPEFHQRPGYLKDPRYQEVDRRFSGVRRDVFLNGSYNDYVREFHNMGPPPPWQGMPPYPGMEQPPHHPYYQHHAPPPQAHPPYSGHHPVPHEARYRDKRVHDYDMRVDDFLRRTQAVVSGRRSRPRERDRERERDRPRDNRRDRERDRGRDRERERERLCDRDRDRGERGRYRR

SEQ ID NO: 6374 - protein, 709 aa, Homo sapiens; identical to SEQ ID NO: 6373

SEQ ID NO: 6375 - protein, 727 aa, Homo sapiens; identical to SEQ ID NO: 6372

SEQ ID NO: 6376 - protein, 663 aa, Homo sapiens
MFLKAGRGNKVPPVRVYGPDCVVLMEPPLSKRNPPALRLADLATAQVQPLQNMTGFPALAGPPAHSQLRAAVAHLRLRDLGADPGVATTPLGPEHMAQASTLGLSPPSQAFPAHPEAPAAAARAAALVAHPGAGSYPCGGGSSGAQPSAPPPPAPPLPPTPSPPPPPPPPPPPALSGYTTTNSGGGGSSGKGHSRDFVLRRDLSATAPAAAMHGAPLGGEQRSGTGSPQHPAPPPHSAGMFISASGTYAGPDGSGGPALFPALHDTPGAPGGHPHPLNGQMRLGLAAAAAAAAAELYGRAEPPFAPRSGDAHYGAVAAAAAAALHGYGAVNLNLNLAAAAAAAAAGPGPHLQHHAPPPAPPPPPAPAQHPHQHHPHLPGAAGAFLRYMRQPIKQELICKWIDPDELAGLPPPPPPPPPPPPPPPAGGAKPCSKTFGTMHELVNHVTVEHVGGPEQSSHVCFWEDCPREGKPFKAKYKLINHIRVHTGEKPFPCPFPGCGKVFARSENLKIHKRTHTGEKPFKCEFDGCDRKFANSSDRKKHSHVHTSDKPYYCKIRGCDKSYTHPSSLRKHMKIHCKSPPPSPGPLGYSSVGTPVGAPLSPVLDPARSHSSTLSPQVTNLNEWYVCQASGAPSHLHTPSSNGTTSETEDEEIYGNPEVVRTIH

SEQ ID NO: 6377 - protein, 217 aa, Homo sapiens
AAAALHGYGAVNLNLNLAAAAAAAHPHQHHPHLPGAAGAFLRYMRQPIKQELICKWIDPDELAGRAKPCSKTFGTMHELVNHVTVEHVGGPEQSSHVCFWEDCPREGKPFKAKYKLINHIRVHTGEKPFPCPFPGCGKVFARSENLKIHKRTHTGEKPFKCEFDGCDRKFANSSDRKKHSHVHTSDKPYYCKIRGCDKSYTHPSSLRKHMKIHCKSP

SEQ ID NO: 6378 - protein, 1231 aa, Homo sapiens
MCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 6379 - protein, 644 aa, Homo sapiens
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSASSKQNSKMIFGVRMYEDTVARNGNEANRWCAEPSSTVNTPHNREADEESLQLGNFPEPLFDVCKKSSVSKLSTPKERVSRRFGRSFTCDSCGFGFSCEKLLDEHVLTCTNRHLYQNTRSYHRIVDIRDGKDSNIKAEFGEKDSSKTFSAQTDKYRGDTSQAADDSASTTGSRKSSTVESEIASEEKSRAAERKRIIIKMEPEDIPTDELKDFNIIKVTDKDCNESTDNDELEDEPEEPFYRYYVEEDVSIKKSGRKTLKPRMSVSADERGGLENMRPPNNSSPVQEDAENASCELCGLTITEEDLSSHYLAKHIENICACGKCGQILVKGRQLQEHAQRCGEPQDLTMNGLGNTEEKMDLEENPDEQSEIRDMFVEMLDDFRDNHYQINSIQKKQLFKHSACPFRCPNCGQRFETENLVVEHMSSCLDQDMFKSAIMEENERDHRRKHFCNLCGKGFYQRCHLREHYTVHTKEKQFVCQTCGKQFLRERQLRLHNDMHKGMASGEIGPSKPVEK

SEQ ID NO: 6380 - protein, 713 aa, Homo sapiens
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSASSKQNSKMIFGVRMYEDTVARNGNEANRWCAEPSSTVNTPHNREADEESLQLGNFPEPLFDVCKKSSVSKLSTPKERVSRRFGRSFTCDSCGFGFSCEKLLDEHVLTCTNRHLYQNTRSYHRIVDIRDGKDSNIKAEFGEKDSSKTFSAQTDKYRGDTSQAADDSASTTGSRKSSTVESEIASEEKSRAAERKRIIIKMEPEDIPTDELKDFNIIKVTDKDCNESTDNDELEDEPEEPFYRYYVEEDVSIKKSGRKTLKPRMSVSADERGGLENMRPPNNSSPVQEDAENASCELCGLTITEEDLSSHYLAKHIENICACGKCGQILVKGRQLQEHAQRCGEPQDLTMNGLGNTEEKMDLEENPDEQSEIRDMFVEMLDDFRDNHYQINSIQKKQLFKHSACPFRCPNCGQRFETENLVVEHMSSCLDQDMFKSAIMEENERDHRRKHFCNLCGKGFYQRCHLREHYTVHTKEKQFVCQTCGKQFLRERQLRLHNDMHKGMARYVCSICDQGNFRKHDHVRHMISHLSAGETICQVCFQIFPNNEQLEQHMDVHLYTCGICGAKFNLRKDMRSHYNAKHLKRT

SEQ ID NO: 6381 - protein, 155 aa, Homo sapiens
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSASSKQNSKMIFGVRMYEDTVARNGNE

SEQ ID NO: 6382 - protein, 713 aa, Homo sapiens; identical to SEQ ID NO: 6380

SEQ ID NO: 6383 - protein, 34 aa, Homo sapiens
MAKPSHSSYVLQQLNNQREWGFLCDCCIAIDDIY

SEQ ID NO: 6384 - protein, 130 aa, Homo sapiens
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSA

SEQ ID NO: 6385 - protein, 579 aa, Homo sapiens
MTRLERSSHRTVICKVPGELVAREGKCASRARESEIPSEEGYCDFNSRPNENSYCYQLLRQLNEQRKKGILCDVSIVVSGKIFKAHKNILVAGSRFFKTLYCFSNKESPNQNNTTHLDIAAVQGFSVILDFLYSGNLVLTSQNAIEVMTVASYLQMSEVVQTCRNFIKDALNISIKSEAPESVVVDYNNRKPVNRDGLSSSRDQKIASFWATRNLTNLASNVKIENDGCNVDEGQIENYQMNDSSWVQDGSPEMAENESEGQTKVFIWNNMGSQGIQETGKTRRKNQTTKRFIYNIPPNNETNLEDCSVMQPPVAYPEENTLLIKEEPDLDGALLSGPDGDRNVNANLLAEAGTSQDGGDAGTSHDFKYGLMPGPSNDFKYGLIPGTSNDFKYGLIPGASNDFKYGLLPESWPKQETWENGESSLIMNKLKCPHCSYVAKYRRTLKRHLLIHTGVRSFSCDICGKLFTRREHVKRHSLVHKKDKKYKCMVCKKIFMLAASVGIRHGSRRYGVCVDCADKSQPGGQEGVDQGQDTEFPRDEEYEENEVGEADEELVDDGEDQNDPSRWDESGEVCMSLDD

SEQ ID NO: 6386 - protein, 871 aa, Homo sapiens
MSFSEMNRRTLAFRGGGLVTASGGGSTNNNAGGEASAWPPQPQPRQPPPPAPPALQPPNGRGADEEVELEGLEPQDLEASAGPAAGAAEEAKELLLPQDAGGPTSLGGGAGGPLLAERNRRTLAFRGGGGGGLGNNGSSRGRPETSVWPLRHFNGRGPATVDLELDALEGKELMQDGASLSDSTEDEEEGASLGDGSGAEGGSCSSSRRSGGDGGDEVEGSGVGAGEGETVQHFPLARPKSLMQKLQCSFQTSWLKDFPWLRYSKDTGLMSCGWCQKTPADGGSVDLPPVGHDELSRGTRNYKKTLLLRHHVSTEHKLHEANAQESEIPSEEGYCDFNSRPNENSYCYQLLRQLNEQRKKGILCDVSIVVSGKIFKAHKNILVAGSRFFKTLYCFSNKESPNQNNTTHLDIAAVQGFSVILDFLYSGNLVLTSQNAIEVMTVASYLQMSEVVQTCRNFIKDALNISIKSEAPESVVVDYNNRKPVNRDGLSSSRDQKIASFWATRNLTNLASNVKIENDGCNVDEGQIENYQMNDSSWVQDGSPEMAENESEGQTKVFIWNNMGSQGIQETGKTRRKNQTTKRFIYNIPPNNETNLEDCSVMQPPVAYPEENTLLIKEEPDLDGALLSGPDGDRNVNANLLAEAGTSQDGGDAGTSHDFKYGLMPGPSNDFKYGLIPGTSNDFKYGLIPGASNDFKYGLLPESWPKQETWENGESSLIMNKLKCPHCSYVAKYRRTLKRHLLIHTGVRSFSCDICGKLFTRREHVKRHSLVHKKDKKYKCMVCKKIFMLAASVGIRHGSRRYGVCVDCADKSQPGGQEGVDQGQDTEFPRDEEYEENEVGEADEELVDDGEDQNDPSRWDESGEVCMSLDD

SEQ ID NO: 6387 - protein, 871 aa, Homo sapiens; identical to SEQ ID NO: 6386

SEQ ID NO: 6388 - protein, 847 aa, Homo sapiens
MSFSEMNRRTLAFRGGGLVTASGGGSTNNNAGGEASAWPPQPQPRQPPPPAPPALQPPNGRGADEEVELEGLEPQDLEASAGPAAGAAEEAKELLLPQDAGGPTSLGGGAGGPLLAERNRRTLAFRGGGGGGLGNNGSSRGRPETSVWPLRHFNGRGPATVDLELDALEGKELMQDGASLSDSTEDEEEGASLGDGSGAEGGSCSSSRRSGGDGGDEVEGSGVGAGEGETVQHFPLARPKSLMQKLQCSFQTSWLKDFPWLRYSKDTGLMSCGWCQKTPADGGSVDLPPVGHDELSRGTRNYKKTLLLRHHVSTEHKLHEANAQESEIPSEEGYCDFNSRPNENSYCYQLLRQLNEQRKKGILCDVSIVVSGKIFKAHKNILVAGSRFFKTLYCFSNKESPNQNNTTHLDIAAVQGFSVILDFLYSGNLVLTSQNAIEVMTVASYLQMSEVVQTCRNFIKDALNISIKSEAPESVVVDYNNRKPVNRDGLSSSRDQKIASFWATRNLTNLASNVKIENDGCNVDEGQIENYQMNDSSWVQDGSPEMAENESEGQTKVFIWNNMGSQGIQETGKTRRKNQTTKRFIYNIPPNNETNLEDCSVMQPPVAYPEENTLLIKEEPDLDGALLSGPDGDRNVNANLLAEAGTSQDGGDAGTSHDFKYGLMPGASNDFKYGLLPESWPKQETWENGESSLIMNKLKCPHCSYVAKYRRTLKRHLLIHTGVRSFSCDICGKLFTRREHVKRHSLVHKKDKKYKCMVCKKIFMLAASVGIRHGSRRYGVCVDCADKSQPGGQEGVDQGQDTEFPRDEEYEENEVGEADEELVDDGEDQNDPSRWDESGEVCMSLDD

SEQ ID NO: 6389 - protein, 1053 aa, Homo sapiens
MSSEESYRAILRYLTNEREPYAPGTEGNVKRKIRKAAACYVVRGGTLYYQRRQRHRKTFAELEVVLQPERRRDLIEAAHLGPGGTHHTRHQTWHYLSKTYWWRGILKQVKDYIKQCSKCQEKLDRSRPISDVSEMLEELGLDLESGEESNESEDDLSNFTSSPTTASKPAKKKPVSKHELVFVDTKGVVKRSSPKHCQAVLKQLNEQRLSNQFCDVTLLIEGEEYKAHKSVLSANSEYFRDLFIEKGAVSSHEAVVDLSGFCKASFLPLLEFAYTSVLSFDFCSMADVAILARHLFMSEVLEICESVHKLMEEKQLTVYKKGEVQTVASTQDLRVQNGGTAPPVASSEGTTTSLPTELGDCEIVLLVNGELPEAEQNGEVGRQPEPQVSSEAESALSSVGCIADSHPEMESVDLITKNNQTELETSNNRENNTVSNIHPKLSKENVISSSPEDSGMGNDISAEDICAEDIPKHRQKVDQPLKDQENLVASTAKTDFGPDDDTYRSRLRQRSVNEGAYIRLHKGMEKKLQKRKAVPKSAVQQVAQKLVQRGKKMKQPKRDAKENTEEASHKCGECGMVFQRRYALIMHKLKHERARDYKCPLCKKQFQYSASLRAHLIRHTRKDAPSSSSSNSTSNEASGTSSEKGRTKREFICSICGRTLPKLYSLRIHMLKHTGVKPHACQVCGKTFIYKHGLKLHQSLHQSQKQFQCELCVKSFVTKRSLQEHMSIHTGESKYLCSVCGKSFHRGSGLSKHFKKHQPKPEVRGYHCTQCEKSFFEARDLRQHMNKHLGVKPFQCQFCDKCYSWKKDWYSHVKSHSVTEPYRCNICGKEFYEKALFRRHVKKATHGKKGRAKQNLERVCEKCGRKFTQLREYRRHMNNHEGVKPFECLTCGVAWADARSLKRHVRTHTGERPYVCPVCSEAYIDARTLRKHMTKFHRDYVPCKIMLEKDTLQFHNQGTQVAHAVSILTAGMQEQESSGPQELETVVVTGETMEALEAVAATEEYPSVSTLSDQSIMQVVNYVLAQQQGQKLSEVAEAIQTVKVEVAHISGGE

SEQ ID NO: 6390 - protein, 459 aa, Homo sapiens
MASGVEVLRFQLPGHEAATLRNMNQLRAEERFCDVTIVADSLKFRGHKVILAACSPFLRDQFLLNPSSELQVSLMHSARIVADLLLSCYTGALEFAVRDIVNYLTAASYLQMEHVVEKCRNALSQFIEPKIGLKEDGVSEASLVSSISATKSLLPPARTPKPAPKPPPPPPLPPPLLRPVKLEFPLDEDLELKAEEEDEDEDEDVSDICIVKVESALEVAHRLKPPGGLGGGLGIGGSVGGHLGELAQSSVPPSTVAPPQGVVKACYSLSEDAEGEGLLLIPGGRASVGATSGLVEAAAVAMAARGAGGSLGAGGSRGPLPGGFSGGNPLKNIKCTKCPEVFQGVEKLVFHMRAQHFIFMCPRCGKQFNHSSNLNRHMNVHRGVKSHSCGICGKCFTQKSTLHDHLNLHSGARPYRCSYCDVRFAHKPAIRRHLKEQHGKTTAENVLEASVAEINVLIR

SEQ ID NO: 6391 - protein, 459 aa, Homo sapiens; identical to SEQ ID NO: 6390

SEQ ID NO: 6392 - protein, 459 aa, Homo sapiens; identical to SEQ ID NO: 6390

SEQ ID NO: 6393 - protein, 459 aa, Homo sapiens; identical to SEQ ID NO: 6390

SEQ ID NO: 6394 - protein, 459 aa, Homo sapiens; identical to SEQ ID NO: 6390

SEQ ID NO: 6395 - protein, 514 aa, Homo sapiens
MDLANHGLILLQQLNAQREFGFLCDCTVAIGDVYFKAHKSVLASFSNYFKMLFVHQTSECVRLKPTDIQPDIFSYLLHLMYTGKMAPQLIDPVRLEQGIKFLHAYPLIQEASLASQGAFSHPDQVFPLASSLYGIQIADHQLRQATKIASAPEKLGRDPRPQTSRISQEQVPEASQLSQLTSNLAQVNRTNMTPSDPLQTSLSPELVSTPVPPPPPGEETNLEASSSDEQPASLTIAHVKPSIMKRNGSFPKYYACHLCGRRFTLRSSLREHLQIHTGVPFTSSQQGESRVPLTLCSNAADLGKDAMEVPEAGMISDSELQHISDSPIIDGQQQSETPPPSDIADIDNLEQADQEREVKRRKYECTICGRKFIQKSHWREHMYIHTGKPFKCSTCDKSFCRANQAARHVCLNQSIDTYTMVDKQTLELCTFEEGSQMDNMLVQTNKPYKCNLCDKTFSTPNEVVKHSCQNQNSDVFALDEGRSILLGSGDSEVTEPDHPVLASIKKEQETVLLD

SEQ ID NO: 6396 - protein, 634 aa, Homo sapiens
MEPSPLSPSGAALPLPLSLAPPPLPLPAAAVVHVSFPEVTSALLESLNQQRLQGQLCDVSIRVQGREFRAHRAVLAASSPYFHDQVLLKGMTSISLPSVMDPGAFETVLASAYTGRLSMAAADIVNFLTVGSVLQMWHIVDKCTELLREGRASATTTITTAAATSVTVPGAGVPSGSGGTVAPATMGSARSHASSRASENQSPSSSNYFSPRESTDFSSSSQEAFAASAVGSGERRGGGPVFPAPVVGSGGATSGKLLLEADELCDDGGDGRGAVVPGAGLRRPTYTPPSIMPQKHWVYVKRGGNCPAPTPLVPQDPDLEEEEEEEDLVLTCEDDEDEELGGSSRVPVGGGPEATLSISDVRTLSEPPDKGEEQVNFCESSNDFGPYEGGGPVAGLDDSGGPTPSSYAPSHPPRPLLPLDMQGNQILVFPSSSSSSSSQAPGQPPGNQAEHGAVTVGGTSVGSLGVPGSVGGVPGGTGSGDGNKIFLCHCGKAFSHKSMRDRHVNMHLNLRPFDCPVCNKKFKMKHHLTEHMKTHTGLKPYECGVCAKKFMWRDSFMRHRGHCERRHRLGGVGAVPGPGTPTGPSLPSKRESPGVGGGSGDEASAATPPSSRRVWSPPRVHKVEMGFGGGGGAN

SEQ ID NO: 6397 - protein, 634 aa, Homo sapiens; identical to SEQ ID NO: 6396

SEQ ID NO: 6398 - protein, 149 aa, Homo sapiens
MEPSPLSPSGAALPLPLSLAPPPLPLPAAAVVHVSFPEVTSALLESLNQQRLQGQLCDVSIRVQGREFRAHRAVLAASSPYFHDQVLLKGMTSISLPSVMDPGAFETVLASAYTGRLSMAAADIVNFLTVGSVLQMWHIVDKCTELLRE

SEQ ID NO: 6399 - protein, 149 aa, Homo sapiens; identical to SEQ ID NO: 6398

SEQ ID NO: 6400 - protein, 634 aa, Homo sapiens; identical to SEQ ID NO: 6396

SEQ ID NO: 6401 - protein, 634 aa, Homo sapiens; identical to SEQ ID NO: 6396

SEQ ID NO: 6402 - protein, 441 aa, Homo sapiens
MSERSDLLHFKFENYGDSMLQKMNKLREENKFCDVTVLIDDIEVQGHKIVFAAGSPFLRDQFLLNDSREVKISILQSSEVGRQLLLSCYSGVLEFPEMELVNYLTAASFLQMSHIVERCTQALWKFIKPKQPMDSKEGCEPQSASPQSKEQQGDARGSPKQDSPCIHPSEDSMDMEDSDIQIVKVESIGDVSEVRSKKDQNQFISSEPTALHSSEPQHSLINSTVENRVSEIEQNHLHNYALSYTGSDNIIMASKDVFGPNIRGVDKGLQWHHQCPKCTRVFRHLENYANHLKMHKLFMCLLCGKTFTQKGNLHRHMRVHAGIKPFQCKICGKTFSQKCSLQDHLNLHSGDKPHKCNYCDMVFAHKPVLRKHLKQLHGKNSFDNANERNVQDLTVDFDSFACTTVTDSKGCQPQPDATQVLDAGKLAQAVLNLRNDSTCVN

SEQ ID NO: 6403 - protein, 441 aa, Homo sapiens; identical to SEQ ID NO: 6402

SEQ ID NO: 6404 - protein, 574 aa, Homo sapiens
MLREFSKWGVEASPGKAWERKRSLLRGAVGRYRGATGGDLFWAPFPSWGTMEFPEHSQQLLQSLREQRSQGFLCDCTVMVGSTQFLAHRAVLASCSPFFQLFYKERELDKRDLVCIHNEIVTAPAFGLLLDFMYAGQLTLRGDTPVEDVLAAASYLHMNDIVKVCKRRLQARALAEADSTKKEEETNSQLPSLEFLSSTSRGTQPSLASAETSGHWGKGEWKGSAAPSPTVRPPDEPPMSSGADTTQPGMEVDAPHLRAPHPPVADVSLASPSSSTETIPTNYFSSGISAVSLEPLPSLDVGPESLRVVEPKDPGGPLQGFYPPASAPTSAPAPVSAPVPSQAPAPAEAELVQVKVEAIVISDEETDVSDEQPQGPERAFPSGGAVYGAQPSQPEAFEDPGAAGLEEVGPSDHFLPTDPHLPYHLLPGAGQYHRGLVTSPLPAPASLHEPLYLSSEYEAAPGSFGVFTEDVPTCKTCGKTFSCSYTLRRHATVHTRERPYECRYCLRSYTQSGDLYRHIRKAHNEDLAKRSKPDPEVGPLLGVQPLPGSPTADRQSSSGGGPPKDFVLAPKTNI

SEQ ID NO: 6405 - protein, 503 aa, Homo sapiens
MEKGGNIQLEIPDFSNSVLSHLNQLRMQGRLCDIVVNVQGQAFRAHKVVLAASSPYFRDHMSLNEMSTVSISVIKNPTVFEQLLSFCYTGRICLQLADIISYLTAASFLQMQHIIDKCTQILEGIHFKINVAEVEAELSQTRTKHQERPPESHRVTPNLNRSLSPRHNTPKGNRRGQVSAVLDIRELSPPEESTSPQIIEPSSDVESREPILRINRAGQWYVETGVADRGGRSDDEVRVLGAVHIKTENLEEWLGPENQPSGEDGSSAEEVTAMVIDTTGHGSVGQENYTLGSSGAKVARPTSSEVDRFSPSGSVVPLTERHRARSESPGRMDEPKQPSSQVEESAMMGVSGYVEYLREQEVSERWFRYNPRLTCIYCAKSFNQKGSLDRHMRLHMGITPFVCRMCGKKYTRKDQLEYHIRKHTGNKPFHCHVCGKSFPFQAILNQHFRKNHPGCIPLEGPHSISPETTVTSRGQAEEESPSQEETVAPGEAVQGSVSTTGPD

SEQ ID NO: 6406 - protein, 411 aa, Homo sapiens
MPATGRYHQLPNSCQFSANAAYYRQMYTDPGGHSFKINVAEVEAELSQTRTKHQERPPESHRVTPNLNRSLSPRHNTPKGNRRGQVSAVLDIRELSPPEESTSPQIIEPSSDVESREPILRINRAGQWYVETGVADRGGRSDDEVRVLGAVHIKTENLEEWLGPENQPSGEDGSSAEEVTAMVIDTTGHGSVGQENYTLGSSGAKVARPTSSEVDRFSPSGSVVPLTERHRARSESPGRMDEPKQPSSQVEESAMMGVSGYVEYLREQEVSERWFRYNPRLTCIYCAKSFNQKGSLDRHMRLHMGITPFVCRMCGKKYTRKDQLEYHIRKHTGNKPFHCHVCGKSFPFQAILNQHFRKNHPGCIPLEGPHSISPETTVTSRGQAEEESPSQEETVAPGEAVQGSVSTTGPD

SEQ ID NO: 6407 - protein, 308 aa, Homo sapiens
MEKGGNIQLEIPDFSNSVLSHLNQLRMQGRLCDIVVNVQGQAFRAHKVVLAASSPYFRDHMSLNEMSTVSISVIKNPTVFEQLLSFCYTGRICLQLADIISYLTAASFLQMQHIIDKCTQILEGIHFKINVAEVEAELSQTRTKHQERPPESHRVTPNLNRSLSPRHNTPKGNRRGQVSAVLDIRELSPPEESTSPQIIEPSSDVESREPILRINRAGQWYVETGVADRGGRSDDEVRVLGAVHIKTENLEEWLGPENQPSGEDGSSAEEVTAMVIDTTGHGSVGQENYTLGSSGAKVARPTSSEVDR

SEQ ID NO: 6408 - protein, 503 aa, Homo sapiens; identical to SEQ ID NO: 6405

SEQ ID NO: 6409 - protein, 361 aa, Homo sapiens
MEKGGNIQLEIPDFSNSVLSHLNQLRMQGRLCDIVVNVQGQAFRAHKVVLAASSPYFRDHMSLNEMSTVSISVIKNPTVFEQLLSFCYTGRICLQLADIISYLTAASFLQMQHIIDKCTQILEGIHFKINVAEVEAELSQTRTKHQERPPESHRVTPNLNRSLSPRHNTPKGNRRGQVSAVLDIRELSPPEESTSPQIIEPSSDVESREPILRINRAGQWYVETGVADRGGRSDDEVRVLGAVHIKTENLEEWLGPENQPSGEDGSSAEEVTAMVIDTTGHGSVGQENYTLGSSGAKVARPTSSEVDRFSPSGSVVPLTERHRARSESPGRMDEPKQPSSQVWSCGFRTALVVGGIATVYE

SEQ ID NO: 6410 - protein, 503 aa, Homo sapiens; identical to SEQ ID NO: 6405

SEQ ID NO: 6411 - protein, 712 aa, Homo sapiens
MGMRIKLQSTNHPNNLLKELNKCRLSETMCDVTIVVGSRSFPAHKAVLACAAGYFQNLFLNTGLDAARTYVVDFITPANFEKVLSFVYTSELFTDLINVGVIYEVAERLGMEDLLQACHSTFPDLESTARAKPLTSTSESHSGTLSCPSAEPAHPLGELRGGGDYLGADRNYVLPSDAGGSYKEEEKNVASDANHSLHLPQPPPPPPKTEDHDTPAPFTSIPSMMTQPLLGTVSTGIQTSTSSCQPYKVQSNGDFSKNSFLTPDNAVDITTGTNSCLSNSEHSKDPGFGQMDELQLEDLGDDDLQFEDPAEDIGTTEEVIELSDDSEDELAFGENDNRENKAMPCQVCKKVLEPNIQLIRQHARDHVDLLTGNCKVCETHFQDRNSRVTHVLSHIGIFLFSCDMCETKFFTQWQLTLHRRDGIFENNIIVHPNDPLPGKLGLFSGAASPELKCAACGKVLAKDFHVVRGHILDHLNLKGQACSVCDQRHLNLCSLMWHTLSHLGISVFSCSVCANSFVDWHLLEKHMAVHQSLEDALFHCRLCSQSFKSEAAYRYHVSQHKCNSGLDARPGFGLQHPALQKRKLPAEEFLGEELALQGQPGNSKYSCKVCGKRFAHTSEFNYHRRIHTGEKPYQCKVCHKFFRGRSTIKCHLKTHSGALMYRCTVCGHYSSTLNLMSKHVGVHKGSLPPDFTIEQTFMYIIHSKEADKNPDS

SEQ ID NO: 6412 - protein, 909 aa, Homo sapiens
MKKRRKVTSNLEKIHLGYHKDSSEGNVAVECDQVTYTHSAGRPTPEALHCYQELPPSPDQRKLLSSLQYNKNLLKYLNDDRQKQPSFCDLLIIVEGKEFSAHKVVVAVGSSYFHACLSKNPSTDVVTLDHVTHSVFQHLLEFLYTSEFFVYKYEIPLVLEAAKFLDIIDAVKLLNNENVAPFHSELTEKSSPEETLNELTGRLSNNHQCKFCSRHFCYKKSLENHLAKTHRSLLLGKKHGLKMLERSFSARRSKRNRKCPVKFDDTSDDEQESGDGSDNLNQENFDKEKSDRNDSEDPGSEYNAEEDELEEEMSDEYSDIEEQSEKDHNDAEEEPEAGDSVGNVHEGLTPVVIQNSNKKILQCPKCDKTFDRIGKYESHTRVHTGEKPFECDICHQRYSTKSNLTVHRKKHSNETEFHKKEHKCPYCNKLHASKKTLAKHVKRFHPENAQEFISIKKTKSESWKCDICKKSFTRRPHLEEHMILHSQDKPFKCTYCEEHFKSRFARLKHQEKFHLGPFPCDICGRQFNDTGNLKRHIECTHGGKRKWTCFICGKSVRERTTLKEHLRIHSGEKPHLCSICGQSFRHGSSYRLHLRVHHDDKRYECDECGKTFIRHDHLTKHKKIHSGEKAHQCEECGKCFGRRDHLTVHYKSVHLGEKVWQKYKATFHQCDVCKKIFKGKSSLEMHFRTHSGEKPYKCQICNQSFRIKKTLTKHLVIHSDARPFNCQHCNATFKRKDKLKYHIDHVHEIKSPDDPLSTSEEKLVSLPVEYSSDDKIFQTETKQYMDQPKVYQSEAKTMLQNVSAEVCVPVTLVPVQMPDTPSDLVRHTTTLPPSSHEILSPQPQSTDYPRAADLAFLEKYTLTPQPANIVHPVRPEQMLDPREQSYLGTLLGLDSTTGVQNISTNEHHS

SEQ ID NO: 6413 - protein, 467 aa, Homo sapiens
MEPGTNSFRVEFPDFSSTILQKLNQQRQQGQLCDVSIVVQGHIFRAHKAVLAASSPYFCDQVLLKNSRRIVLPDVMNPRVFENILLSSYTGRLVMPAPEIVSYLTAASFLQMWHVVDKCTEVLEGNPTVLCQKLNHGSDHQSPSSSSYNGLVESFELGSGGHTDFPKAQELRDGENEEESTKDELSSQLTEHEYLPSNSSTEHDRLSTEMASQDGEEGASDSAEFHYTRPMYSKPSIMAHKRWIHVKPERLEQACEGMDVHATYDEHQVTESINTVQTEHTVQPSGVEEDFHIGEKKVEAEFDEQADESNYDEQVDFYGSSMEEFSGERSDGNLIGHRQEAALAAGYSENIEMVTGIKEEASHLGFSATDKLYPCQCGKSFTHKSQRDRHMSMHLGLRPYGCGVCGKKFKMKHHLVGHMKIHTGIKPYECNICAKRFMWRDSFHRHVTSCTKSYEAAKAEQNTTEAN

SEQ ID NO: 6414 - protein, 467 aa, Homo sapiens; identical to SEQ ID NO: 6413

SEQ ID NO: 6415 - protein, 467 aa, Homo sapiens; identical to SEQ ID NO: 6413

SEQ ID NO: 6416 - protein, 196 aa, Homo sapiens
MEPGTNSFRVEFPDFSSTILQKLNQQRQQGQLCDVSIVVQGHIFRAHKAVLAASSPYFCDQVLLKNSRRIVLPDVMNPRVFENILLSSYTGRLVMPAPEIVSYLTAASFLQMWHVVDKCTEVLEGNPTVLCQKLNHGSDHQSPSSSSYNGLVESFELGSGGHTDFPKAQELRDGENEEESTKDELSSQLTEHEYLP

SEQ ID NO: 6417 - protein, 511 aa, Homo sapiens
MAAAEAVHHIHLQNFSRSLLETLNGQRLGGHFCDVTVRIREASLRAHRCVLAAGSPFFQDKLLLGHSEIRVPPVVPAQTVRQLVEFLYSGSLVVAQGEALQVLTAASVLRIQTVIDECTQIIARARAPGTSAPTPLPTPVPPPLAPAQLRHRLRHLLAARPPGHPGAAHSRKQRQPARLQLPAPPTPAKAEGPDADPSLSAAPDDRGDEDDEESDDETDGEDGEGGGPGEGQAPPSFPDCAAGFLTAAADSACEEPPAPTGLADYSGAGRDFLRGAGSAEDVFPDSYVSTWHDEDGAVPEGCPTETPVQPDCILSGSRPPGVKTPGPPVALFPFHLGAPGPPAPPPSAPSGPAPAPPPAFYPTLQPEAAPSTQLGEVPAPSAAPTTAPSGTPARTPGAEPPTYECSHCRKTFSSRKNYTKHMFIHSGEKPHQCAVCWRSFSLRDYLLKHMVTHTGVRAFQCAVCAKRFTQKSSLNVHMRTHRPERAPCPACGKVFSHRALLERHLAAHPAP

SEQ ID NO: 6418 - protein, 589 aa, Homo sapiens
MNNRKEDMEITSHYRHLLRELNEQRQHGVLCDVCVVVEGKVFKAHKNVLLGSSRYFKTLYCQVQKTSEQATVTHLDIVTAQGFKAIIDFMYSAHLALTSRNVIEVMSAASFLQMTDIVQACHDFIKAALDISIKSDASDELAEFEIGASSSSSTEALISAVMAGRSISPWLARRTSPANSSGDSAIASCHDGGSSYGKEDQEPKADGPDDVSSQPLWPGDVGYGPLRIKEEQVSPSQYGGSELPSAKDGAVQNSFSEQSAGDAWQPTGRRKNRKNKETVRHITQQVEDDSRASSPVPSFLPTSGWPFSSRDSNADLSVTEASSSDSRGERAELYAQVEEGLLGGEASYLGPPLTPEKDDALHQATAVANLRAALMSKNSLLSLKADVLGDDGSLLFEYLPRGAHSLSLNEFTVIRKKFKCPYCSFSAMHQCILKRHMRSHTGERPYPCEICGKKFTRREHMKRHTLVHSKDKKYVCKVCSRVFMSAASVGIRHGSRRHGVCTDCAGRGMAGPLDHGGGGGEGSPEALFPGDGPYLEDPEDPRGEAEELGEDDEGLAPEDALLADDKDEEDSPRPRSPPGGPDKDFAWLS

SEQ ID NO: 6419 - protein, 589 aa, Homo sapiens; identical to SEQ ID NO: 6418

SEQ ID NO: 6420 - protein, 589 aa, Homo sapiens; identical to SEQ ID NO: 6418

SEQ ID NO: 6421 - protein, 747 aa, Homo sapiens
MGRLNEQRLFQPDLCDVDLVLVPQRSVFPAHKGVLAAYSQFFHSLFTQNKQLQRVELSLEALAPGGLQQILNFIYTSKLLVNAANVHEVLSAASLLQMADIAASCQELLDARSLGPPGPGTVALAQPAASCTPAAPPYYCDIKQEADTPGLPKIYAREGPDPYSVRVEDGAGTAGGTVPATIGPAQPFFKEEKEGGVEEAGGPPASLCKLEGGEELEEELGGSGTYSRREQSQIIVEVNLNNQTLHVSTGPEGKPGAGPSPATVVLGREDGLQRHSDEEEEDDEEEEEEEEEEEGGGSGREEEEEEEGGSQGEEEEEEEDGHSEQEEEEEEEEEEGPSEQDQESSEEEEGEEGEAGGKQGPRGSRSSRADPPPHSHMATRSRENARRRGTPEPEEAGRRGGKRPKPPPGVASASARGPPATDGLGAKVKLEEKQHHPCQKCPRVFNNRWYLEKHMNVTHSRMQICDQCGKRFLLESELLLHRQTDCERNIQCVTCGKAFKKLWSLHEHNKIVHGYAEKKFSCEICEKKFYTMAHVRKHMVAHTKDMPFTCETCGKSFKRSMSLKVHSLQHSGEKPFRCENCNERFQYKYQLRSHMSIHIGHKQFMCQWCGKDFNMKQYFDEHMKTHTGEKPYICEICGKSFTSRPNMKRHRRTHTGEKPYPCDVCGQRFRFSNMLKAHKEKCFRVSHTLAGDGVPAAPGLPPTQPQAHALPLLPGLPQTLPPPPHLPPPPPLFPTTASPGGRMNANN

SEQ ID NO: 6422 - protein, 371 aa, Homo sapiens
MATRSRENARRRGTPEPEEAGRRGGKRPKPPPGVASASARGPPATDGLGAKVKLEEKQHHPCQKCPRVFNNRWYLEKHMNVTHSRMQICDQCGKRFLLESELLLHRQTDCERNIQCVTCGKAFKKLWSLHEHNKIVHGYAEKKFSCEICEKKFYTMAHVRKHMVAHTKDMPFTCETCGKSFKRSMSLKVHSLQHSGEKPFRCENCNERFQYKYQLRSHMSIHIGHKQFMCQWCGKDFNMKQYFDEHMKTHTGEKPYICEICGKSFTSRPNMKRHRRTHTGEKPYPCDVCGQRFRFSNMLKAHKEKCFRVSHTLAGDGVPAAPGLPPTQPQAHALPLLPGLPQTLPPPPHLPPPPPLFPTTASPGGRMNANN

SEQ ID NO: 6423 - protein, 646 aa, Homo sapiens
MGRLNEQRLFQPDLCDVDLVLVPQRSVFPAHKGVLAAYSQFFHSLFTQNKQLQRVELSLEALAPGGLQQILNFIYTSKLLVNAANVHEVLSAASLLQMADIAASCQELLDARSLGPPGPGTVALAQPAASCTPAAPPYYCDIKQEADTPGLPKIYAREGPDPYSVRVEDGAGTAGGTVPATIGPAQPFFKEEKEGGVEEAGGPPASLCKLEGGEELEEELGGSGTYSRREQSQIIVEVNLNNQTLHVSTGPEGKPGAGPSPATVVLGREDGLQRHSDEEEEDDEEEEEEEEEEEGGGSGREEEEEEEGGSQGEEEEEEEDGHSEQEEEEEEKQHHPCQKCPRVFNNRWYLEKHMNVTHSRMQICDQCGKRFLLESELLLHRQTDCERNIQCVTCGKAFKKLWSLHEHNKIVHGYAEKKFSCEICEKKFYTMAHVRKHMVAHTKDMPFTCETCGKSFKRSMSLKVHSLQHSGEKPFRCENCNERFQYKYQLRSHMSIHIGHKQFMCQWCGKDFNMKQYFDEHMKTHTGEKPYICEICGKSFTSRPNMKRHRRTHTGEKPYPCDVCGQRFRFSNMLKAHKEKCFRVSHTLAGDGVPAAPGLPPTQPQAHALPLLPGLPQTLPPPPHLPPPPPLFPTTASPGGRMNANN

SEQ ID NO: 6424 - protein, 765 aa, Homo sapiens
MDPVATHSCHLLQQLHEQRIQGLLCDCMLVVKGVCFKAHKNVLAAFSQYFRSLFQNSSSQKNDVFHLDVKNVSGIGQILDFMYTSHLDLNQDNIQVMLDTAQCLQVQNVLSLCHTFLKSATVVQPPGMPCNSTLSLQSTLTPDATCVISENYPPHLLQECSADAQQNKTLDESHPHASPSVNRHHSAGEISKQAPDTSDGSCTELPFKQPNYYYKLRNFYSKQYHKHAAGPSQERVVEQPFAFSTSTDLTTVESQPCAVSHSECILESPEHLPSNFLAQPVNDSAPHPESDATCQQPVKQMRLKKAIHLKKLNFLKSQKYAEQVSEPKSDDGLTKRLESASKNTLEKASSQSAEEKESEEVVSCENFNCISETERPEDPAALEDQSQTLQSQRQYACELCGKPFKHPSNLELHKRSHTGEKPFECNICGKHFSQAGNLQTHLRRHSGEKPYICEICGKRFAASGDVQRHIIIHSGEKPHLCDICGRGFSNFSNLKEHKKTHTADKVFTCDECGKSFNMQRKLVKHRIRHTGERPYSCSACGKCFGGSGDLRRHVRTHTGEKPYTCEICNKCFTRSAVLRRHKKMHCKAGDESPDVLEELSQAIETSDLEKSQSSDSFSQDTSVTLMPVSVKLPVHPVENSVAEFDSHSGGSYCKLRSMIQPHGVSDQEKLSLDPGKLAKPQMQQTQPQAYAYSDVDTPAGGEPLQADGMAMIRSSLAALDNHGGDPLGSRASSTTYRNSEGQFFSSMTLWGLAMKTLQNENELDQ

SEQ ID NO: 6425 - protein, 643 aa, Homo sapiens
MDPVATHSCHLLQQLHEQRIQGLLCDCMLVVKGVCFKAHKNVLAAFSQYFRSLFQNSSSQKNDVFHLDVKNVSGIGQILDFMYTSHLDLNQDNIQVMLDTAQCLQVQNVLSLCHTFLKSATVVQPPGMPCNSTLSLQSTLTPDATCVISENYPPHLLQECSADAQQNKTLDESHPHASPSVNRHHSAGEISKQAPDTSDGSCTELPFKQPNYYYKLRNFYSKQYHKHAAGPSQERVVEQPFAFSTSTDLTTVESQPCAVSHSECILESPEHLPSNFLAQPVNDSAPHPESDATCQQPVKQMRLKKAIHLKKLNFLKSQKYAEQVSEPKSDDGLTKRLESASKNTLEKASSQSAEEKESEEVVSCENFNCISETERPEDPAALEDQSQTLQSQRQYACELCGKPFKHPSNLELHKRSHTGKCFGGSGDLRRHVRTHTGEKPYTCEICNKCFTRSAVLRRHKKMHCKAGDESPDVLEELSQAIETSDLEKSQSSDSFSQDTSVTLMPVSVKLPVHPVENSVAEFDSHSGGSYCKLRSMIQPHGVSDQEKLSLDPGKLAKPQMQQTQPQAYAYSDVDTPAGGEPLQADGMAMIRSSLAALDNHGGDPLGSRASSTTYRNSEGQFFSSMTLWGLAMKTLQNENELDQ

SEQ ID NO: 6426 - protein, 146 aa, Homo sapiens
MDPVATHSCHLLQQLHEQRIQGLLCDCMLVVKGVCFKAHKNVLAAFSQYFRSLFQNSSSQKNDVFHLDVKNVSGIGQILDFMYTSHLDLNQDNIQVMLDTAQCLQVQNVLSLCHTFLKSATVVQPPGMPCNSTLSLQSTLTPDATC

SEQ ID NO: 6427 - protein, 248 aa, Homo sapiens
MQRKLVKHRIRHTGERPYSCSACGKCFGGSGDLRRHVRTHTGEKPYTCEICNKCFTRSAVLRRHKKMHCKAGDESPDVLEELSQAIETSDLEKSQSSDSFSQDTSVTLMPVSVKLPVHPVENSVAEFDSHSGGSYCKLRSMIQPHGVSDQEKLSLDPGKLAKPQMQQTQPQAYAYSDVDTPAGGEPLQADGMAMIRSSLAALDNHGGDPLGSRASSTTYRNSEGQFFSSMTLWGLAMKTLQNENELDQ

SEQ ID NO: 6428 - protein, 677 aa, Homo sapiens
MDFPGHFEQIFQQLNYQRLHGQLCDCVIVVGNRHFKAHRSVLAACSTHFRALFSVAEGDQTMNMIQLDSEVVTAEAFAALIDMMYTSTLMLGESNVMDVLLAASHLHLNSVVKACKHYLTTRTLPMSPPSERVQEQSARMQRSFMLQQLGLSIVSSALNSSQNGEEQPAPMSSSMRSNLDQRTPFPMRRLHKRKQSAEERARQRLRPSIDESAISDVTPENGPSGVHSREEFFSPDSLKIVDNPKADGMTDNQEDSAIMFDQSFGTQEDAQVPSQSDNSAGNMAQLSMASRATQVETSFDQEAAPEKSSFQCENPEVGLGEKEHMRVVVKSEPLSSPEPQDEVSDVTSQAEGSESVEVEGVVVSAEKIDLSPESSDRSFSDPQSSTDRVGDIHILEVTNNLEHKSTFSISNFLNKSRGNNFTANQNNDDNIPNTTSDCRLESEAPYLLSPEAGPAGGPSSAPGSHVENPFSEPADSHFVRPMQEVMGLPCVQTSGYQGGEQFGMDFSRSGLGLHSSFSRVMIGSPRGGASNFPYYRRIAPKMPVVTSVRSSQIPENSTSSQLMMNGATSSFENGHPSQPGPPQLTRASADVLSKCKKALSEHNVLVVEGARKYACKICCKTFLTLTDCKKHIRVHTGEKPYACLKCGKRFSQSSHLYKHSKTTCLRWQSSNLPSTLL

SEQ ID NO: 6429 - protein, 424 aa, Homo sapiens
MAAESDVLHFQFEQQGDVVLQKMNLLRQQNLFCDVSIYINDTEFQGHKVILAACSTFMRDQFLLTQSKHVRITILQSAEVGRKLLLSCYTGALEVKRKELLKYLTAASYLQMVHIVEKCTEALSKYLEIDLSMKNNNQHTDLCQSSDPDVKNEDENSDKDCEIIEISEDSPVNIDFHVKEEESNALQSTVESLTSERKEMKSPELSTVDIGFKDNEICILHVESISTAGVENGQFSQPCTSSKASMYFSETQHSLINSTVESRVAEVPGNQDQGLFCENTEGSYGTVSEIQNLEEGYSLRHQCPRCPRGFLHVENYLRHLKMHKLFLCLQCGKTFTQKKNLNRHIRGHMGIRPFQCTVCLKTFTAKSTLQDHLNIHSGDRPYKCHCCDMDFKHKSALKKHLTSVHGRSSGEKLSRPDLKRQSLL

SEQ ID NO: 6430 - protein, 584 aa, Homo sapiens
MAGGVDGPIGIPFPDHSSDILSGLNEQRTQGLLCDVVILVEGREFPTHRSVLAACSQYFKKLFTSGAVVDQQNVYEIDFVSAEALTALMDFAYTATLTVSTANVGDILSAARLLEIPAVSHVCADLLDRQILAADAGADAGQLDLVDQIDQRNLLRAKEYLEFFQSNPMNSLPPAAAAAAASFPWSAFGASDDDLDATKEAVAAAVAAVAAGDCNGLDFYGPGPPAERPPTGDGDEGDSNPGLWPERDEDAPTGGLFPPPVAPPAATQNGHYGRGGEEEAASLSEAAPEPGDSPGFLSGAAEGEDGDGPDVDGLAASTLLQQMMSSVGRAGAAAGDSDEESRADDKGVMDYYLKYFSGAHDGDVYPAWSQKVEKKIRAKAFQKCPICEKVIQGAGKLPRHIRTHTGEKPYECNICKVRFTRQDKLKVHMRKHTGEKPYLCQQCGAAFAHNYDLKNHMRVHTGLRPYQCDSCCKTFVRSDHLHRHLKKDGCNGVPSRRGRKPRVRGGAPDPSPGATATPGAPAQPSSPDARRNGQEKHFKDEDEDEDVASPDGLGRLNVAGAGGGGDSGGGPGAATDGNFTAGLA

SEQ ID NO: 6431 - protein, 539 aa, Homo sapiens
MGSPEDDLIGIPFPDHSSELLSCLNEQRQLGHLCDLTIRTQGLEYRTHRAVLAACSHYFKKLFTEGGGGAVMGAGGSGTATGGAGAGVCELDFVGPEALGALLEFAYTATLTTSSANMPAVLQAARLLEIPCVIAACMEILQGSGLEAPSPDEDDCERARQYLEAFATATASGVPNGEDSPPQVPLPPPPPPPPRPVARRSRKPRKAFLQTKGARANHLVPEVPTVPAHPLTYEEEEVAGRVGSSGGSGPGDSYSPPTGTASPPEGPQSYEPYEGEEEEEELVYPPAYGLAQGGGPPLSPEELGSDEDAIDPDLMAYLSSLHQDNLAPGLDSQDKLVRKRRSQMPQECPVCHKIIHGAGKLPRHMRTHTGEKPFACEVCGVRFTRNDKLKIHMRKHTGERPYSCPHCPARFLHSYDLKNHMHLHTGDRPYECHLCHKAFAKEDHLQRHLKGQNCLEVRTRRRRKDDAPPHYPPPSTAAASPAGLDLSNGHLDTFRLSLARFWEQSAPTGPPVSTPGPPDDDEEEGAPTTPQAEGAMESS

SEQ ID NO: 6432 - protein, 539 aa, Homo sapiens; identical to SEQ ID NO: 6431

SEQ ID NO: 6433 - protein, 573 aa, Homo sapiens
MLQPGPHPPSPQAAAPGEAWPGPSQAPWQSLEEKMGSPEDDLIGIPFPDHSSELLSCLNEQRQLGHLCDLTIRTQGLEYRTHRAVLAACSHYFKKLFTEGGGGAVMGAGGSGTATGGAGAGVCELDFVGPEALGALLEFAYTATLTTSSANMPAVLQAARLLEIPCVIAACMEILQGSGLEAPSPDEDDCERARQYLEAFATATASGVPNGEDSPPQVPLPPPPPPPPRPVARRSRKPRKAFLQTKGARANHLVPEVPTVPAHPLTYEEEEVAGRVGSSGGSGPGDSYSPPTGTASPPEGPQSYEPYEGEEEEEELVYPPAYGLAQGGGPPLSPEELGSDEDAIDPDLMAYLSSLHQDNLAPGLDSQDKLVRKRRSQMPQECPVCHKIIHGAGKLPRHMRTHTGEKPFACEVCGVRFTRNDKLKIHMRKHTGERPYSCPHCPARFLHSYDLKNHMHLHTGDRPYECHLCHKAFAKEDHLQRHLKGQNCLEVRTRRRRKDDAPPHYPPPSTAAASPAGLDLSNGHLDTFRLSLARFWEQSAPTGPPVSTPGPPDDDEEEGAPTTPQAEGAMESS

SEQ ID NO: 6434 - protein, 539 aa, Homo sapiens; identical to SEQ ID NO: 6431

SEQ ID NO: 6435 - protein, 340 aa, Homo sapiens
MEISSHQSHLLQQLNEQRRQDVFCDCSILVEGKVFKAHRNVLFASSGYFKMLLSQNSKETSQPTTATFQAFSPDTFTVILDFVYSGKLSLTGQNVIEVMSAASFLQMTDVISVCKTFIKSSLDISEKEKDRYFSLSDKDANSNGVERSSFYSGGWQEGSSSPRSHLSPEQGTGIISGKSWNKYNYHPASQKNTQQPLAKHEPRKESIKKTKHLRLSQPSEVTHYKSSKREVRTSDSSSHVSQSEEQAQIDAEMDSTPVGYQYGQGSDVTSKSFPDDLPRMRFKCPYCTHVVKRKADLKRHLRCHTGERPYPCQACGKRFSRLDHLSSHFRTMEIRIPDGT

SEQ ID NO: 6436 - protein, 441 aa, Homo sapiens
MEISSHQSHLLQQLNEQRRQDVFCDCSILVEGKVFKAHRNVLFASSGYFKMLLSQNSKETSQPTTATFQAFSPDTFTVILDFVYSGKLSLTGQNVIEVMSAASFLQMTDVISVCKTFIKSSLDISEKEKDRYFSLSDKDANSNGVERSSFYSGGWQEGSSSPRSHLSPEQGTGIISGKSWNKYNYHPASQKNTQQPLAKHEPRKESIKKTKHLRLSQPSEVTHYKSSKREVRTSDSSSHVSQSEEQAQIDAEMDSTPVGYQYGQGSDVTSKSFPDDLPRMRFKCPYCTHVVKRKADLKRHLRCHTGERPYPCQACGKRFSRLDHLSSHFRTIHQACKLICRKCKRHVTDLTGQVVQEGTRRYRLCNECLAEFGIDSLPIDLEAEQHLMSPSDGDKDSRWHLSEDENRSYVEIVEDGSGDLVIQQVDDSEEEEEKEIKPNIR

SEQ ID NO: 6437 - protein, 495 aa, Homo sapiens
MEMQSYYAKLLGELNEQRKRDFFCDCSIIVEGRIFKAHRNILFANSGYFRALLIHYIQDSGRHSTASLDIVTSDAFSIILDFLYSGKLDLCGENVIEVMSAASYLQMNDVVNFCKTYIRSSLDICRKMEKEAAVAAAVAAAAAAAAAAAAAAAHQVDSESPSSGREGTSCGTKSLVSSPAEGEKSVECLRESPCGDCGDCHPLELVVRDSLGGGSADSNLSTPPKRIEPKVEFDADEVEVDVGEQLQQYAAPLNLAHVEEALPSGQAVDLAYSNYHVKQFLEALLRNSAAPSKDDADHHFSRSLEGRPEGAGVAMSSMMDVQADWYGEDSGDVLVVPIKLHKCPFCPYTAKQKGILKRHIRSHTGERPYPCETCGKRFTRQEHLRSHALSVHRSNRPIICKGCRRTFTSHLSQGLRRFGLCDSCTCVTDTPDDDDDLMPINLSLVEASSESQEKSDTDNDWPIYVESGEENDPAGDDSDDKPQIQPNLSDRETLT

SEQ ID NO: 6438 - protein, 473 aa, Homo sapiens
METPTPLPPVPASPTCNPAPRTIQIEFPQHSSSLLESLNRHRLEGKFCDVSLLVQGRELRAHKAVLAAASPYFHDKLLLGDAPRLTLPSVIEADAFEGLLQLIYSGRLRLPLDALPAHLLVASGLQMWQVVDQCSEILRELETSGGGISARGGNSYHALLSTTSSTGGWCIRSSPFQTPVQSSASTESPASTESPVGGEGSELGEVLQIQVEEEEEEEEDDDDEDQGSATLSQTPQPQRVSGVFPRPHGPHPLPMTATPRKLPEGESAPLELPAPPALPPKIFYIKQEPFEPKEEISGSGTQPGGAKEETKVFSGGDTEGNGELGFLLPSGPGPTSGGGGPSWKPVDLHGNEILSGGGGPGGAGQAVHGPVKLGGTPPADGKRFGCLCGKRFAVKPKRDRHIMLTFSLRPFGCGICNKRFKLKHHLTEHMKTHAGALHACPHCGRRFRVHACFLRHRDLCKGQGWATAHWTYK

SEQ ID NO: 6439 - protein, 473 aa, Homo sapiens; identical to SEQ ID NO: 6438

SEQ ID NO: 6440 - protein, 408 aa, Homo sapiens
MLPRPKAPASPRRPQTPTPSEQDADPGPASPRDTEAQRLRFRQFQYHVASGPHLALGQLWTLCRQWLRPEARSKEQMLELLVLEQFLGALPSKMRTWVQSQGPRSCREAASLVEDLTQMCQQEVLVSLDSVEPQDWSFGEEEDGKSPRSQKEPSQASELILDAVAAAPALPEESEWLETTQLQQSLHTRAEAEAPRAPGLLGSRARLPLKPSIWDEPEDLLAGPSSDLRAEGTVISSPKGPSAQRISPRRRNRNTDQSGRHQPSLKHTKGGTQEAVAGISVVPRGPRGGRPFQCADCGMVFTWVTHFIEHQKTHREEGPFPCPECGKVFLHNSVLTEHGKIHLLEPPRKKAPRSKGPRESVPPRDGAQGPVAPRSPKRPFQCSVCGKAFPWMVHLIDHQKLHTAHGHM

SEQ ID NO: 6441 - protein, 178 aa, Homo sapiens
MLPRPKAPASPRRPQTPTPSEQDADPGPASPRDTEAQRLRFRQFQYHVASGPHLALGQLWTLCRQWLRPEARSKEQMLELLVLEQFLGALPSKMRTWVQSQGPRSCREAASLVEDLTQMCQQEGERRRLPAPGRARGPDVSEDRTALLPAHIAPTPARPLPTSKPLLPRGCVFNYFYI

SEQ ID NO: 6442 - protein, 725 aa, Homo sapiens
MGPRASLSRLRELCGHWLRPALHTKKQILELLVLEQFLSVLPPHLLGRLQGQPLRDGEEVVLLLEGIHREPSHAGPLDFSCNAGKSCPRADVTLEEKGCASQVPSHSPKKELPAEEPSVLGPSDEPPRPQPRAAQPAEPGQWRLPPSSKQPLSPGPQKTFQALQESSPQGPSPWPEESSRDQELAAVLECLTFEDVPENKAWPAHPLGFGSRTPDKEEFKQEEPKGAAWPTPILAESQADSPGVPGEPCAQSLGRGAAASGPGEDGSLLGSSEILEVKVAEGVPEPNPELQFICADCGVSFPQLSRLKAHQLRSHPAGRSFLCLCCGKSFGRSSILKLHMRTHTDERPHACHLCGHRFRQSSHLSKHLLTHSSEPAFLCAECGRGFQRRASLVQHLLAHAQDQKPPCAPESKAEAPPLTDVLCSHCGQSFQRRSSLKRHLRIHARDKDRRSSEGSGSRRRDSDRRPFVCSDCGKAFRRSEHLVAHRRVHTGERPFSCQACGRSFTQSSQLVSHQRVHTGEKPYACPQCGKRFVRRASLARHLLTHGGPRPHHCTQCGKSFGQTQDLARHQRSHTGEKPCRCSECGEGFSQSAHLARHQRIHTGEKPHACDTCGHRFRNSSNLARHRRSHTGERPYSCQTCGRSFRRNAHLRRHLATHAEPGQEQAEPPQECVECGKSFSRSCNLLRHLLVHTGARPYSCTQCGRSFSRNSHLLRHLRTHARETLY

SEQ ID NO: 6443 - protein, 658 aa, Homo sapiens
TRVQAEARGGSPAVQMLPVSGGHGATGVPEPAPGALRPLAAAGSAHQETDPGAAGAGAVPECAASAPPGPPAGAAAQGWGGGGAAARGHPPGAQPRGAAGPQGPSPWPEESSRDQELAAVLECLTFEDVPENKAWPAHPLGFGSRTPDKEEFKQEEPKGAAWPTPILAESQADSPGVPGEPCAQSLGRGAAASGPGEDGSLLGSSEILEVKVAEGVPEPNPELQFICADCGVSFPQLSRLKAHQLRSHPAGRSFLCLCCGKSFGRSSILKLHMRTHTDERPHACHLCGHRFRQSSHLSKHLLTHSSEPAFLCAECGRGFQRRASLVQHLLAHAQDQKPPCAPESKAEAPPLTDVLCSHCGQSFQRRSSLKRHLRIHARDKDRRSSEGSGSRRRDSDRRPFVCSDCGKAFRRSEHLVAHRRVHTGERPFSCQACGRSFTQSSQLVSHQRVHTGEKPYACPQCGKRFVRRASLARHLLTHGGPRPHHCTQCGKSFGQTQDLARHQRSHTGEKPCRCSECGEGFSQSAHLARHQRIHTGEKPHACDTCGHRFRNSSNLARHRRSHTGERPYSCQTCGRSFRRNAHLRRHLATHAEPGQEQAEPPQECVECGKSFSRSCNLLRHLLVHTGARPYSCTQCGRSFSRNSHLLRHLRTHARETLY

SEQ ID NO: 6444 - protein, 348 aa, Homo sapiens
MTTALEPEDQKGLLIIKAEDHYWGQDSSSQKCSPHRRELYRQHFRKLCYQDAPGPREALTQLWELCRQWLRPECHTKEQILDLLVLEQFLSILPKDLQAWVRAHHPETGEEAVTVLEDLERELDEPGKQVPGNSERRDILMDKLAPLGRPYESLTVQLHPKKTQLEQEAGKPQRNGDKTRTKNEELFQKEDMPKDKEFLGEINDRLNKDTPQHPKSKDIIENEGRSEWQQRERRRYKCDECGKSFSHSSDLSKHRRTHTGEKPYKCDECGKAFIQRSHLIGHHRVHTGVKPYKCKECGKDFSGRTGLIQHQRIHTGEKPYECDECGRPFRVSSALIRHQRIHTANKLY

SEQ ID NO: 6445 - protein, 510 aa, Homo sapiens
MLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEEPGMLLGSPAGSSSILSDGVYERHMDPLLLPGELASPSQALGAGEIPAPSETPWLSPDPLFLEQRRVREAKTEEDGPANTEQKLKSFPEDPQHLGEWGHLDPAEENLKSYRKLLLWGYQLSQPDAASRLDTEELRLVERDPQGSSLPEGGRRQESAGCACEEAAPAGVLPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPAPPEAQR

SEQ ID NO: 6446 - protein, 374 aa, Homo sapiens
MLLGSPAGSSSILSDGVYERHMDPLLLPGELASPSQALGAGEIPAPSETPWLSPDPLFLEQRRVREAKTEEDGPANTEQKLKSFPEDPQHLGEWGHLDPAEENLKSYRKLLLWGYQLSQPDAASRLDTEELRLVERDPQGSSLPGGRRQESAGCACEEAAPAGVLPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPAPPEAQR

SEQ ID NO: 6447 - protein, 566 aa, Homo sapiens
MRRVGGRADEDATAAGSLWVLAPPEPTGHLVIPGTSPLEPPCPWLDSHIFQCRFGKMLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEEPGMLLGSPAGSSSILSDGVYERHMDPLLLPGELASPSQALGAGEIPAPSETPWLSPDPLFLEQRRVREAKTEEDGPANTEQKLKSFPEDPQHLGEWGHLDPAEENLKSYRKLLLWGYQLSQPDAASRLDTEELRLVERDPQGSSLPEGGRRQESAGCACEEAAPAGVLPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPAPPEAQR

SEQ ID NO: 6448 - protein, 566 aa, Homo sapiens; identical to SEQ ID NO: 6447

SEQ ID NO: 6449 - protein, 150 aa, Homo sapiens
MMAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSAVAVVASLPVEVTSL

SEQ ID NO: 6450 - protein, 595 aa, Homo sapiens
MMAADIPRVTTPLSSLVQVPQEEDRQEEEVTTMILEDDSWVQEAVLQEEVTRGPQGALGRLRELCRRWLRPEVHTKEQMLTMLPKEIQAWLQEHRPESSEEAAALVEDLTQTLQDSDFEIQSENGENCNQDMFENESRKIFSEMPEGESAQHSDGESDFERDAGIQRLQGHSPGEDHGEVVSQDREVGQLIGLQGTYLGEKPYECPQCGKTFSRKSHLITHERTHTGEKYYKCDECGKSFSDGSNFSRHQTTHTGEKPYKCRDCGKSFSRSANLITHQRIHTGEKPFQCAECGKSFSRSPNLIAHQRTHTGEKPYSCPECGKSFGNRSSLNTHQGIHTGEKPYECKECGESFSYNSNLIRHQRIHTGEKPYKCTDCGQRFSQSSALITHRRTHTGEKPYQCSECGKSFSRSSNLATHRRTHMVEKPYKCGVCGKSFSQSSSLIAHQGMHTGEKPYECLTCGESFSWSSNLLKHQRIHTGEKPYKCSECGKCFSQRSQLVVHQRTHTGEKPYKCLMCGKSFSRGSILVMHQRAHLGDKPYRCPECGKGFSWNSVLIIHQRIHTGEKPYKCPECGKGFSNSSNFITHQRTHMKEKLY

SEQ ID NO: 6451 - protein, 146 aa, Homo sapiens
MMAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSETASCVHGCPV

SEQ ID NO: 6452 - protein, 32 aa, Homo sapiens
MMAADIPRVTTPLSSLVQVPQEEDRQEEEVTT

SEQ ID NO: 6453 - protein, 614 aa, Homo sapiens
MMAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSDFEIQSENGENCNQDMFENESRKIFSEMPEGESAQHSDGESDFERDAGIQRLQGHSPGEDHGEVVSQDREVGQLIGLQGTYLGEKPYECPQCGKTFSRKSHLITHERTHTGEKYYKCDECGKSFSDGSNFSRHQTTHTGEKPYKCRDCGKSFSRSANLITHQRIHTGEKPFQCAECGKSFSRSPNLIAHQRTHTGEKPYSCPECGKSFGNRSSLNTHQGIHTGEKPYECKECGESFSYNSNLIRHQRIHTGEKPYKCTDCGQRFSQSSALITHRRTHTGEKPYQCSECGKSFSRSSNLATHRRTHMVEKPYKCGVCGKSFSQSSSLIAHQGMHTGEKPYECLTCGESFSWSSNLLKHQRIHTGEKPYKCSECGKCFSQRSQLVVHQRTHTGEKPYKCLMCGKSFSRGSILVMHQRAHLGDKPYRCPECGKGFSWNSVLIIHQRIHTGEKPYKCPECGKGFSNSSNFITHQRTHMKEKLY

SEQ ID NO: 6454 - protein, 27 aa, Homo sapiens
MMAADIPRVTTPLSSLVQVPQEEDRQE

SEQ ID NO: 6455 - protein, 614 aa, Homo sapiens; identical to SEQ ID NO: 6453

SEQ ID NO: 6456 - protein, 614 aa, Homo sapiens; identical to SEQ ID NO: 6453

SEQ ID NO: 6457 - protein, 53 aa, Homo sapiens
MMAADIPRVTTPLSSLVQVPQEEDRQEEEVTTMILEDDSWVQEAVLQEDGPES

SEQ ID NO: 6458 - protein, 473 aa, Homo sapiens
MMTKVLGMAPVLGPRPPQEQVGPLMVKVEEKEEKGKYLPSLEMFRQRFRQFGYHDTPGPREALSQLRVLCCEWLRPEIHTKEQILELLVLEQFLTILPQELQAWVQEHCPESAEEAVTLLEDLERELDEPGHQVSTPPNEQKPVWEKISSSGTAKESPSSMQPQPLETSHKYESWGPLYIQESGEEQEFAQDPRKVRDCRLSTQHEESADEQKGSEAEGLKGDIISVIIANKPEASLERQCVNLENEKGTKPPLQEAGSKKGRESVPTKPTPGERRYICAECGKAFSNSSNLTKHRRTHTGEKPYVCTKCGKAFSHSSNLTLHYRTHLVDRPYDCKCGKAFGQSSDLLKHQRMHTEEAPYQCKDCGKAFSGKGSLIRHYRIHTGEKPYQCNECGKSFSQHAGLSSHQRLHTGEKPYKCKECGKAFNHSSNFNKHHRIHTGEKPYWCHHCGKTFCSKSNLSKHQRVHTGEGEAP

SEQ ID NO: 6459 - protein, 448 aa, Homo sapiens
MMTKVLGMAPVLGPRPPQEQVGPLMVKVEEKEEKGKYLPSLEMFRQRFRQFGYHDTPGPREALSQLRVLCCEWLRPEIHTKEHCPESAEEAVTLLEDLERELDEPGHQVSTPPNEQKPVWEKISSSGTAKESPSSMQPQPLETSHKYESWGPLYIQESGEEQEFAQDPRKVRDCRLSTQHEESADEQKGSEAEGLKGDIISVIIANKPEASLERQCVNLENEKGTKPPLQEAGSKKGRESVPTKPTPGERRYICAECGKAFSNSSNLTKHRRTHTGEKPYVCTKCGKAFSHSSNLTLHYRTHLVDRPYDCKCGKAFGQSSDLLKHQRMHTEEAPYQCKDCGKAFSGKGSLIRHYRIHTGEKPYQCNECGKSFSQHAGLSSHQRLHTGEKPYKCKECGKAFNHSSNFNKHHRIHTGEKPYWCHHCGKTFCSKSNLSKHQRVHTGEGEAP

SEQ ID NO: 6460 - protein, 181 aa, Homo sapiens
MMTKVLGMAPVLGPRPPQEQVGPLMVKVEEKEEKGKYLPSLEMFRQRFRQFGYHDTPGPREALSQLRVLCCEWLRPEIHTKEQILELLVLEQFLTILPQELQAWVQEHCPESAEEAVTLLEDLERELDEPGHQVSTPPNEQKPVWEKISSSGTAKESPSSMQPQPLETSHKYESWGPLYIQ

SEQ ID NO: 6461 - protein, 450 aa, Homo sapiens
MMTKVLGMAPVLGPRPPQEQVGPLMVKVEEKEEKGKYLPSLEMFRQRFRQFGYHDTPGPREALSQLRVLCCEWLRPEIHTKEQILELLVLEQFLTILPQELQAWVQEHCPESAEEAVTLLEDLERELDEPGHQVSTPPNEQKPVWEKISSSGTAKESPSSMQPQPLETSHKYESWGPLYIQESGEEQEFAQDPRKVRDCRLSTQHEESADEQKGSEAEGLKGDIISVIIANKPEASLERQCVNLENEKGTKPPLQEAGSKKGEHTLGRNLTCAPSVGKLSATAQTSPSTTEHTWWTGPMTVSVEKLLGRAQTFLNIRECTQKRRHISAKIVARLSAGKAASFVTIGSTLGRSLISVTNVGRASVSMRASAPTRDSTPERSHISVRSVGKPSTTAPTSINTTESTPGKSPTGVITVERPSVASPIFPNISESTLEREKHRNFQALLLLSLF

SEQ ID NO: 6462 - protein, 389 aa, Homo sapiens
MAITLTLQTAEMQEGLLAVKVKEEEEEHSCGPESGLSRNNPHTREIFRRRFRQFCYQESPGPREALQRLQELCHQWLRPEMHTKEQILELLVLEQFLTILPEELQAWVRQHRPVSGEEAVTVLEDLERELDDPGEQVLSHAHEQEEFVKEKATPGAAQESSNDQFQTLEEQLGYNLREVCPVQEIDGKAGTWNVELAPKREISQEVKSLIQVLGKQNGNITQIPEYGDTCDREGRLEKQRVSSSVERPYICSECGKSFTQNSILIEHQRTHTGEKPYECDECGRAFSQRSGLFQHQRLHTGEKRYQCSVCGKAFSQNAGLFHHLRIHTGEKPYQCNQCNKSFSRRSVLIKHQRIHTGERPYECEECGKNFIYHCNLIQHRKVHPVAESS

SEQ ID NO: 6463 - protein, 463 aa, Homo sapiens
MMAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGFEAGFENEDNSKRDISEEVQLHRTLLARSERKIPRYLHQGKGNESDCRSGRQWAKTSGEKRGKLTLPEKSLSEVLSQQRPCLGERPYKYLKYSKSFGPNSLLMHQVSHQVENPYKCADCGKSFSRSARLIRHRRIHTGEKPYKCLDCGKSFRDSSNFITHRRIHTGEKPYQCGECGKCFNQSSSLIIHQRTHTGEKPYQCEECGKSFNNSSHFSAHRRIHTGERPHVCPDCGKSFSKSSDLRAHHRTHTGEKPYGCHDCGKCFSKSSALNKHGEIHAREKLLTQSAPK

SEQ ID NO: 6464 - protein, 852 aa, Homo sapiens
MMAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGLPFPKSGVVSRLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGVHWGYEETKTYLAILSETQFYEALRNCHRNSQLYGAVAERLWEYGFLRTPEQCRTKFKSLQTSYRKVKNGQAPETCPFFEEMDALVSVRVAAPPNDGQEETASCPVQGTSEAEAQKQAEEADEATEEDSDDDEEDTEIPPGAVITRAPVLFQSPRGFEAGFENEDNSKRDISEEVQLHRTLLARSERKIPRYLHQGKGNESDCRSGRQWAKTSGEKRGKLTLPEKSLSEVLSQQRPCLGERPYKYLKYSKSFGPNSLLMHQVSHQVENPYKCADCGKSFSRSARLIRHRRIHTGEKPYKCLDCGKSFRDSSNFITHRRIHTGEKPYQCGECGKCFNQSSSLIIHQRTHTGEKPYQCEECGKSFNNSSHFSAHRRIHTGERPHVCPDCGKSFSKSSDLRAHHRTHTGEKPYGCHDCGKCFSKSSALNKHGEIHAREKLLTQSAPK

SEQ ID NO: 6465 - protein, 494 aa, Homo sapiens
MSGEATVLAYHAPEEQEGLLVVKVEEENYVLDQDFGLQENPWSQEVFRQKFRQFSYSDSTGPREALSRLRELCCQWLRPEVHSKEQILELLMLEQFLAILPEELQAWLREHRPENGEEAVTMLEELEKELEEPRQQDTTHGQEMFWQEMTSTGALKSLSLNSPVQPLENQCKTETQESQAFQERDGRMVAGKVLMAKQEIVECVASAAMISPGKLPGETHSQRIAEEALGGLDNSKKQKGNAAGNKISQLPSQDRHFSLATFNRRIPTEHSVLESHESEGSFSMNSNDITQQSVDTREKLYECFDCGKAFCQSSKLIRHQRIHTGERPYACKECGKAFSLSSDLVRHQRIHSGEKPYECCECGKAFRGSSELIRHRRIHTGEKPYECGECGKAFSRSSALIQHKKIHTGDKSYECIACGKAFGRSSILIEHQRIHTGEKPYECNECGKSFNQSSALTQHQRIHTGEKPYECSECRKTFRHRSGLMQHQRTHTRV

SEQ ID NO: 6466 - protein, 427 aa, Homo sapiens
QEVFRQKFRQFSYSDSTGPREALSRLRELCCQWLRPEVHSKEQILELLMLEQFLAILPEELQAWLREHRPENGEEAVTMLEELEKELEEPRQQVRSKHFFCVPATTVSSVMGSKILTLSIHIFRWQDGGWQSVDGKARNSSAAMISPGKLPGETHSQRIAEEALGGLDNSKKQKGNAAGNKISQLPSQDRHFSLATFNRRIPTEHSVLESHESEGSFSMNSNDITQQSVDTREKLYECFDCGKAFCQSSKLIRHQRIHTGERPYACKECGKAFSLSSDLVRHQRIHSGEKPYECCECGKAFRGSSELIRHRRIHTGEKPYECGECGKAFSRSSALIQHKKIHTGDKSYECIACGKAFGRSSILIEHQRIHTGEKPYECNECGKSFNQSSALTQHQRIHTGEKPYECSECRKTFRHRSGLMQHQRTHT

SEQ ID NO: 6467 - protein, 221 aa, Homo sapiens
MSGEATVLAYHAPEEQEGLLVVKVEEENYVLDQDFGLQENPWSQEVFRQKFRQFSYSDSTGPREALSRLRELCCQWLRPEVHSKEQILELLMLEQFLAILPEELQAWLREHRPENGEEAVTMLEELEKELEEPRQQDTTHGQEMFWQEMTSTGALKSLSLNSPVQPLENQCKTETQESQAFQERDGVSLYHPGWSAVVQPQLTAAALNPWVKVILLPQPPE

SEQ ID NO: 6468 - protein, 494 aa, Homo sapiens; identical to SEQ ID NO: 6465

SEQ ID NO: 6469 - protein, 379 aa, Homo sapiens
MIVRPPQPRETSVVTFHGKEYIVQDSDIEMAEAPSSVRDDLKDVSSQRASSVNQMRPGEGQAHRELQILPRVPALSRRQGEDFLLHKSIDVTGDPKSLRPKQTLEKDLKENREENPGLTSPEPQLPKSPTDLVRAKEGKDPPKIASVENVDADTPSACVVEREASTHSGNRGDALNLSSPKRSKPDASSISQEEPQGEATPVGNRESPGQAGMNSIHSPGPASPVSHPDGQEAKALPPFACDVCEKRFTCNSKLVIHKRSHTGERLFQCNLCGKRFMQLISLQFHQRTHTGERPYTCDVCQKQFTQKSYLKCHKRSHTGEKPFECKDCKKVFTYRGSLKEHQRIHSGEKPYKCSKCPRAFSRLKLLRRHQKTHPEATSQ

SEQ ID NO: 6470 - protein, 496 aa, Homo sapiens
MAANCTSSWSLGESCNRPGLELPRSMASSETQLGNHDVDPEISHVNFRMFSCPKESDPIQALRKLTELCHLWLRPDLHTKEQILDMLVMEQFMISMPQELQVLVMMNGVQSCKDLEDLLRNNRRPKKWSVVTFHGKEYIVQDSDIEMAEAPSSVRDDLKDVSSQRASSVNQMRPGEGQAHRELQILPRVPALSRRQGEDFLLHKSIDVTGDPKSLRPKQTLEKDLKENREENPGLTSPEPQLPKSPTDLVRAKEGKDPPKIASVENVDADTPSACVVEREASTHSGNRGDALNLSSPKRSKPDASSISQEEPQGEATPVGNRESPGQAGMNSIHSPGPASPVSHPDGQEAKALPPFACDVCEKRFTCNSKLVIHKRSHTGERLFQCNLCGKRFMQLISLQFHQRTHTGERPYTCDVCQKQFTQKSYLKCHKRSHTGEKPFECKDCKKVFTYRGSLKEHQRIHSGEKPYKCSKCPRAFSRLKLLRRHQKTHPEATSQ

SEQ ID NO: 6471 - protein, 757 aa, Homo sapiens
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKDVVTPLSTLLPPISNSIPFRGQVKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRERERERERERDRDREKEREKEKGKPKPRSPQPPSRQAEPPKKEAATTGPQVKRADEWKDPWRRSKSPKKKLGVSVSPSRARRRRKTSASSASASNSSRSSSRSSSYSGSGSSRSRSRSSSYSSYSSRSSRHSSFSGSRSRSRSFSSSPSPSPTPSPHRPSIRTKGEPAPPPGKAGEKSVKKPAPPPAPPQATKTTAPVPEPTKPGDPREARRKERPARTPPRRRLIKEAGSAMNHQTRTGRALLQPSGPTHPQTEVLGTGSQVGDWAPRSQSGREARTPKPLQPRLTGSASCHPSPRAPARSRACPAKPRIPAPPAPNQGRPARCLGGRSC

SEQ ID NO: 6472 - protein, 953 aa, Homo sapiens
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRERERERERENRQRERERERERDRERERRQRERERERERERDKERQRRKEEWERERAKRDEKDRQHRDRDREKEREKEKGKPKPRSPQPPSRQAEPPKKEAATTGPQVKRADEWKDPWRRSKSPKKKLGVSVSPSRARRRRKTSASSASASNSSRSSSRSSSYSGSGSSRSRSRSSSYSSYSSRSSRHSSFSGSRSRSRSFSSSPSPSPTPSPHRPSIRTKGEPAPPPGKAGEKSVKKPAPPPAPPQATKTTAPVPEPTKPGDPREARRKERPARTPPRRRTLSGSGSGSGSSYSGSSSRSRSLSVSSVSSVSSATSSSSSAHSVDSEDMYADLASPVSSASSRSPAPAQTRKEKGKSKKEDGVKEEKRKRDSSTQPPKSAKPPAGGKSSQQPSTPQQAPPGQPQQGTFVAHKEIKLTLLNKAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 6473 - protein, 977 aa, Homo sapiens
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKDVVTPLSTLLPPISNSIPFRGQVKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRERERERERENRQRERERERERDRERERRQRERERERERERDKERQRRKEEWERERAKRDEKDRQHRDRDREKEREKEKGKPKPRSPQPPSRQAEPPKKEAATTGPQVKRADEWKDPWRRSKSPKKKLGVSVSPSRARRRRKTSASSASASNSSRSSSRSSSYSGSGSSRSRSRSSSYSSYSSRSSRHSSFSGSRSRSRSFSSSPSPSPTPSPHRPSIRTKGEPAPPPGKAGEKSVKKPAPPPAPPQATKTTAPVPEPTKPGDPREARRKERPARTPPRRRTLSGSGSGSGSSYSGSSSRSRSLSVSSVSSVSSATSSSSSAHSVDSEDMYADLASPVSSASSRSPAPAQTRKEKGKSKKEDGVKEEKRKRDSSTQPPKSAKPPAGGKSSQQPSTPQQAPPGQPQQGTFVAHKEIKLTLLNKAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 6474 - protein, 332 aa, Homo sapiens
MDVAESPERDPHSPEDEEQPQGLSDDDILRDSGSDQDLDGAGVRASDLEDEESAARGPSQEEEDNHSDEEDRASEPKSQDQDSEDDDLEEGEVKDPSDRKVRPRPTCRFFMKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRERERERERENRQRERDKERQRRKEEWERERAAKLSHQRRRLPPRGRR

SEQ ID NO: 6475 - protein, 948 aa, Homo sapiens
MEEKEILRRQIRLLQGLIDDYKTLHGNAPAPGTPAASGWQPPTYHSGRAFSARYPRPSRRGYSSHHGPSWRKKYSLVNRPPGPSDPPADHAVRPLHGARGGQPPVPQQHVLERQVQLSQGQNVVIKVKPPSKSGSASASGAQRGSLEEFEETPWSDQRPREGEGEPPRGQLQPSRPTRARGTCSVEDPLLVCQKEPGKPRMVKSVGSVGDSPREPRRTVSESVIAVKASFPSSALPPRTGVALGRKLGSHSVASCAPQLLGDRRVDAGHTDQPVPSGSVGGPARPASGPRQAREASLVVTCRTNKFRKNNYKWVAASSKSPRVARRALSPRVAAENVCKASAGMANKVEKPQLIADPEPKPRKPATSSKPGSAPSKYKWKASSPSASSSSSFRWQSEASSKDHASQLSPVLSRSPSGDRPAVGHSGLKPLSGETPLSAYKVKSRTKIIRRRSSTSLPGDKKSGTSPAATAKSHLSLRRRQALRGKSSPVLKKTPNKGLVQVTTHRLCRLPPSRAHLPTKEASSLHAVRTAPTSKVIKTRYRIVKKTPASPLSAPPFPLSLPSWRARRLSLSRSLVLNRLRPVASGGGKAQPGSPWWRSKGYRCIGGVLYKVSANKLSKTSGQPSDAGSRPLLRTGRLDPAGSCSRSLASRAVQRSLAIIRQARQRREKRKEYCMYYNRFGRCNRGERCPYIHDPEKVAVCTRFVRGTCKKTDGTCPFSHHVSKEKMPVCSYFLKGICSNSNCPYSHVYVSRKAEVCSDFLKGYCPLGAKCKKKHTLLCPDFARRGACPRGAQCQLLHRTQKRHSRRAATSPAPGPSDATARSRVSASHGPRKPSASQRPTRQTPSSAALTAAAVAAPPHCPGGSASPSSSKASSSSSSSSSPPASLDHEAPSLQEAALAAACSNRLCKLPSFISLQSSPSPGAQPRVRAPRAPLTKDSGKPLHIKPRL

SEQ ID NO: 6476 - protein, 971 aa, Homo sapiens
MSNVSEERRKRQQNIKEGLQFIQSPLSYPGTQEQYAVYLRALVRNLFNEGNDVYREHDWNNSISQYTEALNIADYAKSEEILIPKEIIEKLYINRIACYSNMGFHDKVLEDCNIVLSLNASNCKALYRKSKALSDLGRYKKAYDAVAKCSLAVPQDEHVIKLTQELAQKLGFKIRKAYVRAELSLKSVPGDGATKALNHSVEDIEPDLLTPRQEAVPVVSLPAPSFSHEVGSELASVPVMPLTSILPLQVEESALPSAVLANGGKMPFTMPEAFLDDGDMVLGDELDDLLDSAPETNETVMPSALVRGPLQTASVSPSMPFSASLLGTLPIGARYAPPPSFSEFYPPLTSSLEDFCSSLNSFSMSESKRDLSTSTSREGTPLNNSNSSLLLMNGPGSLFASENFLGISSQPRNDFGNFFGSAVTKPSSSVTPRHPLEGTHELRQACQICFVKSGPKLMDFTYHANIDHKCKKDILIGRIKNVEDKSWKKIRPRPTKTNYEGPYYICKDVAAEEECRYSGHCTFAYCQEEIDVWTLERKGAFSREAFFGGNGKINLTVFKLLQEHLGEFIFLCEKCFDHKPRMISKRNKDNSTACSHPVTKHEFEDNKCLVHILRETTVKYSKIRSFHGQCQLDLCRHEVRYGCLREDECFYAHSLVELKVWIMQNETGISHDAIAQESKRYWQNLEANVPGAQVLGNQIMPGFLNMKIKFVCAQCLRNGQVIEPDKNRKYCSAKARHSWTKDRRAMRVMSIERKKWMNIRPLPTKKQMPLQFDLCNHIASGKKCQYVGNCSFAHSPEEREVWTYMKENGIQDMEQFYELWLKSQKNEKSEDIASQSNKENGKQIHMPTDYAEVTVDFHCWMCGKNCNSEKQWQGHISSEKHKEKVFHTEDDQYCWQHRFPTGYFSICDRYMNGTCPEGNSCKFAHGNAELHEWEERRDALKMKLNKARKDHLIGPNDNDFGKYSFLFKDLN

SEQ ID NO: 6477 - protein, 971 aa, Homo sapiens; identical to SEQ ID NO: 6476

SEQ ID NO: 6478 - protein, 977 aa, Homo sapiens
MERQKRKADIEKGLQFIQSTLPLKQEEYEAFLLKLVQNLFAEGNDLFREKDYKQALVQYMEGLNVADYAASDQVALPRELLCKLHVNRAACYFTMGLYEKALEDSEKALGLDSESIRALFRKARALNELGRHKEAYECSSRCSLALPHDESVTQLGQELAQKLGLRVRKAYKRPQELETFSLLSNGTAAGVADQGTSNGLGSIDDIETDCYVDPRGSPALLPSTPTMPLFPHVLDLLAPLDSSRTLPSTDSLDDFSDGDVFGPELDTLLDSLSLVQGGLSGSGVPSELPQLIPVFPGGTPLLPPVVGGSIPVSSPLPPASFGLVMDPSKKLAASVLDALDPPGPTLDPLDLLPYSETRLDALDSFGSTRGSLDKPDSFMEETNSQDHRPPSGAQKPAPSPEPCMPNTALLIKNPLAATHEFKQACQLCYPKTGPRAGDYTYREGLEHKCKRDILLGRLRSSEDQTWKRIRPRPTKTSFVGSYYLCKDMINKQDCKYGDNCTFAYHQEEIDVWTEERKGTLNRDLLFDPLGGVKRGSLTIAKLLKEHQGIFTFLCEICFDSKPRIISKGTKDSPSVCSNLAAKHSFYNNKCLVHIVRSTSLKYSKIRQFQEHFQFDVCRHEVRYGCLREDSCHFAHSFIELKVWLLQQYSGMTHEDIVQESKKYWQQMEAHAGKASSSMGAPRTHGPSTFDLQMKFVCGQCWRNGQVVEPDKDLKYCSAKARHCWTKERRVLLVMSKAKRKWVSVRPLPSIRNFPQQYDLCIHAQNGRKCQYVGNCSFAHSPEERDMWTFMKENKILDMQQTYDMWLKKHNPGKPGEGTPISSREGEKQIQMPTDYADIMMGYHCWLCGKNSNSKKQWQQHIQSEKHKEKVFTSDSDASGWAFRFPMGEFRLCDRLQKGKACPDGDKCRCAHGQEELNEWLDRREVLKQKLAKARKDMLLCPRDDDFGKYNFLLQEDGDLAGATPEAPAAAATATTGE

SEQ ID NO: 6479 - protein, 977 aa, Homo sapiens; identical to SEQ ID NO: 6478

SEQ ID NO: 6480 - protein, 291 aa, Homo sapiens [sequence omitted]

SEQ ID NO: 6481 - protein, 291 aa, Homo sapiens [sequence omitted]

SEQ ID NO: 6482 - protein, 281 aa, Homo sapiens
MAEAAPARDPETDKHTEDQSPSTPLPQPAAEKNSYLYSTEITLWTVVAAIQALEKKVDSCLTRLLTLEGRTGTAEKKLADCEKTAVEFGNQLEGKWAVLGTLLQEYGLLQRRLENVENLLRNRNFWILRLPPGSKGEAPKVPVTFDDVAVYFSELEWGKLEDWQKELYKHVMRGNYETLVSLDYAISKPDILTRIERGEEPCLDRWGQEKGNEVEVGRPRMMGTGLPPYPEHLTSPLSPAQEELKEGQAPKQQQDSEARVAPAGPEAGLALRTDLQGEAQI

SEQ ID NO: 6483 - protein, 179 aa, Homo sapiens
MAEAAAPPDWHCGLTSRERPRSDLQRSPFRLSWLLFRWWRRRWNPRLPGYRAWRDACGQPRRSWLTARRWLWSSGTSWRALVNGGASLVCGSQVGLVSSEWLCQKGLVYDRNAGQLERPQAFCPGSSKRKGQVGGASRAHRRPLWHTCAQVRHAGPCLLRPVSLGLRRHGVPWGASQRL

SEQ ID NO: 6484 - protein, 546 aa, Homo sapiens
MAEAAPARDPETDKHTEDQSPSTPLPQPAAEKNSYLYSTEITLWTVVAAIQALEKKVDSCLTRLLTLEGRTGTAEKKLADCEKTAVEFGNQLEGKWAVLGTLLQEYGLLQRRLENVENLLRNRNFWILRLPPGSKGEAPKVPVTFDDVAVYFSELEWGKLEDWQKELYKHVMRGNYETLVSLDYAISKPDILTRIERGEEPCLDRWGQEKGNEVEVGRPRMMGTGLPPYPEHLTSPLSPAQEELKEGQAPKQQQDSEARVAPAGPEAGGGVAIKTEAQSEDEMTPERLFLGVSRGQTECRIPRGPRNRPGGPSRHQAQGMPRVRAGEPRPPGASGETPRVLSRRRQRAFPCPDCGQSFRLKINLTIHQRTHVEEGRQEAPGRSPTSCGDSQAMLEPGEVVVPGPVIRWLPEEPEGRRSVAGGRALVGRRPAASKMYHCSECLRFFQQRKSLLLHQRLHTGNGQGWPACPYCGKAFRRPSDLFRHQRIHTGERPYQCPQCGRTFNRNHHLAVHMQTHARGQVGPHFPAAPARHGSLPLPWPSRKEEG

SEQ ID NO: 6485 - protein, 281 aa, Homo sapiens; identical to SEQ ID NO: 6482

SEQ ID NO: 6486 - protein, 862 aa, Homo sapiens [sequence omitted]

SEQ ID NO: 6487 - protein, 100 aa, Homo sapiens
MATLNSASTTGTTPSPGHNAPSLPSDTFSSSTPSDPVTKDPPAASSTSENMRSSEPGGQLLESGCGLVPPKEIGEPQEGPDCGHFPPNDPGVEKDKEQEE

SEQ ID NO: 6488 - protein, 2572 aa, Homo sapiens
MATLNSASTTGTTPSPGHNAPSLPSDTFSSSTPSDPVTKDPPAASSTSENMRSSEPGGQLLESGCGLVPPKEIGEPQEGPDCGHFPPNDPGVEKDKEQEEEEEGLPPMDLSNHLFFTAGGEAYLVAKLSLPGGSELLLPKGFPWGEAGIKEEPSLPFLAYPPPSHLTALHIQHGFDPIQGFSSSDQILSHDTSAPSPAACEERHGAFWSYQLAPNPPGDPKDGPMGNSGGNHVAVFWLCLLCRLGFSKPQAFMDHTQSHGVKLTPAQYQGLSGSPAVLQEGDEGCKALISFLEPKLPARPSSDIPLDNSSTVNMEANVAQTEDGPPEAEVQALILLDEEVMALSPPSPPTATWDPSPTQAKESPVAAGEAGPDWFPEGQEEDGGLCPPLNQSSPTSKEGGTLPAPVGSPEDPSDPPQPYRLADDYTPAPAAFQGLSLSSHMSLLHSRNSCKTLKCPKCNWHYKYQQTLDVHMREKHPESNSHCSYCSAGGAHPRLARGESYNCGYKPYRCDVCNYSTTTKGNLSIHMQSDKHLANLQGFQAGPGGQGSPPEASLPPSAGDKEPKTKSSWQCKVCSYETNISRNLRIHMTSEKHMQNVLMLHQGLPLGLPPGLMGPGPPPPPGATPTSPPELFQYFGPQALGQPQTPLAGPGLRPDKPLEAQLLLNGFHHVGAPARKFPTSAPGSLSPDAHLPPSQLLGSSSDSLPTSPPPDDSLSLKVFRCLVCQAFSTDSLELLLYHCSIGRSLPEAEWKEVAGDTHRCKLCCYGTQLKANFQLHLKTDKHAQKYQLAAHLREGGGAMGTPSPASLGDGAPYGSVSPLHLRCNICDFESNSKEKMQLHARGAAHEENSQIYKFLLDMEGAEAGAELGLYHCLLCAWETPSRLAVLQHLRTPAHRDAQAQRRLQLLQNGPTTEEGLAALQSILSFSHGQLRTPGKAPVTPLAEPPTPEKDAQNKTEQLASEETENKTGPSRDSANQTTVYCCPYCSFLSPESSQVRAHTLSQHAVQPKYRCPLCQEQLVGRPALHFHLSHLHNVVPECVEKLLLVATTVEMTFTTKVLSAPTLSPLDNGQEPPTHGPEPTPSRDQAAEGPNLTPEASPDPLPEPPLASVEVPDKPSGSPGQPPSPAPSPVPEPDAQAEDVAPPPTMAEEEEGTTGELRSAEPAPADSRHPLTYRKTTNFALDKFLDPARPYKCTVCKESFTQKNILLVHYNSVSHLHKMKKAAIDPSAPARGEAGAPPTTTAATDKPFKCTVCRVSYNQSSTLEIHMRSVLHQTRSRGTKTDSKIEGPERSQEEPKEGETEGEVGTEKKGPDTSGFISGLPFLSPPPPPLDLHRFPAPLFTPPVLPPFPLVPESLLKLQQQQLLLPFYLHDLKVGPKLTLAGPAPVLSLPAATPPPPPQPPKAELAEREWERPPMAKEGNEAGPSSPPDPLPNEAARTAAKALLENFGFELVIQYNEGKQAVPPPPTPPPPEALGGGDKLACGACGKLFSNMLILKTHEEHVHRRFLPFEALSRYAAQFRKSYDSLYPPLAEPPKPPDGSLDSPVPHLGPPFLVPEPEAGGTRAPEERSRAGGHWPIEEEESSRGNLPPLVPAGRRFSRTKFTEFQTQALQSFFETSAYPKDGEVERLASLLGLASRVVVVWFQNARQKARKNACEGGSMPTGGGTGGASGCRRCHATFSCVFELVRHLKKCYDDQTLEEEEEEAERGEEEEEVEEEEVEEEQGLEPPAGPEGPLPEPPDGEELSQAEATKAGGKEPEEKATPSPSPAHTCDQCAISFSSQDLLTSHRRLHFLPSLQPSAPPQLLDLPLLVFGERNPLVAATSPMPGPPLKRKHEDGSLSPTGSEAGGGGEGEPPRDKRLRTTILPEQLEILYRWYMQDSNPTRKMLDCISEEVGLKKRVVQVWFQNTRARERKGQFRSTPGGVPSPAVKPPATATPASLPKFNLLLGKVDDGTGREAPKREAPAFPYPTATLASGPQPFLPPGKEATTPTPEPPLPLLPPPPPSEEEGPEEPPKASPESEACSLSAGDLSDSSASSLAEPESPGAGGTSGGPGGGTGVPDGMGQRRYRTQMSSLQLKIMKACYEAYRTPTMQECEVLGEEIGLPKRVIQVWFQNARAKEKKAKLQGTAAGSTGGSSEGLLAAQRTDCPYCDVKYDFYVSCRGHLFSRQHLAKLKEAVRAQLKSESKCYDLAPAPEAPPALKAPPATTPASMPLGAAPTLPRLAPVLLSGPALAQPPLGNLAPFNSGPAASSGLLGLATSVLPTTTVVQTAGPGRPLPQRPMPDQTNTSTAGTTDPVPGPPTEPLGDKVSSERKPVAGPTSSSNDALKNLKALKTTVPALLGGQFLPFPLPPAGGTAPPAVFGPQLQGAYFQQLYGMKKGLFPMNPMIPQTLIGLLPNALLQPPPQPPEPTATAPPKPPELPAPGEGEAGEVDELLTGSTGISTVDVTHRYLCRQCKMAFDGEAPATAHQRSFCFFGRGSGGSMPPPLRVPICTYHCLACEVLLSGREALASHLRSSAHRRKAAPPQGGPPISITNAATAASAAVAFAKEEARLPHTDSNPKTTTTSTLLAL

SEQ ID NO: 6489 - protein, 408 aa, Homo sapiens
MATLNSASTTGTTPSPGHNAPSLPSDTFSSSTPSDPVTKDPPAASSTSENMRSSEPGGQLLESGCGLVPPKEIGEPQEGPDCGHFPPNDPGVEKDKEQEEEEEGLPPMDLSNHLFFTAGGEAYLVAKLSLPGGSELLLPKGFPWGEAGIKEEPSLPFLAYPPPSHLTALHIQHGFDPIQGFSSSDQILSHDTSAPSPAACEERHGAFWSYQLAPNPPGDPKDGPMGNSGGNHVAVFWLCLLCRLGFSKPQAFMDHTQSHGVKLTPAQYQGLSGSPAVLQEGDEGCKALISFLEPKLPARPSSDIPLDNSSTVNMEANVAQTEDGPPEAEVQALILLDEEVMALSPPSPPTATWGYTTACCVRGRHPPAWLCCNTCAHLPTAMPRPRGVCSCYRMAQPLRKDSQLFRAS

SEQ ID NO: 6490 - protein, 246 aa, Homo sapiens
MATLNSASTTGTTPSPGHNAPSLPSDTFSSSTPSDPVTKDPPAASSTSENMRSSEPGGQLLESGCGLVPPKEIGEPQEGPDCGHFPPNDPGVEKDKEQEEEEEGLPPMDLSNHLFFTAGGEAYLVAKLSLPGGSELLLPKGFPWGEAGIKEEPSLPFLAYPPPSHLTALHIQHGFDPIQGFSSSDQILSHDTSAPSPAACEERHGAFWSYQLAPNPPGDPKDGPMGNSGGNHVAVFWLCLLCRLGF

SEQ ID NO: 6491 - protein, 527 aa, Homo sapiens
MYQPEDDNNSDVTSDDDMTRNRRESSPPHSVHSFSGDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLGFLAQDSVPAEKRNTEMLDNLPSAGSQFPDFKHLGTFLVFEELVTFEDVLVDFSPEELSSLSAAQRNLYREVMLENYRNLVSLGHQFSKPDIISRLEEEESYAMETDSRHTVICQGESHDDPLEPHQGNQEKLLTPITMNDPKTLTPERSYGSDEFERSSNLSKQSKDPLGKDPQEGTAPGICTSPQSASQENKHNRCEFCKRTFSTQVALRRHERIHTGKKPYECKQCAEAFYLMPHLNRHQKTHSGRKTSGCNEGRKPSVQCANLCERVRIHSQEDYFECFQCGKAFLQNVHLLQHLKAHEAARVLPPGLSHSKTYLIRYQRKHDYVGERACQCCDCGRVFSRNSYLIQHYRTHTQERPYQCQLCGKCFGRPSYLTQHYQLHSQEKTVECDHC

SEQ ID NO: 6492 - protein, 527 aa, Homo sapiens; identical to SEQ ID NO: 6491

SEQ ID NO: 6493 - protein, 527 aa, Homo sapiens; identical to SEQ ID NO: 6491

SEQ ID NO: 6494 - protein, 527 aa, Homo sapiens; identical to SEQ ID NO: 6491

SEQ ID NO: 6495 - protein, 527 aa, Homo sapiens; identical to SEQ ID NO: 6491

SEQ ID NO: 6496 - protein, 568 aa, Homo sapiens
MARLTKRRQADTKAIQHLWAAIEIIRNQKQIANIDRITKYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWVNTSLF

SEQ ID NO: 6497 - protein, 407 aa, Homo sapiens
MNKSQGSVSFTDVTVDFTQEEWEQLDPSQRILYMDVMLENYSNLLSVEVWKADDQMERDHRNPDEQARQFLILKNQTPIEERGDLFGKALNLNTDFVSLRQVPYKYDLYEKTLKYNSDLLNSNRSYAGKQTDECNEFGKALLYLKQEKTHSGVEYSEYNKSGKALSHKAAIFKHQKIKNLVQPFICTYCDKAFSFKSLLISHKRIHTGEKPYECNVCKKTFSHKANLIKHQRIHTGEKPFECPECGKAFTHQSNLIVHQRAHMEKKPYECSECGKTFAQKFELTTHQRIHTGERPYECNECAKTFFKKSNLIIHQKIHTGEKRYECSECGKSFIQNSQLIIHMRTHTGEKPYECTECGKTFSQRSTLRLHLRIHTGEKPYECSECGKAFSRKSRLSVHQRVHIGEKP

SEQ ID NO: 6498 - protein, 407 aa, Homo sapiens; identical to SEQ ID NO: 6497

SEQ ID NO: 6499 - protein, 533 aa, Homo sapiens
MAHGSVTFRDVAIDFSQEEWEFLDPAQRDLYRDVMWENYSNFISLGPSISKPDVITLLDEERKEPGMVVREGTRRYCPDLESRYRTNTLSPEKDIYEIYSFQWDIMERIKSYSLQGSIFRNDWECKSKIEGEKEQQEGYFGQVKITSEKMTTYKRHNFLTEYQIVHNGEKVYECKECRKTFIRRSTLSQHLRIHTGEKPYKCKECGQAFRQRAHLIRHHKLHTGEKPYECKECGKAFTVLQELTQHQRLHTGEKPYECKECGKAFRVHQQLARHQRIHTGEKPYECKDCGKTFRQCTHLTRHQRLHTAEKLYECKECGKAFVCGPDLRVHQKIHFGEKPYECKECGKAFRICQQLTVHQSIHTGEKPYECKECGKTFRLRQQLVRHQRIHTREKPYECMECWKTFSSYSQLISHQSIHIGERPYECEECGKAFRLLSQLTQHQSIHTGEKPYECKECRKPFRLLSQLTQHQSIHTGEKPYECKECGKAFRLYSFLTQHQRIHTGEKPYKCKECKKAFRQHSHLTQHQKIHNGI

SEQ ID NO: 6500 - protein, 533 aa, Homo sapiens
VAHGSVTFRDVAIDFSQEEWEFLDPAQRDLYRDVMWENYSNFISLGPSISKPDVITLLDEERKEPGMVVREGTRRYCPDLESRYRTNTLSPEKDIYEIYSFQWDIMERIKSYSLQGSIFRNDWECKSKIEGEKEQQEGYFGQVKITSEKMTTYKRHNFLTEYQIVHNGEKVYECKECRKTFIRRSTLSQHLRIHTGEKPYKCKECGQAFRQRAHLIRHHKLHTGEKPYECKECGKAFTVLQELTQHQRLHTGEKPYECKECGKAFRVHQQLARHQRIHTGEKPYECKDCGKTFRQCTHLTRHQRLHTAEKLYECKECGKAFVCGPDLRVHQKIHFGEKPYECKECGKAFRICQQLTVHQSIHTGEKPYECKECGKTFRLRQQLVRHQRIHTREKPYECMECWKTFSSYSQLISHQSIHIGERPYECEECGKAFRLLSQLTQHQSIHTGEKPYECKECRKPFRLLSQLTQHQSIHTGEKPYECKECGKAFRLYSFLTQHQRIHTGEKPYKCKECKKAFRQHSHLTQHQKIHNGI

SEQ ID NO: 6501 - protein, 754 aa, Homo sapiens
MTTAGRGNLGLIPRSTAFQKQEGRLTVKQEPANQTWGQGSSLQKNYPPVCEIFRLHFRQLCYHEMSGPQEALSRLRELCRWWLMPEVHTKEQILELLVLEQFLSILPGELRTWVQLHHPESGEEAVAVVEDFQRHLSGSEEVSAPAQKQEMHFEETTALGTTKESPPTSPLSGGSAPGAHLEPPYDPGTHHLPSGDFAQCTSPVPTLPQVGNSGDQAGATVLRMVRPQDTVAYEDLSVDYTQKKWKSLTLSQRALQWNMMPENHHSMASLAGENMMKGSELTPKQEFFKGSESSNRTSGGLFGVVPGAAETGDVCEDTFKELEGQTSDEEGSRLENDFLEITDEDKKKSTKDRYDKYKEVGEHPPLSSSPVEHEGVLKGQKSYRCDECGKAFNRSSHLIGHQRIHTGEKPYECNECGKTFRQTSQLIVHLRTHTGEKPYECSECGKAYRHSSHLIQHQRLHNGEKPYKCNECAKAFTQSSRLTDHQRTHTGEKPYECNECGEAFIRSKSLARHQVLHTGKKPYKCNECGRAFCSNRNLIDHQRIHTGEKPYECSECGKAFSRSKCLIRHQSLHTGEKPYKCSECGKAFNQNSQLIEHERIHTGEKPFECSECGKAFGLSKCLIRHQRLHTGEKPYKCNECGKSFNQNSHLIIHQRIHTGEKPYECNECGKVFSYSSSLMVHQRTHTGEKPYKCNDCGKAFSDSSQLIVHQRVHTGEKPYECSECGKAFSQRSTFNHHQRTHTGEKSSGLAWSVS

SEQ ID NO: 6502 - protein, 203 aa, Homo sapiens
SKCLIRHQSLHTGEKPYKCSECGKAFNQNSQLIEHERIHTGEKPFECSECGKAFGLSKCLIRHQRLHTGEKPYKCNECGKSFNQNSHLIIHQRIHTGEKPYECNECGKVFSYSSSLMVHQRTHTGEKPYKCNDCGKAFSDSSQLIVHQRVHTGEKPYECSECGKAFSQRSTFNHHQRTHTGEVLRSGLVSFLRYGSETESNDL

SEQ ID NO: 6503 - protein, 276 aa, Homo sapiens
MTTAGRGNLGLIPRSTAFQKQEGRLTVKQEPANQTWGQGSSLQKNYPPVCEIFRLHFRQLCYHEMSGPQEALSRLRELCRWWLMPEVHTKEQILELLVLEQFLSILPGELRTWVQLHHPESGEEAVAVVEDFQRHLSGSEEVSAPAQKQEMHFEETTALGTTKESPPTSPLSGGSAPGAHLEPPYDPGTHHLPSGDFAQCTSPVPTLPQVGNSGDQAGATVLRMVRPQDTVAYEDLSVDYTQKKWKSLTLSQRALQWNMMPENHHSMASLGWSTMA

SEQ ID NO: 6504 - protein, 754 aa, Homo sapiens; identical to SEQ ID NO: 6501

SEQ ID NO: 6505 - protein, 276 aa, Homo sapiens; identical to SEQ ID NO: 6503

SEQ ID NO: 6506 - protein, 662 aa, Homo sapiens
MNLTEDYMVFEDVAIHFSQEEWGILNDVQRHLHSDVMLENFALLSSVGCWHGAKDEEAPSKQCVSVGVSQVTTLKPALSTQKAQPCETCSSLLKDILHLAEHDGTHPKRTAKLYLHQKEHLREKLTRSDEGRPSFVNDSVHLAKRNLTCMQGGKDFTGDSDLQQQALHSGWKPHRDTHGVEAFQSGQNNYSCTQCGKDFCHQHTLFEHQKIHTEERPYECSECGKLFRYNSDLIKHQRNHTGERPYKCSECGKAFSLKYNVVQHQKIHTGERPYECSECGKAFLRKSHLLQHQRIHTRPRPYVCSECGKAFLTQAHLVGHQKIHTGERPYGCNECGKYFMYSSALIRHQKVHTGERPFYCCECGKFFMDSCTLIIHQRVHTGEKPYECNECGKFFRYRSTLIRHQKVHTGEKPYECSECGKFFMDTSTLIIHQRVHTGEKPYECNKCGKFFRYCFTLNRHQRVHSGERPYECSECGKFFVDSCTLKSHQRVHTGERPFECSICGKSFRCRSTLDTHQRIHTGERPYECSECGKFFRHNSNHIRHRRNHFGERSFECTECGRVFSQNSHLIRHQKVHTRERTYKCSKCGKFFMDSSTLISHERVHTGEKPYECSECGKVFRYNSSLIKHRRIHTGERPYQCSECGRVFNQNSHLIQHQKVHTR

SEQ ID NO: 6507 - protein, 662 aa, Homo sapiens; identical to SEQ ID NO: 6506

SEQ ID NO: 6508 - protein, 1029 aa, Homo sapiens
MTRENVAHNALRQEGLVKGKDDTWKWGTSFQGSSSSVWETSHLHFRQLRYHETSGPQEALSRLRELCRRWLRPEARTKAQILELLVLEQFLSILPGEIRTWVQLHHPGSGEEAVALVEELQKDLDGPAIQVPVLVKDQDTLQKVVSAPGTTLPPVLPGSHIAAEICPHPPTDLVAFNLQDPQHDSPAPEASALSQEENPRNQLMALMLLTAQPQELVMFEEVSVCFTSEEWACLGPIQRALYWDVMLENYGNVTSLEWETMTENEEVTSKPSSSQRADSHKGTSKRLQGSVPQVLDFEEECEWQVLASQWGNETDERADTVKKVSLCERDKKKRTPPEKQGQKWKELGDSLTFGSAISESLIGTEGKKFYKCDMCCKHFNKISHLINHRRIHTGEKPHKCKECGKGFIQRSSLLMHLRNHSGEKPYKCNECGKAFSQSAYLLNHQRIHTGEKPYKCKECGKGFYRHSGLIIHLRRHSGERPYKCNECGKVFSQNAYLIDHQRLHKGEEPYKCNKCQKAFILKKSLILHQRIHSGEKPYKCDECGKTFAQTTYLIDHQRLHSAENPYKCKECGKVFIRSKSLLLHQRVHTEKKTFGCKKCGKIFSSKSNFIDHKRMHSREKPYKCTECGKAFTQSAYLFDHQRLHNGEKPYECNECGKVFILKKSLILHQRFHTGENLYECKDCGKVFGSNRNLIDHERLHNGEKPYECRECGKTFIMSKSFMVHQKLHTQEKAYKCEDCGKAFSYNSSLLVHRRIHTGEKPFECSECGRAFSSNRNLIEHKRIHSGEKPYECDECGKCFILKKSLIGHQRIHTREKSYKCNDCGKVFSYRSNLIAHQRIHTGEKPYACSECGKGFTYNRNLIEHQRIHSGEKTYECHVCRKVLTSSRNLMVHQRIHTGEKPYKCNECGKDFSQNKNLVVHQRMHTGEKPYECDKCRKSFTSKRNLVGHQRIHTGEKPYGCNDCSKVFRQRKNLTVHQKIHTDEKPCECDVSEKEFSQTSNLHLQQKIHTIEEFSWLQNTNESKIEIQKI

SEQ ID NO: 6509 - protein, 267 aa, Homo sapiens
MTRENVAHNALRQEGLVKGKDDTWKWGTSFQGSSSSVWETSHLHFRQLRYHETSGPQEALSRLRELCRRWLRPEARTKAQILELLVLEQFLSILPGEIRTWVQLHHPGSGEEAVALVEELQKDLDGPAIQVPVLVKDQDTLQKVVSAPGTTLPPVLPGSHIAAEICPHPPTDLVAFNLQDPQHDSPAPEASALSQEENPRNQLMALMLLTAQPQELVMFEEVSVCFTSEEWACLGPIQRALYWDVMLENYGNVTSLGYRKYRRQRNK

SEQ ID NO: 6510 - protein, 267 aa, Homo sapiens; identical to SEQ ID NO: 6509

SEQ ID NO: 6511 - protein, 1029 aa, Homo sapiens; identical to SEQ ID NO: 6508

SEQ ID NO: 6512 - protein, 79 aa, Homo sapiens
MTRENVAHNALRQEGLVKGKDDTWKWGTSFQGSSSSVWETSHLHFRQLRYHETSGPQEALSRLRELCRRWLRPEARTKA

SEQ ID NO: 6513 - protein, 321 aa, Homo sapiens
MTRENVAHNALRQEGLVKGKDDTWKWGTSFQGSSSSVWETSHLHFRQLRYHETSGPQEALSRLRELCRRWLRPEARTKAQILELLVLEQFLSILPGEIRTWVQLHHPGSGEEAVALVEELQKDLDGPAIQVPVLVKDQDTLQKVVSAPGTTLPPVLPGSHIAAEICPHPPTDLVAFNLQDPQHDSPAPEASALSQEENPRNQLMALMLLTAQPQELVMFEEVSVCFTSEEWACLGPIQRALYWDVMLENYGNVTSLEWETMTENEEVTSKPSSSQRADSHKGTSKRLQGSVPQVLDFEEECEWQVLASQWGNETDERADTV

SEQ ID NO: 6514 - protein, 461 aa, Homo sapiens
MEREGIWHSTLGETWEPNNWLEGQQDSHLSQVGVTHKETFTEMRVCGGNEFERCSSQDSILDTQQSIPMVKRPHNCNSHGEDATQNSELIKTQRMFVGKKIYECNQCSKTFSQSSSLLKHQRIHTGEKPYKCNVCGKHFIERSSLTVHQRIHTGEKPYKCNECGKAFSQSMNLTVHQRTHTGEKPYQCKECGKAFHKNSSLIQHERIHTGEKPYKCNECGKAFTQSMNLTVHQRTHTGEKPYECNECGKAFSQSMHLIVHQRSHTGEKPYECSQCGKAFSKSSTLTLHQRNHTGEKPYKCNKCGKSFSQSTYLIEHQRLHSGVKPFECNECGKAFSKNSSLTQHRRIHTGEKPYECMVCGKHFTGRSSLTVHQVIHTGEKPYECNECGKAFSQSAYLIEHQRIHTGEKPYECDQCGKAFIKNSSLTVHQRTHTGEKPYQCNECGKAFSRSTNLTRHQRTHT

SEQ ID NO: 6515 - protein, 461 aa, Homo sapiens; identical to SEQ ID NO: 6514

SEQ ID NO: 6516 - protein, 461 aa, Homo sapiens; identical to SEQ ID NO: 6514

SEQ ID NO: 6517 - protein, 23 aa, Homo sapiens
MEREGIWHSTLGETWEPNNWLEG

SEQ ID NO: 6518 - protein, 9 aa, Homo sapiens
MEREGIWHS

SEQ ID NO: 6519 - protein, 461 aa, Homo sapiens; identical to SEQ ID NO: 6514

SEQ ID NO: 6520 - protein, 577 aa, Homo sapiens
MLGFPPGRPQLPVQLRPQTRMATALRDPASVPIATEVLFKLTQGSVTFEDVAVYFSWEEWDLLDEAQKHLYFDVMLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 6521 - protein, 555 aa, Homo sapiens
MLENFALTSSLGLISSWSHVVAQLGLGEVPSVLHRMFMTPASARWDQRGPGLHEWHLGKGMSSGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 6522 - protein, 564 aa, Homo sapiens
MLGFPPGRPQLPVQLRPQTRMATALRDPASGSVTFEDVAVYFSWEEWDLLDEAQKHLYFDVMLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 6523 - protein, 503 aa, Homo sapiens
MLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 6524 - protein, 568 aa, Homo sapiens
MISAYCNLHLLGSSDSPASASQVAGTTGMRHHAQGSVTFEDVAVYFSWEEWDLLDEAQKHLYFDVMLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 6525 - protein, 555 aa, Homo sapiens; identical to SEQ ID NO: 6521

SEQ ID NO: 6526 - protein, 576 aa, Homo sapiens
MRTLRQREVEYFSKATQLVRGSTKDRGAQVPIATEVLFKLTQGSVTFEDVAVYFSWEEWDLLDEAQKHLYFDVMLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 6527 - protein, 629 aa, Homo sapiens
MLGFPPGRPQLPVQLRPQTRMATALRDPASVPIATEVLFKLTQGSVTFEDVAVYFSWEEWDLLDEAQKHLYFDVMLENFALTSSLGLISSWSHVVAQLGLGEVPSVLHRMFMTPASARWDQRGPGLHEWHLGKGMSSGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 6528 - protein, 38 aa, Homo sapiens
MLGFPPGRPQLPVQLRPQTRMATALRDPASAVQWKKRL

SEQ ID NO: 6529 - protein, 617 aa, Homo sapiens
MISPSLELLHSGLCKFPEVEGKMTTFKEAVTFKDVAVVFTEEELGLLDPAQRKLYRDVMLENFRNLLSVGNQPFHQDTFHFLGKEKFWKMKTTSQREGNSGGKIQIEMETVPEAGPHEEWSCQQIWEQIASDLTRSQNSIRNSSQFFKEGDVPCQIEARLSISHVQQKPYRCNECKQSFSDVSVFDLHQQSHSGEKSHTCGECGKSFCYSPALHIHQRVHMGEKCYKCDVCGKEFNQSSHLQTHQRVHTGEKPFKCGQCGKGFHSRSALNVHCKLHTGEKPYNCEECGKAFIHDSQLQEHQRIHTGEKPFKCDICGKSFRVRSRLNRHSMVHTGEKAFRCDTCGKNFRQRSALNSHSMVHIEEKPYKCEQCGKGFICRRDFCKHQMVHTGEKPYNCKECGKTFRWSSCLLNHQQVHSGQKSFKCEECGKGFYTNSRRSSHQRSHNGEKPYNCEECGKDYKRRLDLEFHQRVHTGERPYNCKECGKSFGWASCLLKHQRLHSGEKPFKCEECGKRFTQSSQLHSHQTCHTGEKLYKCEQCEKGYNSKFNLDMHQRVHGGERPYNCKECGKSFGWASCLLKHQRLHSGEKPLKSGVWEEIYSEFTASFTSVSLCGRKAI

SEQ ID NO: 6530 - protein, 47 aa, Homo sapiens
MTTFKEAVTFKDVAVVFTEEELGLLDPAQRKLYRDVMLENFRNLLSV

SEQ ID NO: 6531 - protein, 451 aa, Homo sapiens
MAKLYEAVTFKDVAVIFTEEELGLLDPAQRKLYRDVMLENFRNLLSVGGKIQTEMETVPEAGTHEEFSCKQIWEQIASDLTRSQDTTISNSQLFEQDDNPSQIKARLSTVHTREKPFQGENCKQFFSDVSFFDLPQQLYSGEKSHTCDECGKSFCYISALHIHQRVHMGVKCYKCDVCGKEFSQSSRLQTHQRVHTGEKPFKCEQCGKGFRCRSALKVHCKLHMREKPYNCEKCGKAFMHNFQLQKHHRIHTGEKPFKCEICGKSFCLRSSLNRHCMVHTAEKLYKSEKYGRGFIDRLDLHKHQMIHMGQKPYNCKECGKSFKWSSYLLVHQRVHTGEKPYKCEECGKGYISKSGLDFHHRTHTGERSYNCDNCGKSFRHASSILNHKKLHCQRKPLKCEDCGKRLVCRSYCKDQQRDHSGENPSKCEDCGKRYKRRLNLDIILSLFLNDI

SEQ ID NO: 6532 - protein, 397 aa, Homo sapiens [sequence omitted]

SEQ ID NO: 6533 - protein, 491 aa, Homo sapiens
MIDSGEKKPGRRAEEAVTFKDVAVIFTEEELGLLDPAQRKLYRDVMLENFRNLLSVGHQPFHGDTFHFLREEKFWVMGTTSQREGNLGGKIQTEMETVPEAGTHEEFSCKQIWEQIASDLTRSQDTTISNSQLFEQDDNPSQIKARLSTVHTREKPFQGENCKQFFSDVSFFDLPQQLYSGEKSHTCDECGKSFCYISALHIHQRVHMGVKCYKCDVCGKEFSQSSRLQTHQRVHTGEKPFKCEQCGKGFRCRSALKVHCKLHMREKPYNCEKCGKAFMHNFQLQKHHRIHTGEKPFKCEICGKSFCLRSSLNRHCMVHTAEKLYKSEKYGRGFIDRLDLHKHQMIHMGQKPYNCKECGKSFKWSSYLLVHQRVHTGEKPYKCEECGKGYISKSGLDFHHRTHTGERSYNCDNCGKSFRHASSILNHKKLHCQRKPLKCEDCGKRLVCRSYCKDQQRDHSGENPSKCEDCGKRYKRRLNLDIILSLFLNDI

SEQ ID NO: 6534 - protein, 482 aa, Homo sapiens
MTMSKEAVTFKDVAVVFTEEELGLLDLAQRKLYRDVMLENFRNLLSVGHQPFHRDTFHFLREEKFWMMDIATQREGNSGGKIQPEMKTFPEAGPHEGWSCQQIWEEIASDLTRPQDSTIKSSQFFEQGDAHSQVEEGLSIMHTGQKPSNCGKCKQSFSDMSIFDLPQQIRSAEKSHSCDECGKSFCYISALHIHQRVHLGEKLFKCDVCGKEFSQSLHLQTHQRVHTGEKPFKCEQCGRGFRCRSALTVHCKLHMGEKHYNCEACGRAFIHDFQLQKHQRIHTGEKPFKCEICSVSFRLRSSLNRHCVVHTGKKPNSTGEYGKGFIRRLDLCKHQTIHTGEKPYNCKECGKSFRRSSYLLIHQRVHTGEKPYKCDKCGKSYITKSGLDLHHRAHTGERPYNCDDCGKSFRQASSILNHKRLHCRKKPFKCEDCGKKLVYRSYRKDQQKNHSGENPSKCEDCGKRYKRRLNLDIILSLFLNDT

SEQ ID NO: 6535 - protein, 706 aa, Homo sapiens
MTTLKEAVTFKDVAVVFTEEELRLLDLAQRKLYREVMLENFRNLLSVGHQSLHRDTFHFLKEEKFWMMETATQREGNLGGKIQMEMETVSESGTHEGLFSHQTWEQISSDLTRFQDSMVNSFQFSKQDDMPCQVDAGLSIIHVRQKPSEGRTCKKSFSDVSVLDLHQQLQSREKSHTCDECGKSFCYSSALRIHQRVHMGEKLYNCDVCGKEFNQSSHLQIHQRIHTGEKPFKCEQCGKGFSRRSGLYVHRKLHTGVKPHICEKCGKAFIHDSQLQEHQRIHTGEKPFKCDICCKSFRSRANLNRHSMVHMREKPFRCDTCGKSFGLKSALNSHRMVHTGEKRYKCEECGKRFIYRQDLYKHQIDHTGEKPYNCKECGKSFRWASGLSRHVRVHSGETTFKCEECGKGFYTNSQRYSHQRAHSGEKPYRCEECGKGYKRRLDLDFHQRVHRGEKPYNCKECGKSFGWASCLLNHQRIHSGEKPFKCEECGKRFTQNSQLYTHRRVHSGEKPFKCEECGKRFTQNSQLYSHRRVHTGVKPYKCEECGKGFNSKFNLDMHQRVHTGERPYNCKECGKSFSRASSILNHKRLHGDEKPFKCEECGKRFTENSQLHSHQRVHTGEKPYKCEKCGKSFRWASTHLTHQRLHSREKLLQCEDCGKSIVHSSCLKDQQRDQSGEKTSKCEDCGKRYKRRLNLDTLLSLFLNDT

SEQ ID NO: 6536 - protein, 670 aa, Homo sapiens
MLENFRNLLSVGHQSLHRDTFHFLKEEKFWMMETATQREGNLGGKIQMEMETVSESGTHEGLFSHQTWEQISSDLTRFQDSMVNSFQFSKQDDMPCQVDAGLSIIHVRQKPSEGRTCKKSFSDVSVLDLHQQLQSREKSHTCDECGKSFCYSSALRIHQRVHMGEKLYNCDVCGKEFNQSSHLQIHQRIHTGEKPFKCEQCGKGFSRRSGLYVHRKLHTGVKPHICEKCGKAFIHDSQLQEHQRIHTGEKPFKCDICCKSFRSRANLNRHSMVHMREKPFRCDTCGKSFGLKSALNSHRMVHTGEKRYKCEECGKRFIYRQDLYKHQIDHTGEKPYNCKECGKSFRWASGLSRHVRVHSGETTFKCEECGKGFYTNSQRYSHQRAHSGEKPYRCEECGKGYKRRLDLDFHQRVHRGEKPYNCKECGKSFGWASCLLNHQRIHSGEKPFKCEECGKRFTQNSQLYTHRRVHSGEKPFKCEECGKRFTQNSQLYSHRRVHTGVKPYKCEECGKGFNSKFNLDMHQRVHTGERPYNCKECGKSFSRASSILNHKRLHGDEKPFKCEECGKRFTENSQLHSHQRVHTGEKPYKCEKCGKSFRWASTHLTHQRLHSREKLLQCEDCGKSIVHSSCLKDQQRDQSGEKTSKCEDCGKRYKRRLNLDTLLSLFLNDT

SEQ ID NO: 6537 - protein, 94 aa, Homo sapiens
MNMFKEAVTFKDVAVAFTEEELGLLGPAQRKLYRDVMVENFRNLLSVGHPPFKQDVSPIERNEQLWIMTTATRRQGNLDTLLVKALLLYDLAQT

SEQ ID NO: 6538 - protein, 803 aa, Homo sapiens
MNMFKEAVTFKDVAVAFTEEELGLLGPAQRKLYRDVMVENFRNLLSVGHPPFKQDVSPIERNEQLWIMTTATRRQGNLGEKNQSKLITVQDRESEEELSCWQIWQQIANDLTRCQDSMINNSQCHKQGDFPYQVGTELSIQISEDENYIVNKADGPNNTGNPEFPILRTQDSWRKTFLTESQRLNRDQQISIKNKLCQCKKGVDPIGWISHHDGHRVHKSEKSYRPNDYEKDNMKILTFDHNSMIHTGQKSYQCNECKKPFSDLSSFDLHQQLQSGEKSLTCVERGKGFCYSPVLPVHQKVHVGEKLKCDECGKEFSQGAHLQTHQKVHVIEKPYKCKQCGKGFSRRSALNVHCKVHTAEKPYNCEECGRAFSQASHLQDHQRLHTGEKPFKCDACGKSFSRNSHLQSHQRVHTGEKPYKCEECGKGFICSSNLYIHQRVHTGEKPYKCEECGKGFSRPSSLQAHQGVHTGEKSYICTVCGKGFTLSSNLQAHQRVHTGEKPYKCNECGKSFRRNSHYQVHLVVHTGEKPYKCEICGKGFSQSSYLQIHQKAHSIEKPFKCEECGQGFNQSSRLQIHQLIHTGEKPYKCEECGKGFSRRADLKIHCRIHTGEKPYNCEECGKVFRQASNLLAHQRVHSGEKPFKCEECGKSFGRSAHLQAHQKVHTGDKPYKCDECGKGFKWSLNLDMHQRVHTGEKPYKCGECGKYFSQASSLQLHQSVHTGEKPYKCDVCGKVFSRSSQLQSHQRVHTGEKPYKCEICGKSFSWRSNLTVHHRIHVGDKSYKSNRGGKNIRESTQEKKSIK

SEQ ID NO: 6539 - protein, 94 aa, Homo sapiens; identical to SEQ ID NO: 6537

SEQ ID NO: 6540 - protein, 700 aa, Homo sapiens
MTTFKEGLTFKDVAVVFTEEELGLLDPVQRNLYQDVMLENFRNLLSVGHHPFKHDVFLLEKEKKLDIMKTATQRKGKSADKIQSEVETVPEAGRHEELYWGQIWKQIASDLIKYEDSMISISRFPRQGDLSCQVRAGLYTTHTGQKFYQCDEYKKSFTDVFNFDLHQQLHSGEKSHTCDECGKSFCYISALHIHQRVHMGEKCYKCDVCGKEFSQSSHLQTHQRVHTVEKPFKCVECGKGFSRRSTLTVHCKLHSGEKPYNCEECGRAFIHASHLQEHQRIHTGEKPFKCDTCGKNFRRRSALNNHCMVHTGEKPYKCEDCGKCFTCSSNLRIHQRVHTGEKPYKCEECGKCFIQPSQFQAHRRIHTGEKPYVCKVCGKGFIYSSSFQAHQGVHTGEKPYKCNECGKSFRMKIHYQVHLVVHTGEKPYKCEVCGKAFRQSSYLKIHLKAHSVQKPFKCEECGQGFNQSSRLQIHQLIHTGEKPYKCEECGKGFSRRADLKIHCRIHTGEKPYNCEECGKVFSQASHLLTHQRVHSGEKPFKCEECGKSFSRSAHLQAHQKVHTGEKPYKCGECGKGFKWSLNLDMHQRVHTGEKPYTCGECGKHFSQASSLQLHQSVHTGEKPYKCDVCGKVFSRSSQLQYHRRVHTGEKPYKCEICGKRFSWRSNLVSHHKIHAAGTFYENDENSKNIRELSEGGSSTR

SEQ ID NO: 6541 - protein, 803 aa, Homo sapiens; identical to SEQ ID NO: 6538

SEQ ID NO: 6542 - protein, 68 aa, Homo sapiens
LKSPTSSELHVGEKLKCDECGKEFSQGAHLQTHQKVHVIEKPYKCKQCGKGFSRRSALNVHCKVHTAE

SEQ ID NO: 6543 - protein, 68 aa, Homo sapiens
HSGEKSHTCDECKASVTSQPFIHQRVHMGEKCYKCDVCGKEFSQSSHLQTHQRVHTVEKPFKCVECGK

SEQ ID NO: 6544 - protein, 799 aa, Homo sapiens
MPSQNYDLPQKKQEKMTKFQEAVTFKDVAVVFSREELRLLDLTQRKLYRDVMVENFKNLVAVGHLPFQPDMVSQLEAEEKLWMMETETQRSSKHQNKMETLQKFALKYLSNQELSCWQIWKQVASELTRCLQGKSSQLLQGDSIQVSENENNIMNPKGDSSIYIENQEFPFWRTQHSCGNTYLSESQIQSRGKQIDVKNNLQIHEDFMKKSPFHEHIKTDTEPKPCKGNEYGKIISDGSNQKLPLGEKPHPCGECGRGFSYSPRLPLHPNVHTGEKCFSQSSHLRTHQRIHPGEKLNRCHESGDCFNKSSFHSYQSNHTGEKSYRCDSCGKGFSSSTGLIIHYRTHTGEKPYKCEECGKCFSQSSNFQCHQRVHTEEKPYKCEECGKGFGWSVNLRVHQRVHRGEKPYKCEECGKGFTQAAHFHIHQRVHTGEKPYKCDVCGKGFSHNSPLICHRRVHTGEKPYKCEACGKGFTRNTDLHIHFRVHTGEKPYKCKECGKGFSQASNLQVHQNVHTGEKRFKCETCGKGFSQSSKLQTHQRVHTGEKPYRCDVCGKDFSYSSNLKLHQVIHTGEKPYKCEECGKGFSWRSNLHAHQRVHSGEKPYKCEQCDKSFSQAIDFRVHQRVHTGEKPYKCGVCGKGFSQSSGLQSHQRVHTGEKPYKCDVCGKGFRYSSQFIYHQRGHTGEKPYKCEECGKGFGRSLNLRHHQRVHTGEKPHICEECGKAFSLPSNLRVHLGVHTREKLFKCEECGKGFSQSARLEAHQRVHTGEKPYKCDICDKDFRHRSRLTYHQKVHTGKKL

SEQ ID NO: 6545 - protein, 756 aa, Homo sapiens
MTKFQEAVTFKDVAVVFSREELRLLDLTQRKLYRDVMVENFKNLVAVGSKHQNKMETLQKFALKYLSNQELSCWQIWKQVASELTRCLQGKSSQLLQGDSIQVSENENNIMNPKGDSSIYIENQEFPFWRTQHSCGNTYLSESQIQSRGKQIDVKNNLQIHEDFMKKSPFHEHIKTDTEPKPCKGNEYGKIISDGSNQKLPLGEKPHPCGECGRGFSYSPRLPLHPNVHTGEKCFSQSSHLRTHQRIHPGEKLNRCHESGDCFNKSSFHSYQSNHTGEKSYRCDSCGKGFSSSTGLIIHYRTHTGEKPYKCEECGKCFSQSSNFQCHQRVHTEEKPYKCEECGKGFGWSVNLRVHQRVHRGEKPYKCEECGKGFTQAAHFHIHQRVHTGEKPYKCDVCGKGFSHNSPLICHRRVHTGEKPYKCEACGKGFTRNTDLHIHFRVHTGEKPYKCKECGKGFSQASNLQVHQNVHTGEKRFKCETCGKGFSQSSKLQTHQRVHTGEKPYRCDVCGKDFSYSSNLKLHQVIHTGEKPYKCEECGKGFSWRSNLHAHQRVHSGEKPYKCEQCDKSFSQAIDFRVHQRVHTGEKPYKCGVCGKGFSQSSGLQSHQRVHTGEKPYKCDVCGKGFRYSSQFIYHQRGHTGEKPYKCEECGKGFGRSLNLRHHQRVHTGEKPHICEECGKAFSLPSNLRVHLGVHTREKLFKCEECGKGFSQSARLEAHQRVHTGEKPYKCDICDKDFRHRSRLTYHQKVHTGKKL

SEQ ID NO: 6546 - protein, 438 aa, Homo sapiens
HESGDCFNKSSFHSYQSNHTGEKSYRCDSCGKGFSSSTGLIIHYRTHTGEKPYKCEECGKCFSQSSNFQCHQRVHTEEKPYKCEECGKGFGWSVNLRVHQRVHRGEKPYKCEECGKGFTQAAHFHIHQRVHTGEKPYKCDVCGKGFSHNSPLICHRRVHTGEKPYKCEACGKGFTRNTDLHIHFRVHTGEKPYKCKECGKGFSQASNLQVHQNVHTGEKRFKCETCGKGFSQSSKLQTREKPYKCEQCDKSFSQAIDFRVHQRVHTGEKPYKCGVCGKGFSQSSGLQSHQRVHTGEKPYKCDVCGKGFRYSSQFIYHQRGHTGEKPYKCEECGKGFGRSLNLRHHQRVHTGEKPHICEECGKAFSLPSNLRVHLGVHTREKLFKCEECGKGFSQSARLEAHQRVHTGEKPYKCDICDKDFRHRSRLTYHQKVHTGKKL

SEQ ID NO: 6547 - protein, 748 aa, Homo sapiens
MVENFKNLVAVGHLPFQPDMVSQLEAEEKLWMMETETQRSSKHQNKMETLQKFALKYLSNQELSCWQIWKQVASELTRCLQGKSSQLLQGDSIQVSENENNIMNPKGDSSIYIENQEFPFWRTQHSCGNTYLSESQIQSRGKQIDVKNNLQIHEDFMKKSPFHEHIKTDTEPKPCKGNEYGKIISDGSNQKLPLGEKPHPCGECGRGFSYSPRLPLHPNVHTGEKCFSQSSHLRTHQRIHPGEKLNRCHESGDCFNKSSFHSYQSNHTGEKSYRCDSCGKGFSSSTGLIIHYRTHTGEKPYKCEECGKCFSQSSNFQCHQRVHTEEKPYKCEECGKGFGWSVNLRVHQRVHRGEKPYKCEECGKGFTQAAHFHIHQRVHTGEKPYKCDVCGKGFSHNSPLICHRRVHTGEKPYKCEACGKGFTRNTDLHIHFRVHTGEKPYKCKECGKGFSQASNLQVHQNVHTGEKRFKCETCGKGFSQSSKLQTHQRVHTGEKPYRCDVCGKDFSYSSNLKLHQVIHTGEKPYKCEECGKGFSWRSNLHAHQRVHSGEKPYKCEQCDKSFSQAIDFRVHQRVHTGEKPYKCGVCGKGFSQSSGLQSHQRVHTGEKPYKCDVCGKGFRYSSQFIYHQRGHTGEKPYKCEECGKGFGRSLNLRHHQRVHTGEKPHICEECGKAFSLPSNLRVHLGVHTREKLFKCEECGKGFSQSARLEAHQRVHTGEKPYKCDICDKDFRHRSRLTYHQKVHTGKKL

SEQ ID NO: 6548 - protein, 778 aa, Homo sapiens
KVTQLQEAVTFKDVAVVFSREELRLLDLTQRKLYRDVMVENFKNLVAVDMVSQLEAEEKLWMMETETQRSSKHQNKMETLQKFALKYLSNQELSCWQIWKQVASELTRCLQGKSSQLLQGDSIQVSENENNIMNPKGDSSIYIENQEFPFWRTQHSCGNTYLSESQIQSRGKQIDVKNNLQIHEDFMKKSPFHEHIKTDTEPKPCKGNEYGKIISDGSNQKLPLGEKPHPCGECGRGFSYSPRLPLHPNVHTGEKCFSQSSHLRTHQRIHPGEKLNRCHESGDCFNKSSFHSYQSNHTGEKSYRCDSCGKGFSSSTGLIIHYRTHTGEKPYKCEECGKCFSQSSNFQCHQRVHTEEKPYKCEECGKGFGWSVNLRVHQRVHRGEKPYKCEECGKGFTQAAHFHIHQRVHTGEKPYKCDVCGKGFSHNSPLICHRRVHTGEKPYKCEACGKGFTRNTDLHIHFRVHTGEKPYKCKECGKGFSQASNLQVHQNVHTGEKRFKCETCGKGFSQSSKLQTHQRVHTGEKPYRCDVCGKDFSYSSNLKLHQVIHTGEKPYKCEECGKGFSWRSNLHAHQRVHSGEKPYKCEQCDKSFSQAIDFRVHQRVHTGEKPYKCGVCGKGFSQSSGLQSHQRVHTGEKPYKCDVCGKGFRYSSQFIYHQRGHTGEKPYKCEECGKGFGRSLNLRHHQRVHTGEKPHICEECGKAFSLPSNLRVHLGVHTREKLFKCEECGKGFSQSARLEAHQRVHTGEKPYKCDICDKDFRHRSRLTYHQKVHTGKKL

SEQ ID NO: 6549 - protein, 825 aa, Homo sapiens
METLTSRHEKRALHSQASAISQDREEKIMSQEPLSFKDVAVVFTEEELELLDSTQRQLYQDVMQENFRNLLSVGERNPLGDKNGKDTEYIQDEELRFFSHKELSSCKIWEEVAGELPGSQDCRVNLQGKDFQFSEDAAPHQGWEGASTPCFPIENSLDSLQGDGLIGLENQQFPAWRAIRPIPIQGSWAKAFVNQLGDVQERCKNLDTEDTVYKCNWDDDSFCWISCHVDHRFPEIDKPCGCNKCRKDCIKNSVLHRINPGENGLKSNEYRNGFRDDADLPPHPRVPLKEKLCQYDEFSEGLRHSAHLNRHQRVPTGEKSVKSLERGRGVRQNTHIRNHPRAPVGDMPYRCDVCGKGFRYKSVLLIHQGVHTGRRPYKCEECGKAFGRSSNLLVHQRVHTGEKPYKCSECGKGFSYSSVLQVHQRLHTGEKPYTCSECGKGFCAKSALHKHQHIHPGEKPYSCGECGKGFSCSSHLSSHQKTHTGERPYQCDKCGKGFSHNSYLQAHQRVHMGQHLYKCNVCGKSFSYSSGLLMHQRLHTGEKPYKCECGKSFGRSSDLHIHQRVHTGEKPYKCSECGKGFRRNSDLHSHQRVHTGERPYVCDVCGKGFIYSSDLLIHQRVHTGEKPYKCAECGKGFSYSSGLLIHQRVHTGEKPYRCQECGKGFRCTSSLHKHQRVHTGKKPYTCDQCGKGFSYGSNLRTHQRLHTGEKPYTCCECGKGFRYGSGLLSHKRVHTGEKPYRCHVCGKGYSQSSHLQGHQRVHTGEKPYKCEECGKGFGRNSCLHVHQRVHTGEKPYTCGVCGKGFSYTSGLRNHQRVHLGENPYK

SEQ ID NO: 6550 - protein, 825 aa, Homo sapiens; identical to SEQ ID NO: 6549

SEQ ID NO: 6551 - protein, 474 aa, Homo sapiens
MTTFKEAVTFKDVAVFFTEEELGLLDPAQRKLYQDVMLENFTNLLSVGHQPFHPFHFLREEKFWMMETATQREGNSGGKTIAEAGPHEDCPCQQIWEQTASDLTQSQDSIINNSHFFEQGDVPSQVEAGLSIIHTGQKPSQNGKCKQSFSDVAIFDPPQQFHSGEKSHTCNECGKSFCYISALRIHQRVHLREKLSKCDMRGKEFSQSSCLQTRERVHTGEKPFKCEQCGKGFRCRAILQVHCKLHTGEKPYICEKCGRAFIHDFQLQKHQIIHTGEKPFKCEICGKSFCLRSSLNRHCMVHTAEKLYKSEECGKGFTDSLDLHKHQIIHTGQKPYNCKECGKSFRWSSYLLIHQRIHSGEKPYRCEECGKGYISKSGLNLHQRVHTGERPYNCKECGKSFSRASSILNHKKLHCRKKPFKCEDCGKRLVHRSFCKDQQGDHNGENSSKCEDCGKRYKRRLNLDIILSLFLNDM

SEQ ID NO: 6552 - protein, 444 aa, Homo sapiens
MEPPGPVRGPLQDSSWYEPSAELVQTRMAVSLTAAETLALQGTQGQEKMMMMGPKEEEQSCEYETRLPGNHSTSQEIFRQRFRHLRYQETPGPREALSQLRVLCCEWLRPEKHTKEQILEFLVLEQFLTILPEELQSWVRGHHPKSGEEAVTVLEDLEKGLEPEPQVPGPAHGPAQEEPWEKKESLGAAQEALSIQLQPKETQPFPKSEQVYLHFLSVVTEDGPEPKDKGSLPQPPITEVESQVFSEKLATDTSTFEATSEGTLELQQRNPKAERLRWSPAQEESFRQMVVIHKEIPTGKKDHECSECGKTFIYNSHLVVHQRVHSGEKPYKCSDCGKTFKQSSNLGQHQRIHTGEKPFECNECGKAFRWGAHLVQHQRIHSGEKPYECNECGKAFSQSSYLSQHRRIHSGEKPFICKECGKAYGWCSELIRHRRVHARKEPSH

SEQ ID NO: 6553 - protein, 192 aa, Homo sapiens
MAVSLTAAETLALQGTQGQEKMMMMGPKEEEQSCEYETRLPGNHSTSQEIFRQRFRHLRYQETPGPREALSQLRVLCCEWLRPEKHTKEQILEFLVLEQFLTILPEELQSWVRGHHPKSGEEAVTVLEDLEKGLEPEPQVGRGIWSVMGARLMTFRLDRGAAVGGGAKFKPLLGQVEQLVCVSVSVFSALEP

SEQ ID NO: 6554 - protein, 567 aa, Homo sapiens
GHKNQNEIDTLQEVRLRFLSYEDLICWQIWEQFTSKLTSNQDLIINLQGKRSKLLKQGDSPCQVWTGESSQVSEDENYVIKLQGESSNSIKNQELPLRTTWDFWRKMYLREPQNYQSRCQQIDVKNKLCKCDHCVRQRIAHQHDDHGVHKREKAFSHNNCGKDCVKESSQHSIIQSGEQTSDENGKGLSVGSNLELHQQLHLRDKPHVNVEYGKGIGYSSGLPRHQCFHIGEKCYRNGDSGEGFSQGSHLQPHQRVSTGENLYRCQVYARSSNQNSCLPSHELTHPGEKLCTCGRCGKGFHHSLDFDIHCVDSAGERACKCDVYDKGFSQTSQLQAHQRVHTGEKPYKCEVCDKGFSKASNLQAHQRIHTGEKPYKCDVCDKNFSRNSHLQAHQRVHTGEKPYKCDTCGKDFSQISHLQAHQRVHKGEKPYKCETCGKGFSQSSHLQDHQQVHTGENPYKCDVCGKGFSWSSHLQAHQRVHTGEKPYKCEECRKGFIWNSYLHVHQRIHTGEKPYKCGMCGKSFSQTSHLQAHQRVHTGEKPYKCFVCGKGFSKSSLQIHQRVHDGD

SEQ ID NO: 6555 - protein, 652 aa, Homo sapiens
MVKRSMQQEELTILNIYAPNTGAPRFIRAVACFRSGILGSVVQKPLQPCVLPLQEGEAAVIYPLWEVSQRGTSASTASFPGLGVGLAVLPSQDPALPQKEQEKMTKFQLLAIRLRLHLLDVVGDGDIQGCGCGLHQGGAGVAGPCPEKAVPRCDAGELQEPAVSGLSTLQTRCDITVGKRRQASDDGDRNPRRWVFRQRIAHQHDDHGVHKREKAFSHNNCGKDCVKESSQHSIIQSGEQTSDENGKGLSVGSNLELHQQLHLRDKPHVNVEYGKGIGYSSGLPRHQCFHIGEKCYRNGDSGEGFSQGSHLQPHQRVSTGENLYRCQVYARSSNQNSCLPSHELTHPGEKLCTCGRCGKGFHHSLDFDIHCVDSAGERACKCDVYDKGFSQTSQLQAHQRGHSRDKTYKWEVSDRIFNRNSGLHQRVHTGEKPYKCEVCDKGFSKASNLQAHQRIHTGEKPYKCDVCDKNFSRNSHLQAHQRVHTGEKPYKCDTCGKDFSQISHLQAHQRVHKGEKPYKCETCGKGFSQSSHLQDHQQVHTGENPYKCDVCGKGFSWSSHLQAHQRVHTGEKPYKCEECRKGFIWNSYLHVHQRIHTGEKPYKCGMCGKSFSQTSHLQAHQRVHTGEKPYKCFVCGKGFSKSSLSSDSSESP

SEQ ID NO: 6556 - protein, 670 aa, Homo sapiens
MTKFQEMVTFKDVAVVFTREELGLLDLAQRKLYQDVMLENFRNLLSVGYQPFKLDVILQLGKEDKLRMMETEIQGDGCSGHKNQNEIDTLQEVRLRFLSYEDLICWQIWEQFTSKLTSNQDLIINLQGKRSKLLKQGDSPCQVWTGESSQVSEDENYVIKLQGESSNSIKNQELPLRTTWDFWRKMYLREPQNYQSRCQQIDVKNKLCKCDHCVRQRIAHQHDDHGVHKREKAFSHNNCGKDCVKESSQHSIIQSGEQTSDENGKGLSVGSNLELHQQLHLRDKPHVNVEYGKGIGYSSGLPRHQCFHIGEKCYRNGDSGEGFSQGSHLQPHQRVSTGENLYRCQVYARSSNQNSCLPSHELTHPGEKLCTCGRCGKGFHHSLDFDIHCVDSAGERACKCDVYDKGFSQTSQLQAHQRGHSRDKTYKWEVSDRIFNRNSGLHQRVHTGEKPYKCEVCDKGFSKASNLQAHQRIHTGEKPYKCDVCDKNFSRNSHLQAHQRVHTGEKPYKCDTCGKDFSQISHLQAHQRVHKGEKPYKCETCGKGFSQSSHLQDHQQVHTGENPYKCDVCGKGFSWSSHLQAHQRVHTGEKPYKCEECRKGFIWNSYLHVHQRIHTGEKPYKCGMCGKSFSQTSHLQAHQRVHTGEKPYKCFVCGKGFSKSSLSSDSSESP

SEQ ID NO: 6557 - protein, 106 aa, Homo sapiens
GHKNQNEIDTLQEVRLRFLSYEDLICWQIWEQFTSKLTSNQDLIINLQGKRSKLLKQGDSPCQVWTGESSQVSEDENYVIKLQGESSNSIKNQELPSQKKKKKKKK

SEQ ID NO: 6558 - protein, 738 aa, Homo sapiens
MTKFQEAVTFKDVAVAFTEEELGLLDSAQRKLYRDVMLENFRNLVSVGHQSFKPDMISQLEREEKLWMKELQTQRGKHSGDRNQNEMATLHKAGLRCFSLGELSCWQIKRHIASKLARSQDSMINIEGKSSQFPKHHDSPCQVGAGESIQASVDDNCLVNHIGDHSSIIENQEFPTGKVPNSWSKIYLNETQNYQRSCKQTQMKNKLCIFAPYVDIFSCISHHHDDNIVHKRDKVHSNSDCGKDTLKVSPLTQRSIHTGQKTYQGNECEEAFNDSSSLELHKQVHLGKKSPACSTHEKDTSYSSGIPVQQSVRTGKKRYWCHECGKGFSQSSNLQTHQRVHTGEKPYTCHECGKSFNQSSHLYAHLPIHTGEKPYRCDSCGKGFSRSTDLNIHCRVHTGEKPYKCEVCGKGFTQRSHLQAHERIHTGEKPYKCGDCGKRFSCSSNLHTHQRVHTEEKPYKCDECGKCFSLSFNLHSHQRVHTGEKPYKCEECGKGFSSASSFQSHQRVHTGEKPFRCNVCGKGFSQSSYFQAHQRVHTGEKPYKCEVCGKRFNWSLNLHNHQRVHTGEKPYKCEECGKGFSQASNLQAHQSVHTGEKPFKCDACQKRFSQASHLQAHQRVHTGEKPYKCDTCGKAFSQRSNLQVHQIIHTGEKPFKCEECGKEFSWSAGLSAHQRVHTGEKPYTCQQCGKGFSQASHFHTHQRVHTGERPYICDVCCKGFSQRSHLIYHQRVHTGGNL

SEQ ID NO: 6559 - protein, 588 aa, Homo sapiens
SGDRNQNEMATLHKAGLRCFSLGELSCWQIKRHIASKLARSQDSMINIEGKSSQFPKHHDSPCQVGAGESIQASVDDNCLVNHIGDHSSIIENQEFPTGKVPNSWSKIYLNETQNYQRSCKQTQMKNKLCIFAPYVDIFSCISHHHDDNIVHKRDKVHSNSDCGKDTLKVSPLTQRSIHTGQKTYQGNECEEAFNDSSSLELHKQVHLGKKSPACSTHEKDTSYSSGIPVQQSVRTGKKRYWCHECGKGFSQSSNLQTHQRVHTGEKPYTCHECGKSFNQSSHLYAHLPIHTGEKPYRCDSCGKGFSRSTDLNIHCRVHTGEKPYKCEVCGKGFTQRSHLQAHERIHTGEKPYKSQIFIPIRDFNLHSHQRVHTGEKPYKCEECGKGFSSASSFQSHQRVHTGEKPFRCNVCGKGFSQSSYFQAHQRVHTGEKPYKCEVCGKRFNWSLNLHNHQRVHTGEKPYKCEECGKGFSQASNLQAHQSVHTGEKPFKCDACQKRFSQASHLQAHQRVHTGEKPYKCDTCGKAFSQRSNLQVHQIIHTGEKPFKCEECGKEFSWSAGLSAHQRVHTGEKPYTCQQCGKGFSQAS

SEQ ID NO: 6560 - protein, 738 aa, Homo sapiens
MGRIQEAVTFKDVAVAFTEEELGLLDSAQRKLYRDVMLENFRNLVSVGHQSFKPDMISQLEREEKLWMKELQTQRGKHSGDRNQNEMATLHKAGLRCFSLGELSCWQIKRHIASKLARSQDSMINIEGKSSQFPKHHDSPCQVGAGESIQASVDDNCLVNHIGDHSSIIENQEFPTGKVPNSWSKIYLNETQNYQRSCKQTQMKNKLCIFAPYVDIFSCISHHHDDNIVHKRDKVHSNSDCGKDTLKVSPLTQRSIHTGQKTYQGNECEEAFNDSSSLELHKQVHLGKKSPACSTHEKDTSYSSGIPVQQSVRTGKKRYWCHECGKGFSQSSNLQTHQRVHTGEKPYTCHECGKSFNQSSHLYAHLPIHTGEKPYRCDSCGKGFSRSTDLNIHCRVHTGEKPYKCEVCGKGFTQRSHLQAHERIHTGEKPYKCGDCGKRFSCSSNLHTHQRVHTEEKPYKCDECGKCFSLSFNLHSHQRVHTGEKPYKCEECGKGFSSASSFQSHQRVHTGEKPFRCNVCGKGFSQSSYFQAHQRVHTGEKPYKCEVCGKRFNWSLNLHNHQRVHTGEKPYKCEECGKGFSQASNLQAHQSVHTGEKPFKCDACQKRFSQASHLQAHQRVHTGEKPYKCDTCGKAFSQRSNLQVHQIIHTGEKPFKCEECGKEFSWSAGLSAHQRVHTGEKPYTCQQCGKGFSQASHFHTHQRVHTGERPYICDVCCKGFSQRSHLIYHQRVHTGGNL

SEQ ID NO: 6561 - protein, 181 aa, Homo sapiens
MGRIQEAVTFKDVAVAFTEEELGLLDSAQRKLYRDVMLENFRNLVSVGHQSFKPDMISQLEREEKLWMKELQTQRGDRNQNEMATLHKAGLRCFSLGELSCWQIKRHIASKLARSQDSMINIEGKSSQFPKHHDSPCQVGAGESIQASVDDNCLVNHIGDHSSIIENQEFPTGKKKKKKKQ

SEQ ID NO: 6562 - protein, 579 aa, Homo sapiens
MNKSQEQVSFKDVCVDFTQEEWYLLDPAQKILYRDVILENYSNLVSVGYCITKPEVIFKIEQGEEPWILEKGFPSQCHPERKWKVDDVLESSQENEDDHFWELLFHNNKTVSVENGDRGSKTFNLGTDPVSLRNYPYKICDSCEMNLKNISGLIISKKNCSRKKPDEFNVCEKLLLDIRHEKIPIGEKSYKYDQKRNAINYHQDLSQPSFGQSFEYSKNGQGFHDEAAFFTNKRSQIGETVCKYNECGRTFIESLKLNISQRPHLEMEPYGCSICGKSFCMNLRFGHQRALTKDNPYEYNEYGEIFCDNSAFIIHQGAYTRKILREYKVSDKTWEKSALLKHQIVHMGGKSYDYNENGSNFSKKSHLTQLRRAHTGEKTFECGECGKTFWEKSNLTQHQRTHTGEKPYECTECGKAFCQKPHLTNHQRTHTGEKPYECKQCGKTFCVKSNLTEHQRTHTGEKPYECNACGKSFCHRSALTVHQRTHTGEKPFICNECGKSFCVKSNLIVHQRTHTGEKPYKCNECGKTFCEKSALTKHQRTHTGEKPYECNACGKTFSQRSVLTKHQRIHTRVKALSTS

SEQ ID NO: 6563 - protein, 119 aa, Homo sapiens
MNKSQEQVSFKDVCVDFTQEEWYLLDPAQKILYRDVILENYSNLVSVGYCITKPEVIFKIEQGEEPWILEKGFPSQCHPERKWKVDDVLESSQENEDDHFWELLFHNNKTWNLKLIKVE

SEQ ID NO: 6564 - protein, 579 aa, Homo sapiens; identical to SEQ ID NO: 6562

SEQ ID NO: 6565 - protein, 100 aa, Homo sapiens
MNKSQEQVSFKDVCVDFTQEEWYLLDPAQKILYRDVILENYSNLVSVGYCITKPEVIFKIEQGEEPWILEKGFPSQCHPERKWKVDDVLESSQENEDDHF

SEQ ID NO: 6566 - protein, 69 aa, Homo sapiens
MNKSQEQVSFKDVCVDFTQEEWYLLDPAQKILYRDVILENYSNLVSVGYCITKPEVIFKIEQGEEPWIL

SEQ ID NO: 6567 - protein, 560 aa, Homo sapiens
MAAARLLPVPAGPQPLSFQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWECETKGESQNTDLSPKPLISEQTVILGKTPLGRIDQENNETKQSFCLSPNSVDHREVQVLSQSMPLTPHQAVPSGERPYMCVECGKCFGRSSHLLQHQRIHTGEKPYVCSVCGKAFSQSSVLSKHRRIHTGEKPYECNECGKAFRVSSDLAQHHKIHTGEKPHECLECRKAFTQLSHLIQHQRIHTGERPYVCPLCGKAFNHSTVLRSHQRVHTGEKPHRCNECGKTFSVKRTLLQHQRIHTGEKPYTCSECGKAFSDRSVLIQHHNVHTGEKPYECSECGKTFSHRSTLMNHERIHTEEKPYACYECGKAFVQHSHLIQHQRVHTGEKPYVCGECGHAFSARRSLIQHERIHTGEKPFQCTECGKAFSLKATLIVHLRTHTGEKPYECNSCGKAFSQYSVLIQHQRIHTGEKPYECGECGRAFNQHGHLIQHQKVHRKL

SEQ ID NO: 6568 - protein, 122 aa, Homo sapiens
MAAARLLPVPAGPQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWDPVPQKP

SEQ ID NO: 6569 - protein, 443 aa, Homo sapiens
MAAARLLPVPAGPQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWECETKGESQNTDLSPKPLISEQTVILGKTPLGRIDQENNETKQSFCLSPNSVDHREVQVLSQSMPLTPHQAVPSGERPYMCVECGKCFGRSSHLLQHQRIHTGEKPYVCSVCGKAFSQSSVLSKHRRIHTGEKPYECNECGKAFRVSSDLAQHHKIHTGEKPHECLECRKAFTQLSHLIQHQRIHTGERPYVCPLCGKAFNHSTVLRSHQRVHTGEKPHRCNECGKTFSVKRTLLQHQRIHTGEKPFQCTECGKAFSLKATLIVHLRTHTGEKPYECNSCGKAFSQYSVLIQHQRIHTGEKPYECGECGRAFNQHGHLIQHQKVHRKL

SEQ ID NO: 6570 - protein, 555 aa, Homo sapiens
MAAARLLPVPAGPQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWECETKGESQNTDLSPKPLISEQTVILGKTPLGRIDQENNETKQSFCLSPNSVDHREVQVLSQSMPLTPHQAVPSGERPYMCVECGKCFGRSSHLLQHQRIHTGEKPYVCSVCGKAFSQSSVLSKHRRIHTGEKPYECNECGKAFRVSSDLAQHHKIHTGEKPHECLECRKAFTQLSHLIQHQRIHTGERPYVCPLCGKAFNHSTVLRSHQRVHTGEKPHRCNECGKTFSVKRTLLQHQRIHTGEKPYTCSECGKAFSDRSVLIQHHNVHTGEKPYECSECGKTFSHRSTLMNHERIHTEEKPYACYECGKAFVQHSHLIQHQRVHTGEKPYVCGECGHAFSARRSLIQHERIHTGEKPFQCTECGKAFSLKATLIVHLRTHTGEKPYECNSCGKAFSQYSVLIQHQRIHTGEKPYECGECGRAFNQHGHLIQHQKVHRKL

SEQ ID NO: 6571 - protein, 122 aa, Homo sapiens; identical to SEQ ID NO: 6568

SEQ ID NO: 6572 - protein, 127 aa, Homo sapiens
MAAARLLPVPAGPQPLSFQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWDPVPQKP

SEQ ID NO: 6573 - protein, 671 aa, Homo sapiens
MAATFQLPGHQEMPLTFQDVAVYFSQAEGRQLGPQQRALYRDVMLENYGNVASLGFPVPKPELISQLEQGKELWVLNLLGAEEPDILKSCQKDSEVGTKKELSILNQKFSEEVKTPEFVSRRLLRDNAQAAEFREAWGREGKLKERVGNSAGQSLNKPNIHKRVLTEATVGRERSLGERTQECSAFDRNLNLDQNVVRLQRNKTGERVFKCDICSKTFKYNSDLSRHQRSHTGEKPYECGRCGRAFTHSSNLVLHHHIHTGNKPFKCDECGKTFGLNSHLRLHRRIHTGEKPFGCGECGKAFSRSSTLIQHRIIHTGEKPYKCNECGRGFSQSPQLTQHQRIHTGEKPHECSHCGKAFSRSSSLIQHERIHTGEKPHKCNQCGKAFSQSSSLFLHHRVHTGEKPYVCNECGRAFGFNSHLTEHVRIHTGEKPYVCNECGKAFRRSSTLVQHRRVHTGEKPYQCVECGKAFSQSSQLTLHQRVHTGEKPYDCGDCGKAFSRRSTLIQHQKVHSGETRKCRKHGPAFVHGSSLTADGQIPTGEKHGRAFNHGANLILRWTVHTGEKSFGCNEYGKAFSPTSRPTEDQIMHAGEKPYKCQECGNAFSGKSTLIQHQVTHTGQKPCHCSVYGKAFSQSSQLTPPQQTRVGEKPALNDGSKRYFIHIKKIFQERHF

SEQ ID NO: 6574 - protein, 533 aa, Homo sapiens
MATSFRTASCWGLLSFKDISMEFTWDEWQLLDSTQKYLYRDVILENYHNLISVGYHGTKPDLIFKLEQGEDPWIINAKISRQSCPDGWEEWYQNNQDELESIERSYACSVLGRLNLSKTHDSSRQRLYNTRGKSLTQNSAPSRSYLRKNPDKFHGYEEPYFLKHQRAHSIEKNCVCSECGKAFRCKSQLIVHLRIHTGERPYECSKCERAFSAKSNLNAHQRVHTGEKPYSCSECEKVFSFRSQLIVHQEIHTGGKPYGCSECGKAYSWKSQLLLHQRSHTGVKPYECSECGKAFSLKSPFVVHQRTHTGVKPHKCSECGKAFRSKSYLLVHIRMHTGEKPYQCSDCGKAFNMKTQLIVHQGVHTGNNPYQCGECGKAFGRKEQLTAHLRAHAGEKPYGCSECGKAFSSKSYLVIHRRTHTGERPYECSLCERAFCGKSQLIIHQRTHSTEKPYECNECEKAYPRKASLQIHQKTHSGEKPFKCSECGKAFTQKSSLSEHQRVHTGEKPWKCSECGKSFCWNSGLRIHRKTHK

SEQ ID NO: 6575 - protein, 683 aa, Homo sapiens
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQVTNHGRGTEVLLEEPLPLETARESPSFKLEPMETERSPGPRLQELLGPSPQRDPQAVKERALSAPWLSLFPPEGNMEDKEMTGPQLPESLEDVAMYISQEEWGHQDPSKRALSRDTVQESYENVDSLESHIPSQEVPGTQVGQGGKLWDPSVQSCKEGLSPRGPAPGEEKFENLEGVPSVCSENIHPQVLLPDQARGEVPWSPELGRPHDRSQGDWAPPPEGGMEQALAGASSGRELGRPKELQPKKLHLCPLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTHTG

SEQ ID NO: 6576 - protein, 331 aa, Homo sapiens
MEQALAGASSGRELGRPKELQPKKLHLCPLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTHTG

SEQ ID NO: 6577 - protein, 504 aa, Homo sapiens
MLDNYRNLVFLGIAVSKPDLITCLEQGKEPCNMKRHAMVAKPPVVCSHFAQDLWPKQGLKDSFQKVILRRYGKYGHENLQLRKGCKSADEHKVHKRGYNGLNQCLTTTQSKIFQCDKYVKVLHKFSNSNIHKKRQTGKKPFKCKECGKSCCILSQLTQHKKTATRVNFYKCKTCGKAFNQFSNLTKHKIIHPEVNPYKCEECGKAFNQSLTLTKHKKIHTEEKPYKCEDCGKVFSVFSVLTKHKIIHTGTKPYNCEECGKGFSIFSTLTKHKIIHTGEKPYKCNECGKAFNWSSTLTKHKRIHTGEKPYKCEECGKAFNQSSTLTRHKIVHTGEKPYKCEECGKAFKRSTTLTKHKRIYTKEKPYKCEECGKAFSVFSTLTKHKIIHTGAKPYKCEECGSAFRAFSTLTEHKRVHTGEKPYKCNECGKAFNWSSTLTKHKRIHTGEKPYKCEECGKAFNRSSNLTRHKKIHTGEKPYKPKRCDSAFDNTPNFSRHKRNHMGEKS

SEQ ID NO: 6578 - protein, 569 aa, Homo sapiens
MSSAPRGPPSVAPLPAGIGRSTAKTPGLPGSLEMGPLTFRDVAIEFSLEEWQCLDTSQQNLYRNVMLDNYRNLVFLGIAVSKPDLITCLEQGKEPCNMKRHAMVAKPPVVCSHFAQDLWPKQGLKDSFQKVILRRYGKYGHENLQLRKGCKSADEHKVHKRGYNGLNQCLTTTQSKIFQCDKYVKVLHKFSNSNIHKKRQTGKKPFKCKECGKSCCILSQLTQHKKTATRVNFYKCKTCGKAFNQFSNLTKHKIIHPEVNPYKCEECGKAFNQSLTLTKHKKIHTEEKPYKCEDCGKVFSVFSVLTKHKIIHTGTKPYNCEECGKGFSIFSTLTKHKIIHTGEKPYKCNECGKAFNWSSTLTKHKRIHTGEKPYKCEECGKAFNQSSTLTRHKIVHTGEKPYKCEECGKAFKRSTTLTKHKRIYTKEKPYKCEECGKAFSVFSTLTKHKIIHTGAKPYKCEECGSAFRAFSTLTEHKRVHTGEKPYKCNECGKAFNWSSTLTKHKRIHTGEKPYKCEECGKAFNRSSNLTRHKKIHTGEKPYKPKRCDSAFDNTPNFSRHKRNHMGEKS

SEQ ID NO: 6579 - protein, 81 aa, Homo sapiens
MGPLTFRDVAIEFSLEEWQCLDTSQQNLYRNVMLDNYRNLVFLGIAVSKPDLITCLEQGKEPCNMKRHAMVAKPPGWSAVA

SEQ ID NO: 6580 - protein, 376 aa, Homo sapiens
MKGEDAQPQEMASTSFPRASGPSPEFRQHGDSDGKRGSPQNLPIEHHFACKECGDTFRLKVLLVQHQRVHSEEKGWECGDCGKVFRGVAEFNEHRKSHVAAEPQPGPSRALENAAEKREQMEREAKPFECEECGKRFKKNAGLSQHLRVHSREKPFDCEECGRSFKVNTHLFRHQKLHTSEKPFACKACSRDFLDRQELLKHQRMHTGHLPFDCDDCGKSFRGVNGLAEHQRIHSGAKPYGCPHCGKLFRRSSELTKHRRIHTGEKPYACGQCGKAFRQSSSLLEHARIHSGERPYACGECGKAFRGPSDLIKHRRIHSGLKPYECDKCGKAFRRSSGLSRHRRIHSGARRCECSQCGRVFKRRSALQKHQPTHHE

SEQ ID NO: 6581 - protein, 329 aa, Homo sapiens
MMSHPCVSLLGVPVLNPALVPHLAQGQVLLVSDPSPNTDPAKYSESTSATRHQMKGEDAQPQEMASTSFPRASGPSPEFRQHGDSDGKRGSPQNLPIEHHFACKECGDTFRLKVLLVQHQRVHSEEKGWECGDCGKVFRGVAEFNEHRKSHVAAEPQPGPSRALENAAEKREQMEREAKPFECEECGKRFKKNAGLSQHLRVHSREKPFDCEECGRSFKVNTHLFRHQKLHTSEKPFACKACSRDFLDRQELLKHQRMHTGHLPFDCDDCGKSFRGVNGLAEHQRIHSGAKPYGCPHCGKLFRRSSELTKHRRIHTGEKPYACGLPWAL

SEQ ID NO: 6582 - protein, 429 aa, Homo sapiens
MMSHPCVSLLGVPVLNPALVPHLAQGQVLLVSDPSPNTDPAKYSESTSATRHQMKGEDAQPQEMASTSFPRASGPSPEFRQHGDSDGKRGSPQNLPIEHHFACKECGDTFRLKVLLVQHQRVHSEEKGWECGDCGKVFRGVAEFNEHRKSHVAAEPQPGPSRALENAAEKREQMEREAKPFECEECGKRFKKNAGLSQHLRVHSREKPFDCEECGRSFKVNTHLFRHQKLHTSEKPFACKACSRDFLDRQELLKHQRMHTGHLPFDCDDCGKSFRGVNGLAEHQRIHSGAKPYGCPHCGKLFRRSSELTKHRRIHTGEKPYACGQCGKAFRQSSSLLEHARIHSGERPYACGECGKAFRGPSDLIKHRRIHSGLKPYECDKCGKAFRRSSGLSRHRRIHSGARRCECSQCGRVFKRRSALQKHQPTHHE

SEQ ID NO: 6583 - protein, 459 aa, Homo sapiens
MPEDLVTFDDVAWYLTTREWFKLDPEQRALEYYGNVTSVAGVPVLNPALVPHLAQGQVLLVSDPSPNTDPAKYSESTSATRHQMKGEDAQPQEMASTSFPRASGPSPEFRQHGDSDGKRGSPQNLPIEHHFACKECGDTFRLKVLLVQHQRVHSEEKGWECGDCGKVFRGVAEFNEHRKSHVAAEPQPGPSRALENAAEKREQMEREAKPFECEECGKRFKKNAGLSQHLRVHSREKPFDCEECGRSFKVNTHLFRHQKLHTSEKPFACKACSRDFLDRQELLKHQRMHTGHLPFDCDDCGKSFRGVNGLAEHQRIHSGAKPYGCPHCGKLFRRSSELTKHRRIHTGEKPYACGQCGKAFRQSSSLLEHARIHSGERPYACGECGKAFRGPSDLIKHRRIHSGLKPYECDKCGKAFRRSSGLSRHRRIHSGARRCECSQCGRVFKRRSALQKHQPTHHE

SEQ ID NO: 6584 - protein, 539 aa, Homo sapiens
MGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPWDKETAPRLPQHRGWNPGDAPQTSQGRGTGTPVGAETKTLPSTDVAQPPSDSDAVGPRSGFPPQPSLPLCRAPGQLGEKQLPSSTSDDRVKDEFSDLSEGDVLSEDENDKKQNAQSSDESFEPYPERKVSGKKSESKEAKKSEEPRIRKKPGPKPGWKKKLRCEREELPTIYKCPYQGCTAVYRGADGMKKHIKEHHEEVRERPCPHPGCNKVFMIDRYLQRHVKLIHTEVRNYICDECGQTFKQRKHLLVHQMRHSGAKPLQCEVCGFQCRQRASLKYHMTKHKAETELDFACDQCGRRFEKAHNLNVHMSMVHPLTQTQDKALPLEAEPPPGPPSPSVTTEGQAVKPEPT

SEQ ID NO: 6585 - protein, 614 aa, Homo sapiens
MKRDRLGRFLSPGSSRQCGASDGGGGVSRTRGRPSLSGGPRVDGATARRAWGPVGSCGDAGEDGADEAGAGRALAMGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPWDKETAPRLPQHRGWNPGDAPQTSQGRGTGTPVGAETKTLPSTDVAQPPSDSDAVGPRSGFPPQPSLPLCRAPGQLGEKQLPSSTSDDRVKDEFSDLSEGDVLSEDENDKKQNAQSSDESFEPYPERKVSGKKSESKEAKKSEEPRIRKKPGPKPGWKKKLRCEREELPTIYKCPYQGCTAVYRGADGMKKHIKEHHEEVRERPCPHPGCNKVFMIDRYLQRHVKLIHTEVRNYICDECGQTFKQRKHLLVHQMRHSGAKPLQCEVCGFQCRQRASLKYHMTKHKAETELDFACDQCGRRFEKAHNLNVHMSMVHPLTQTQDKALPLEAEPPPGPPSPSVTTEGQAVKPEPT

SEQ ID NO: 6586 - protein, 400 aa, Homo sapiens
MDMRPAAGPCPTFRGHCPPSTAASSRSCGAATRATTTPWIPAPAARPSCWTVRWQSSGHGTKRRRHGCPSTEGGTLGMPLRPPRVEGQGPQLGLRPRPCPARMWPSLLRTATRWGPGRASHLSQACPFAGPQGSWVRSSFHLQPRMIGDVLSEDENDKKQNAQSSDESFEPYPERKVSGKKSESKEAKKSEEPRIRKKPGPKPGWKKKLRCEREELPTIYKCPYQGCTAVYRGADGMKKHIKEHHEEVRERPCPHPGCNKVFMIDRYLQRHVKLIHTEVRNYICDECGQTFKQRKHLLVHQMRHSGAKPLQCEVCGFQCRQRASLKYHMTKHKAETELDFACDQCGRRFEKAHNLNVHMSMVHPLTQTQDKALPLEAEPPPGPPSPSVTTEGQAVKPEPT

SEQ ID NO: 6587 - protein, 665 aa, Homo sapiens
MMKTFFSTGQGNTEAFHTGTLQRQASHHIGDFCFQKIEKDIHGFQFQWKEDETNDHAAPMTEIKELTGSTGQHDQRHAGNKHIKDQLGLSFHSHLPELHIFQPEGKIGNQVEKSINNASSVSTSQRICCRPKTHISNKYGNNSLHSSLLTQKRNVHMREKSFQCIESGKSFNCSSLLKKHQITHLEEKQCKCDVYGKVFNQKRYLACHRRSHIDEKPYKCNECGKIFGHNTSLFLHKALHTADKPYECEECDKVFSRKSHLETHKIIYTGGKPYKCKVCDKAFTCNSYLAKHTIIHTGEKPYKCNECGKVFNRLSTLARHRRLHTGEKPYECEECEKVFSRKSHLERHKRIHTGEKPYKCKVCDKAFAYNSYLAKHSIIHTGEKPYKCNECGKVFNQQSTLARHHRLHTAEKPYKCEECDKVFRCKSHLERHRRIHTGEKPYKCKVCDKAFRSDSCLTEHQRVHTGEKPYMCNECGKVFSTKANLACHHKLHTAEKPYKCEECEKVFSRKSHMERHRRIHTGEKPYKCKVCDKAFRRDSHLAQHQRVHTGEKPYKCNECGKTFRQTSSLIIHRRLHTGEKPYKCNECGKTFSQMSSLVYHHRLHSGEKPYKCNECGKVFNQQAHLAQHQRVHTGEKPYKCNECGKTFSQMSNLVYHHRLHSGEKP

SEQ ID NO: 6588 - protein, 665 aa, Homo sapiens; identical to SEQ ID NO: 6587

SEQ ID NO: 6589 - protein, 718 aa, Homo sapiens
MALPQGLLTFRDVAIEFSQEEWKCLDPAQRTLYRDVMLENYRNLVSLDISSKCMMKTFFSTGQGNTEAFHTGTLQRQASHHIGDFCFQKIEKDIHGFQFQWKEDETNDHAAPMTEIKELTGSTGQHDQRHAGNKHIKDQLGLSFHSHLPELHIFQPEGKIGNQVEKSINNASSVSTSQRICCRPKTHISNKYGNNSLHSSLLTQKRNVHMREKSFQCIESGKSFNCSSLLKKHQITHLEEKQCKCDVYGKVFNQKRYLACHRRSHIDEKPYKCNECGKIFGHNTSLFLHKALHTADKPYECEECDKVFSRKSHLETHKIIYTGGKPYKCKVCDKAFTCNSYLAKHTIIHTGEKPYKCNECGKVFNRLSTLARHRRLHTGEKPYECEECEKVFSRKSHLERHKRIHTGEKPYKCKVCDKAFAYNSYLAKHSIIHTGEKPYKCNECGKVFNQQSTLARHHRLHTAEKPYKCEECDKVFRCKSHLERHRRIHTGEKPYKCKVCDKAFRSDSCLTEHQRVHTGEKPYMCNECGKVFSTKANLACHHKLHTAEKPYKCEECEKVFSRKSHMERHRRIHTGEKPYKCKVCDKAFRRDSHLAQHQRVHTGEKPYKCNECGKTFRQTSSLIIHRRLHTGEKPYKCNECGKTFSQMSSLVYHHRLHSGEKPYKCNECGKVFNQQAHLAQHQRVHTGEKPYKCNECGKTFSQMSNLVYHHRLHSGEKP

SEQ ID NO: 6590 - protein, 868 aa, Homo sapiens
MRGAASASVREPTPLPGRGAPRTKPRAGRGPTVGTPATLALPARGRPRSRNGLASKGQRGAAPTGPGHRALPSRDTALPQERNKKLEAVGTGIEPKAMSQGLVTFGDVAVDFSQEEWEWLNPIQRNLYRKVMLENYRNLASLGLCVSKPDVISSLEQGKEPWTVKRKMTRAWCPDLKAVWKIKELPLKKDFCEGKLSQAVITERLTSYNLEYSLLGEHWDYDALFETQPGLVTIKNLAVDFRQQLHPAQKNFCKNGIWENNSDLGSAGHCVAKPDLVSLLEQEKEPWMVKRELTGSLFSGQRSVHETQELFPKQDSYAEGVTDRTSNTKLDCSSFRENWDSDYVFGRKLAVGQETQFRQEPITHNKTLSKERERTYNKSGRWFYLDDSEEKVHNRDSIKNFQKSSVVIKQTGIYAGKKLFKCNECKKTFTQSSSLTVHQRIHTGEKPYKCNECGKAFSDGSSFARHQRCHTGKKPYECIECGKAFIQNTSLIRHWRYYHTGEKPFDCIDCGKAFSDHIGLNQHRRIHTGEKPYKCDVCHKSFRYGSSLTVHQRIHTGEKPYECDVCRKAFSHHASLTQHQRVHSGEKPFKCKECGKAFRQNIHLASHLRIHTGEKPFECAECGKSFSISSQLATHQRIHTGEKPYECKVCSKAFTQKAHLAQHQKTHTGEKPYECKECGKAFSQTTHLIQHQRVHTGEKPYKCMECGKAFGDNSSCTQHQRLHTGQRPYECIECGKAFKTKSSLICHRRSHTGEKPYECSVCGKAFSHRQSLSVHQRIHSGKKPYECKECRKTFIQIGHLNQHKRVHTGERSYNYKKSRKVFRQTAHLAHHQRIHTGESSTCPSLPSTSNPVDLFPKFLWNPSSLPSP

SEQ ID NO: 6591 - protein, 542 aa, Homo sapiens
MGDIFLCKKVESPKKNLRESKQREEDDEDPDLIYVGVEHVHRDAEVLFVGMISNSKPVVSNILNRVTPGSKSRRKKGHFRQYPAHVSQPANHVTSMAKAIMPVSLSEGRSTDSPVTMKSSSEPGYKMSSPQVVSPNYSDSLPPGTQCLVGAMVSGGGRNESSPDSKRLSTSDINSRDSKRVKLRDGIPGVPSLAVVPSDMSSTISTNTPSQGICNSSNHVQNGVTFPWPDANGKAHFNLTDPERANESGLAMTDISSLASQNKTFDPKKENPIVLLSNFYYGQHKGDGQPEQKTHTTFKCLSCVKVLKNIKFMNHMKHHLEFEKQRNDSWEDHTTCQHCHRQFPTPFQLQCHIDSVHIAMGPSAVCKICELSFETDQVLLQHMKDHHKPGEMPYVCQVCHYRSSVFADVETHFRTCHENTKNLLCLFCLKLFKTAIPYMNHCWRHSRRRVLQCSKCRLQFLTLKEEIEHKTKDHQTFKKPEQLQGFPRETKVIIQTSVQPGSSGMASVIVSNTDPQSSPVKTKKKTAMNTRDSRLPCSKDSS

SEQ ID NO: 6592 - protein, 543 aa, Homo sapiens
MEQSCEEEKEPEPQKNIQETKQVDDEDAELIFVGVEHVNEDAELIFVGVTSNSKPVVSNILNRVTPGSWSRRKKYDHLRKDTARKLQPKSHETVTSEAVTVLPASQLESRSTDSPIIIEPLSKPDYRNSSPQVVPNNSSELPSPLITFTDSLHHPVSTALSVGGINESPRVSKQLSTFEVNSINPKRAKLRDGIIEGNSSASFPSDTFHTMNTQQSTPSNNVHTSLSHVQNGAPFPAAFPKDNIHFKPINTNLDRENELAKTDILSLTSQNKTFDPKKENPIVLLSDFYYGQHKGEGQPEQKTHTTFKCLSCVKVLKNVKFMNHVKHHLEFEKQRNDSWENHTTCQHCHRQFPTPFQLQCHIENVHTAQEPSTVCKICELSFETDQVLLQHMKDHHKPGEMPYVCQVCHYRSSVFADVETHFRTCHENTKNLLCPFCLKIFKTATPYMCHYRGHWGKSAHQCSKCRLQFLTFKEKMEHKTQCHQMFKKPKQLEGLPPETKVTIQVSLEPLQPGSVDVASITVSTSDSEPSLPRSKSKISKKSH

SEQ ID NO: 6593 - protein, 543 aa, Homo sapiens; identical to SEQ ID NO: 6592

SEQ ID NO: 6594 - protein, 610 aa, Homo sapiens
MDDDKPFQPKNISKMAELFMECEEEELEPWQKKVEETQDEDDDELIFVGEISSSKPAISNILNRGHSSSSSKGIKSEPHSPGIPEIFRTASQRCRDPPSNPVAASPRFHLVSKSSQSSVTVENASKPDFTKNSQVGSDNSSILLFDSTQESLPPSQDIPAIFREGMKNTSYVLKHPSTSKVNSVTPKKPKTSEDVPQINPSTSLPLIGSPPVTSSQVMLSKGTNTSSPYDAGADYLRACPKCNVQFNLLDPLKYHMKHCCPDMITKFLGVIVKSERPCDEDKTDSETGKLIMLVNEFYYGRHEGVTEKEPKTYTTFKCFSCSKVLKNNIRFMNHMKHHLELEKQNNESWENHTTCQHCYRQYPTPFQLQCHIESTHTPHEFSTICKICELSFETEHILLQHMKDTHKPGEMPYVCQKKGVHRCPKCRLQFLTSKEKAEHKAQHRTFIKPKELEGLPPGAKVTIRASLGPLQSKLPTAPFGCAPGTSFLQVTPPTSQNTTARNPRKSNASRSKTSKLHATTSTASKVNTSKPRGRIAKSKAKPSYKQKRQRNRKNKMSLALKNIRCRRGIHKCIECHSKIKDFASHFSIYIHCSFCKYNTNCNKAFVNHMM

SEQ ID NO: 6595 - protein, 737 aa, Homo sapiens
MDDDKPFQPKNISKMAELFMECEEEELEPWQKKVEETQDEDDDELIFVGEISSSKPAISNILNRGHSSSSSKGIKSEPHSPGIPEIFRTASQRCRDPPSNPVAASPRFHLVSKSSQSSVTVENASKPDFTKNSQVGSDNSSILLFDSTQESLPPSQDIPAIFREGMKNTSYVLKHPSTSKVNSVTPKKPKTSEDVPQINPSTSLPLIGSPPVTSSQVMLSKGTNTSSPYDAGADYLRACPKCNVQFNLLDPLKYHMKHCCPDMITKFLGVIVKSERPCDEDKTDSETGKLIMLVNEFYYGRHEGVTEKEPKTYTTFKCFSCSKVLKNNIRFMNHMKHHLELEKQNNESWENHTTCQHCYRQYPTPFQLQCHIESTHTPHEFSTICKICELSFETEHILLQHMKDTHKPGEMPYVCQVCQFRSSTFSDVEAHFRAAHENTKNLLCPFCLKVSKMATPYMNHYMKHQKKGVHRCPKCRLQFLTSKEKAEHKAQHRTFIKPKELEGLPPGAKVTIRASLGPLQSKLPTAPFGCAPGTSFLQVTPPTSQNTTARNPRKSNASRSKTSKLHATTSTASKVNTSKPRGRIAKSKAKPSYKQKRQRNRKNKMSLALKNIRCRRGIHKCIECHSKIKDFASHFSIYIHCSFCKYNTNCNKAFVNHMMSSHSNHPGKRFCIFKKHSGTLRGITLVCLKCDFLADSSGLDRMAKHLSQRKTHTCQVIIENVSKSTSTSEPTTGCSLK

SEQ ID NO: 6596 - protein, 610 aa, Homo sapiens; identical to SEQ ID NO: 6594

SEQ ID NO: 6597 - protein, 302 aa, Homo sapiens
MAGMSESSFLSKRPSTSEVNNVNPKKPKPSESVSGANSSAVLPSVKSPSVTSSQAMLAKGTNTSSNQSKNGTPFPRACPKCNIHFNLLDPLKNHMKYCCPDMINNFLGLAKTEFSSTVNKNTTIDSEKGKLIMLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKTCYARFASKLLKLQHHICIII

SEQ ID NO: 6598 - protein, 979 aa, Homo sapiens
MGDNPFQPKSNSKMAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPGYITNSSRVVSNKSSELLFDLTQDTGLSHYQGGPTLSMAGMSESSFLSKRPSTSEVNNVNPKKPKPSESVSGANSSAVLPSVKSPSVTSSQAMLAKGTNTSSNQSKNGTPFPRACPKCNIHFNLLDPLKNHMKYCCPDMINNFLGLAKTEFSSTVNKNTTIDSEKGKLIMLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKVTIRASVGPLQSGASPTPSISASASTLQLSPPRTKNITAKNPAKSNTSKPNTVKSNASKPNTSKPNGSKSKYKPKISNMQKKQSTLASSNKKSKVNTALRNLRYRRGIHKCIECCSEIKDFANHFPTYVHCSFCRYNTSCSKAYVNHMMSFHSNRPSKRFCIFKKHSENLRGITLVCLNCDFLSDVSGLDNMATHLSQHKTHTCQVVMQKVSVCIPTSEHLSELKKEAPAKEQEPVSKEIARPNMAERETETSNSESKQDKAASSKEKNGCNANSFEGSSTTKSEESITVSDKENETCLADQETGSKNIVSCDSNIGADKVEKKKQIQHVCQEMELKMCQSSENIILSDQIKDHNSSEARFSSKNIKDLRLASDNVSIDQFLRKRHEPESVSSDVSEQGSIHLEPLTPSEVLEYEATEILQKGSGDPSAKTDEVVSDQTDDIPGGNNPSTTEATVDLEDEKERS

SEQ ID NO: 6599 - protein, 421 aa, Homo sapiens
MLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKVTIRASVGPLQSGASPTPSISASASTLQLSPPRTKNITAKNPAKSNTSKPNTVKSNASKPNTSKPNGSKSKYKPKISNMQKKQSTLASSNKKSKVNTALRNLRYRRGIHKCIECCSEIKDFANHFPTYVHCSFCRYNTSCSKAYVNHMMSFHSNRPSKRFCIFKKHSENLRCVGGQIECDLPKLHKLVVEPRLTLGLLTPNF

SEQ ID NO: 6600 - protein, 966 aa, Homo sapiens
MAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPGYITNSSRVVSNKSSELLFDLTQDTGLSHYQGGPTLSMAGMSESSFLSKRPSTSEVNNVNPKKPKPSESVSGANSSAVLPSVKSPSVTSSQAMLAKGTNTSSNQSKNGTPFPRACPKCNIHFNLLDPLKNHMKYCCPDMINNFLGLAKTEFSSTVNKNTTIDSEKGKLIMLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKVTIRASVGPLQSGASPTPSISASASTLQLSPPRTKNITAKNPAKSNTSKPNTVKSNASKPNTSKPNGSKSKYKPKISNMQKKQSTLASSNKKSKVNTALRNLRYRRGIHKCIECCSEIKDFANHFPTYVHCSFCRYNTSCSKAYVNHMMSFHSNRPSKRFCIFKKHSENLRGITLVCLNCDFLSDVSGLDNMATHLSQHKTHTCQVVMQKVSVCIPTSEHLSELKKEAPAKEQEPVSKEIARPNMAERETETSNSESKQDKAASSKEKNGCNANSFEGSSTTKSEESITVSDKENETCLADQETGSKNIVSCDSNIGADKVEKKKQIQHVCQEMELKMCQSSENIILSDQIKDHNSSEARFSSKNIKDLRLASDNVSIDQFLRKRHEPESVSSDVSEQGSIHLEPLTPSEVLEYEATEILQKGSGDPSAKTDEVVSDQTDDIPGGNNPSTTEATVDLEDEKERS

SEQ ID NO: 6601 - protein, 747 aa, Homo sapiens
MAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPGYITNSSRVVSNKSSELLFDLTQDTGLSHYQGGPTLSMAGMSESSFLSKRPSTSEVNNVNPKKPKPSESVSGANSSAVLPSVKSPSVTSSQAMLAKGTNTSSNQSKNGTPFPRACPKCNIHFNLLDPLKNHMKYCCPDMINNFLGLAKTEFSSTVNKNTTIDSEKGKLIMLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKVTIRASVGPLQSGASPTPSISASASTLQLSPPRTKNITAKNPAKSNTSKPNTVKSNASKPNTSKPNGSKSKYKPKISNMQKKQSTLASSNKKSKVNTALRNLRYRRGIHKCIECCSEIKDFANHFPTYVHCSFCRYNTSCSKAYVNHMMSFHSNRPSKRFCIFKKHSENLRGITLVCLNCDFLSDVSGLDNMATHLSQHKTHTCQVVMQKDAEAAQRFQKISRVYLDSVPLRWTQLMPVLSFQGM

SEQ ID NO: 6602 - protein, 80 aa, Homo sapiens
MGDNPFQPKSNSKMAELFMECEEEELEPWQKKVKEVEDDDDDEPIFVGEISSSKPAISNILNRVNPSSYSRGLKNGALSR

SEQ ID NO: 6603 - protein, 158 aa, Homo sapiens
MGDNPFQPKSNSKMAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPVSVSKTIRPAQGSIGCCLSISTVPSYNSGLS

SEQ ID NO: 6604 - protein, 966 aa, Homo sapiens; identical to SEQ ID NO: 6600

SEQ ID NO: 6605 - protein, 895 aa, Homo sapiens
MKIGSGFLSGGGGTGSSGGSGSGGGGSGGGGGGGSSGRRAEMEPTFPQGMVMFNHRLPPVTSFTRPAGSAAPPPQCVLSSSTSAAPAAEPPPPPAPDMTFKKEPAASAAAFPSQRTSWGFLQSLVSIKQEKPADPEEQQSHHHHHHHHYGGLFAGAEERSPGLGGGEGGSHGVIQDLSILHQHVQQQPAQHHRDVLLSSSSRTDDHHGTEEPKQDTNVKKAKRPKPESQGIKAKRKPSASSKPSLVGDGEGAILSPSQKPHICDHCSAAFRSSYHLRRHVLIHTGERPFQCSQCSMGFIQKYLLQRHEKIHSREKPFGCDQCSMKFIQKYHMERHKRTHSGEKPYKCDTCQQYFSRTDRLLKHRRTCGEVIVKGATSAEPGSSNHTNMGNLAVLSQGNTSSSRRKTKSKSIAIENKEQKTGKTNESQISNNINMQSYSVEMPTVSSSGGIIGTGIDELQKRVPKLIFKKGSRKNTDKNYLNFVSPLPDIVGQKSLSGKPSGSLGIVSNNSVETIGLLQSTSGKQGQISSNYDDAMQFSKKRRYLPTASSNSAFSINVGHMVSQQSVIQSAGVSVLDNEAPLSLIDSSALNAEIKSCHDKSGIPDEVLQSILDQYSNKSESQKEDPFNIAEPRVDLHTSGEHSELVQEENLSPGTQTPSNDKASMLQEYSKYLQQAFEKSTNASFTLGHGFQFVSLSSPLHNHTLFPEKQIYTTSPLECGFGQSVTSVLPSSLPKPPFGMLFGSQPGLYLSALDATHQQLTPSQELDDLIDSQKNLETSSAFQSSSQKLTSQKEQKNLESSTGFQIPSQELASQIDPQKDIEPRTTYQIENFAQAFGSQFKSGSRVPMTFITNSNGEVDHRVRTSVSDFSGYTNMMSDVSEPCSTRVKTPTSQSYR

SEQ ID NO: 6606 - protein, 859 aa, Homo sapiens
MKIGSGFLSGGGGTGSSGGSGSGGGGSGGGGGGGSSGRRAEMEPTFPQAPAAEPPPPPAPDMTFKKEPAASAAAFPSQRTSWGFLQSLVSIKQEKPADPEEQQSHHHHHHHHYGGLFAGAEERSPGLGGGEGGSHGVIQDLSILHQHVQQQPAQHHRDVLLSSSSRTDDHHGTEEPKQDTNVKKAKRPKPESQGIKAKRKPSASSKPSLVGDGEGAILSPSQKPHICDHCSAAFRSSYHLRRHVLIHTGERPFQCSQCSMGFIQKYLLQRHEKIHSREKPFGCDQCSMKFIQKYHMERHKRTHSGEKPYKCDTCQQYFSRTDRLLKHRRTCGEVIVKGATSAEPGSSNHTNMGNLAVLSQGNTSSSRRKTKSKSIAIENKEQKTGKTNESQISNNINMQSYSVEMPTVSSSGGIIGTGIDELQKRVPKLIFKKGSRKNTDKNYLNFVSPLPDIVGQKSLSGKPSGSLGIVSNNSVETIGLLQSTSGKQGQISSNYDDAMQFSKKRRYLPTASSNSAFSINVGHMVSQQSVIQSAGVSVLDNEAPLSLIDSSALNAEIKSCHDKSGIPDEVLQSILDQYSNKSESQKEDPFNIAEPRVDLHTSGEHSELVQEENLSPGTQTPSNDKASMLQEYSKYLQQAFEKSTNASFTLGHGFQFVSLSSPLHNHTLFPEKQIYTTSPLECGFGQSVTSVLPSSLPKPPFGMLFGSQPGLYLSALDATHQQLTPSQELDDLIDSQKNLETSSAFQSSSQKLTSQKEQKNLESSTGFQIPSQELASQIDPQKDIEPRTTYQIENFAQAFGSQFKSGSRVPMTFITNSNGEVDHRVRTSVSDFSGYTNMMSDVSEPCSTRVKTPTSQSYR

SEQ ID NO: 6607 - protein, 895 aa, Homo sapiens; identical to SEQ ID NO: 6605

SEQ ID NO: 6608 - protein, 600 aa, Homo sapiens
MGFIQKYLLQRHEKIHSREKPFGCDQCSMKFIQKYHMERHKRTHSGEKPYKCDTCQQYFSRTDRLLKHRRTCGEVIVKGATSAEPGSSNHTNMGNLAVLSQGNTSSSRRKTKSKSIAIENKEQKTGKTNESQISNNINMQSYSVEMPTVSSSGGIIGTGIDELQKRVPKLIFKKGSRKNTDKNYLNFVSPLPDIVGQKSLSGKPSGSLGIVSNNSVETIGLLQSTSGKQGQISSNYDDAMQFSKKRRYLPTASSNSAFSINVGHMVSQQSVIQSAGVSVLDNEAPLSLIDSSALNAEIKSCHDKSGIPDEVLQSILDQYSNKSESQKEDPFNIAEPRVDLHTSGEHSELVQEENLSPGTQTPSNDKASMLQEYSKYLQQAFEKSTNASFTLGHGFQFVSLSSPLHNHTLFPEKQIYTTSPLECGFGQSVTSVLPSSLPKPPFGMLFGSQPGLYLSALDATHQQLTPSQELDDLIDSQKNLETSSAFQSSSQKLTSQKEQKNLESSTGFQIPSQELASQIDPQKDIEPRTTYQIENFAQAFGSQFKSGSRVPMTFITNSNGEVDHRVRTSVSDFSGYTNMMSDVSEPCSTRVKTPTSQSYR

SEQ ID NO: 6609 - protein, 671 aa, Homo sapiens
MQFVSTRPQPQQLGIQGLGLDSGSWSWAQALPPEEVCHQEPALRGEMAEGMPPMQAQEWDMDARRPMPFQFPPFPDRAPVFPDRMMREPQLPTAEISLWTVVAAIQAVERKVDAQASQLLNLEGRTGTAEKKLADCEKTAVEFGNHMESKWAVLGTLLQEYGLLQRRLENLENLLRNRNFWVLRLPPGSKGEAPKVPVTFVDIAVYFSEDEWKNLDEWQKELYNNLVKENYKTLMSLDAEGSVPKPDAPVQAEPREEPCVWEQRHPEEREIPMDPEAGAEPLVPAQDASSQVKREDTLCVRGQRGLEERAIPTESITDSPISAQDLLSRIKQEEHQCVWDQQDLADRDIPTDPNSESLISAHDILSWIKQEEQPYPWGPRDSMDGELGLDSGPSDSLLMVKNPPPAPPQPQPQPQPPQPQLQSQPQPQSLPPIAVAENPGGPPSRGLLDDGFQVLPGERGSGEAPPGGDRSTGGGGGDGGGGGGGAEAGTGAGGGCGSCCPGGLRRSLLLHGARSKPYSCPECGKSFGVRKSLIIHHRSHTKERPYECAECEKSFNCHSGLIRHQMTHRGERPYKCSECEKTYSRKEHLQNHQRLHTGERPFQCALCGKSFIRKQNLLKHQRIHTGERPYTCGECGKSFRYKESLKDHLRVHSGGPGPGAPRQLPPPPERD

SEQ ID NO: 6610 - protein, 324 aa, Homo sapiens
MREPQLPTAEISLWTVVAAIQAVERKVDAQASQLLNLEGRTGTAEKKLADCEKTAVEFGNHMESKWAVLGTLLQEYGLLQRRLENLENLLRNRNFWVLRLPPGSKGEAPKVPVTFVDIAVYFSEDEWKNLDEWQKELYNNLVKENYKTLMSLDAEGSVPKPDAPVQAEPSYSCPECGKSFGVRKSLIIHHRSHTKERPYECAECEKSFNCHSGLIRHQMTHRGERPYKCSECEKTYSRKEHLQNHQRLHTGERPFQCALCGKSFIRKQNLLKHQRIHTGERPYTCGECGKSFRYKESLKDHLRVHSGGPGPGAPRQLPPPPERD

SEQ ID NO: 6611 - protein, 463 aa, Homo sapiens
MQFVSTRPQPQQLGIQGLGLDSGSWSWAQALPPEEVCHQEPALRGEMAEGMPPMQAQEWDMDARRPMPFQFPPFPDRAPVFPDRMMREPQLPTAEISLWTVVAAIQAVERKVDAQASQLLNLEGRTGTAEKKLADCEKTAVEFGNHMESKWAVLGTLLQEYGLLQRRLENLENLLRNRNFWVLRLPPGSKGEAPKVPVTFVDIAVYFSEDEWKNLDEWQKELYNNLVKENYKTLMSLDAEGSVPKPDAPVQAEPREEPCVWEQRHPEEREIPMDPEAGAEPLVPAQDASSQVKREDTLCVRGQRGLEERAIPTESITDSPISAQDLLSRIKQEEHQCVWDQQDLADRDIPTDPNSESLISAHDILSWIKQEEQPYPWGPRDSMDGELGLDSGPSDSLLMVKNPPPAPPQPQPQPQPPQPQLQSQPQPQSLPPIAVAENPGGPPSRGLLDDGFQPHQGAALRVR

SEQ ID NO: 6612 - protein, 83 aa, Homo sapiens
MFESCSGFSGFCASPIEESHGALISSCNSRTMTDGLVTFRDVAIDFSQEEWECLDPAQRDLYVDVMLENYSNLVSLGKVICLK

SEQ ID NO: 6613 - protein, 679 aa, Homo sapiens
MESRSVAQAGVQWCDLGSLQAPPPGFTLFSCLSLLSSWDYSSGFSGFCASPIEESHGALISSCNSRTMTDGLVTFRDVAIDFSQEEWECLDPAQRDLYVDVMLENYSNLVSLDLESKTYETKKIFSENDIFEINFSQWEMKDKSKTLGLEASIFRNNWKCKSIFEGLKGHQEGYFSQMIISYEKIPSYRKSKSLTPHQRIHNTEKSYVCKECGKACSHGSKLVQHERTHTAEKHFECKECGKNYLSAYQLNVHQRFHTGEKPYECKECGKTFSWGSSLVKHERIHTGEKPYECKECGKAFSRGYHLTQHQKIHTGVKSYKCKECGKAFFWGSSLAKHEIIHTGEKPYKCKECGKAFSRGYQLTQHQKIHTGKKPYECKICGKAFCWGYQLTRHQIFHTGEKPYECKECGKAFNCGSSLIQHERIHTGEKPYECKECGKAFSRGYHLSQHQKIHTGEKPFECKECGKAFSWGSSLVKHERVHTGEKSHECKECGKTFCSGYQLTRHQVFHTGEKPYECKECGKAFNCGSSLVQHERIHTGEKPYECKECGKAFSRGYHLTQHQKIHTGEKPFKCKECGKAFSWGSSLVKHERVHTNEKSYECKDCGKAFGSGYQLSVHQRFHTGEKLYQRKEFGKTFTCGSKLVHERTHSNDKPYKYNECGEAFLWTTYSNEKIDTDETL

SEQ ID NO: 6614 - protein, 593 aa, Homo sapiens
MTMFKEAVTFKDVAVVFTEEELGLLDVSQRKLYRDVMLENFRNLLSVGHQLSHRDTFHFQREEKFWIMETATQREGNSGGKIQTELESVPETGPHEEWSCQQIWEQTASELTRPQDSISSSQFSTQGDVPSQVDAGLSIIHIGETPSEHGKCKKFFSDVSILDLHQQLHSGKISHTCNEYRKRFCYSSALCLHQKVHMGEKRYKCDVCSKAFSQNSQLQTHQRIHTGEKPFKCEQCGKSFSRRSGMYVHCKLHTGEKPHICEECGKAFIHNSQLREHQRIHTGEKPFKCYICGKSFHSRSNLNRHSMVHMQEKSFRCDTCSNSFGQRSALNSHCMDHTKEKLYKCEECGRSFTCRQDLCKHQMDHTGDKPYNCNVCGKGFRWSSCLSRHQRVHNGETTFKCDGCGKRFYMNSQGHSHQRAYREEELYKCQKCGKGYISKFNLDLHQRVHTGERPYNCKECGKSFRWASGILRHKRLHTGEKPFKCEECGKRFTENSKLRFHQRIHTGEKPYKCEECGKGFRWASTHLTHQRLHSREKLFQCEDCGKSSEHSSCLQDQQSDHSGEKTSKCEDCGKRYERRLNLDMILSLFLNDI

SEQ ID NO: 6615 - protein, 912 aa, Homo sapiens
MIKFQMVTFKDVAVVFTEEELGLLDSVQRKLYRDVMLENFRNLLLVAHQPFKPDLISQLEREEKLLMVETETPRDGCSGRKNQQKMESIQEVTVSYFSPKELSSRQTWQQSAGGLIRCQDFLKVFQGKNSQLQEQGNSLGQVWAGIPVQISEDKNYIFTHIGNGSNYIKSQGYPSWRAHHSWRKMYLKESHNYQCRCQQISMKNHFCKCDSVSWLSHHNDKLEVHRKENYSCHDCGEDIMKVSLLNQESIQTEEKPYPCTGYRKAFSNDSSSEVHQQFHLEGKPYTYSSCGKGCNYSSLLHIHQNIEREDDIENSHLKSYQRVHTEEKPCKCGEYGENFNHCSPLNTYELIHTGEMSYRHNIYEKAFSHSLDLNSIFRVHTRDEPHEYEENENVFNQSSCLQVHQKIHTEEKLYTDIEYGKSFICSSNLDIQHRVHMEENSYNSEECGNGFSLASHFQDLQIVHTKEQPYKRYVCSNSFSHNLYLQGHPKIHIGEKPRKEHGNGFNWSSKLKDHQRVHTGQKPYKCNICGKGFNHRSVLNVHQRVHTGEKPYKCEECDKGFSRSSYLQAHQRVHTGEKPYKCEECGKGFSRNSYLQGHQRVHTGEKPYKCEECGKGFSRSSHLQGHQRVHTGEKPFKCEECGKGFSWSFNLQIHQRVHTGEKPYKCEECGKGFSKASTLLAHQRVHTGEKPYQCDECGKSFSQRSYLQSHQSVHSGERPYICEVCGKGFSQRAYLQGHQRVHTRVKPYKCEMCGKGFSQSSRLEAHRRVHTGGKPYKCEVCTKGFSESSRLQAHQRVHVEGRPYKCEQCGKGFSGYSSLQAHHRVHTGEKPYKCEVCGKGFSQRSNLQAHQRVHTGEKPYKCDACGKGFRWSSGLLIHQRVHSSDKFYKSEDYGKDYPSSENLHRNEDSVLF

SEQ ID NO: 6616 - protein, 590 aa, Homo sapiens
MIKFQERVTFKDVAVVFTKEELALLDKAQINLYQDVMLENFRNLMLVRDGIKNNILNLQAKGLSYLSQEVLHCWQIWKQRIRDLTVSQDYIVNLQEECSPHLEDVSLSEEWAGISLQISENENYVVNAIIKNQDITAWQSLTQVLTPESWRKANIMTEPQNSQGRYKGIYMEEKLYRRAQHDDSLSWTSCDHHESQECKGEDPGRHPNCGKNLGMKSTVEKRNAAHVLPQPFPCNNCGVAFADDTDPHVHHSTHLGEKSYKCDQYGKNFSQSQDLIVHCKTHSGKTPYEFHEWPMGCKQSSDLPRYQKVSSGDKPYKCKECGKGFRRSSSLHNHHRVHTGEMPYKCDECGKGFGFRSLLCIHQGVHTGKKPYKCEECGKGFDQSSNLLVHQRVHTGEKPYKCSECGKCFSSSSVLQVHWRFHTGEKPYRCGECGKGFSQCTHLHIHQRVHTGEKPYKCNVCGKDFAYSSVLHTHQRVHTGEKPYKCEVCGKCFSYSSYFHLHQRDHIREKPYKCDECGKGFSRNSDLNVHLRVHTRERPYKCKACGKGFSRNSYLLAHQRVHIDETQYTHCERGKDLLTHQRLHEQRETL

SEQ ID NO: 6617 - protein, 913 aa, Homo sapiens
MTKFQEMVTFKDVAVVFTEEELGLLDSVQRKLYRDVMLENFRNLLLVAHQPFKPDLISQLEREEKLLMVETETPRDGCSGRKNQQKMESIQEVTVSYFSPKELSSRQTWQQSAGGLIRCQDFLKVFQGKNSQLQEQGNSLGQVWAGIPVQISEDKNYIFTHIGNGSNYIKSQGYPSWRAHHSWRKMYLKESHNYQCRCQQISMKNHFCKCDSVSWLSHHNDKLEVHRKENYSCHDCGEDIMKVSLLNQESIQTEEKPYPCTGYRKAFSNDSSSEVHQQFHLEGKPYTYSSCGKGCNYSSLLHIHQNIEREDDIENSHLKSYQRVHTEEKPCKCGEYGENFNHCSPLNTYELIHTGEMSYRHNIYEKAFSHSLDLNSIFRVHTRDEPHEYEENENVFNQSSCLQVHQKIHTEEKLYTDIEYGKSFICSSNLDIQHRVHMEENSYNSEECGNGFSLASHFQDLQIVHTKEQPYKRYVCSNSFSHNLYLQGHPKIHIGEKPRKEHGNGFNWSSKLKDHQRVHTGQKPYKCNICGKGFNHRSVLNVHQRVHTGEKPYKCEECDKGFSRSSYLQAHQRVHTGEKPYKCEECGKGFSRNSYLQGHQRVHTGEKPYKCEECGKGFSRSSHLQGHQRVHTGEKPFKCEECGKGFSWSFNLQIHQRVHTGEKPYKCEECGKGFSKASTLLAHQRVHTGEKPYQCDECGKSFSQRSYLQSHQSVHSGERPYICEVCGKGFSQRAYLQGHQRVHTRVKPYKCEMCGKGFSQSSRLEAHRRVHTGGKPYKCEVCTKGFSESSRLQAHQRVHVEGRPYKCEQCGKGFSGYSSLQAHHRVHTGEKPYKCEVCGKGFSQRSNLQAHQRVHTGEKPYKCDACGKGFRWSSGLLIHQRVHSSDKFYKSEDYGKDYPSSENLHRNEDSVLF

SEQ ID NO: 6618 - protein, 907 aa, Homo sapiens
MVTFKDVAVVFTEEELGLLDSVQRKLYRDVMLENFRNLLLVAHQPFKPDLISQLEREEKLLMVETETPRDGCSGRKNQQKMESIQEVTVSYFSPKELSSRQTWQQSAGGLIRCQDFLKVFQGKNSQLQEQGNSLGQVWAGIPVQISEDKNYIFTHIGNGSNYIKSQGYPSWRAHHSWRKMYLKESHNYQCRCQQISMKNHFCKCDSVSWLSHHNDKLEVHRKENYSCHDCGEDIMKVSLLNQESIQTEEKPYPCTGYRKAFSNDSSSEVHQQFHLEGKPYTYSSCGKGCNYSSLLHIHQNIEREDDIENSHLKSYQRVHTEEKPCKCGEYGENFNHCSPLNTYELIHTGEMSYRHNIYEKAFSHSLDLNSIFRVHTRDEPHEYEENENVFNQSSCLQVHQKIHTEEKLYTDIEYGKSFICSSNLDIQHRVHMEENSYNSEECGNGFSLASHFQDLQIVHTKEQPYKRYVCSNSFSHNLYLQGHPKIHIGEKPRKEHGNGFNWSSKLKDHQRVHTGQKPYKCNICGKGFNHRSVLNVHQRVHTGEKPYKCEECDKGFSRSSYLQAHQRVHTGEKPYKCEECGKGFSRNSYLQGHQRVHTGEKPYKCEECGKGFSRSSHLQGHQRVHTGEKPFKCEECGKGFSWSFNLQIHQRVHTGEKPYKCEECGKGFSKASTLLAHQRVHTGEKPYQCDECGKSFSQRSYLQSHQSVHSGERPYICEVCGKGFSQRAYLQGHQRVHTRVKPYKCEMCGKGFSQSSRLEAHRRVHTGGKPYKCEVCTKGFSESSRLQAHQRVHVEGRPYKCEQCGKGFSGYSSLQAHHRVHTGEKPYKCEVCGKGFSQRSNLQAHQRVHTGEKPYKCDACGKGFRWSSGLLIHQRVHSSDKFYKSEDYGKDYPSSENLHRNEDSVLF

SEQ ID NO: 6619 - protein, 913 aa, Homo sapiens
LTVCQEMVTFKDVAVVFTEEELGLLDSVQRKLYRDVMLENFRNLLLVAHQPFKPDLISQLEREEKLLMVETETPRDGCSGRKNQQKMESIQEVTVSYFSPKELSSRQTWQQSAGGLIRCQDFLKVFQGKNSQLQEQGNSLGQVWAGIPVQISEDKNYIFTHIGNGSNYIKSQGYPSWRAHHSWRKMYLKESHNYQCRCQQISMKNHFCKCDSVSWLSHHNDKLEVHRKENYSCHDCGEDIMKVSLLNQESIQTEEKPYPCTGYRKAFSNDSSSEVHQQFHLEGKPYTYSSCGKGCNYSSLLHIHQNIEREDDIENSHLKSYQRVHTEEKPCKCGEYGENFNHCSPLNTYELIHTGEMSYRHNIYEKAFSHSLDLNSIFRVHTRDEPHEYEENENVFNQSSCLQVHQKIHTEEKLYTDIEYGKSFICSSNLDIQHRVHMEENSYNSEECGNGFSLASHFQDLQIVHTKEQPYKRYVCSNSFSHNLYLQGHPKIHIGEKPRKEHGNGFNWSSKLKDHQRVHTGQKPYKCNICGKGFNHRSVLNVHQRVHTGEKPYKCEECDKGFSRSSYLQAHQRVHTGEKPYKCEECGKGFSRNSYLQGHQRVHTGEKPYKCEECGKGFSRSSHLQGHQRVHTGEKPFKCEECGKGFSWSFNLQIHQRVHTGEKPYKCEECGKGFSKASTLLAHQRVHTGEKPYQCDECGKSFSQRSYLQSHQSVHSGERPYICEVCGKGFSQRAYLQGHQRVHTRVKPYKCEMCGKGFSQSSRLEAHRRVHTGGKPYKCEVCTKGFSESSRLQAHQRVHVEGRPYKCEQCGKGFSGYSSLQAHHRVHTGEKPYKCEVCGKGFSQRSNLQAHQRVHTGEKPYKCDACGKGFRWSSGLLIHQRVHSSDKFYKSEDYGKDYPSSENLHRNEDSVLF

SEQ ID NO: 6620 - protein, 930 aa, Homo sapiens
MGLGPRSLPFSRKRKRKMTKFQEMVTFKDVAVVFTEEELGLLDSVQRKLYRDVMLENFRNLLLVAHQPFKPDLISQLEREEKLLMVETETPRDGCSGRKNQQKMESIQEVTVSYFSPKELSSRQTWQQSAGGLIRCQDFLKVFQGKNSQLQEQGNSLGQVWAGIPVQISEDKNYIFTHIGNGSNYIKSQGYPSWRAHHSWRKMYLKESHNYQCRCQQISMKNHFCKCDSVSWLSHHNDKLEVHRKENYSCHDCGEDIMKVSLLNQESIQTEEKPYPCTGYRKAFSNDSSSEVHQQFHLEGKPYTYSSCGKGCNYSSLLHIHQNIEREDDIENSHLKSYQRVHTEEKPCKCGEYGENFNHCSPLNTYELIHTGEMSYRHNIYEKAFSHSLDLNSIFRVHTRDEPHEYEENENVFNQSSCLQVHQKIHTEEKLYTDIEYGKSFICSSNLDIQHRVHMEENSYNSEECGNGFSLASHFQDLQIVHTKEQPYKRYVCSNSFSHNLYLQGHPKIHIGEKPRKEHGNGFNWSSKLKDHQRVHTGQKPYKCNICGKGFNHRSVLNVHQRVHTGEKPYKCEECDKGFSRSSYLQAHQRVHTGEKPYKCEECGKGFSRNSYLQGHQRVHTGEKPYKCEECGKGFSRSSHLQGHQRVHTGEKPFKCEECGKGFSWSFNLQIHQRVHTGEKPYKCEECGKGFSKASTLLAHQRVHTGEKPYQCDECGKSFSQRSYLQSHQSVHSGERPYICEVCGKGFSQRAYLQGHQRVHTRVKPYKCEMCGKGFSQSSRLEAHRRVHTGGKPYKCEVCTKGFSESSRLQAHQRVHVEGRPYKCEQCGKGFSGYSSLQAHHRVHTGEKPYKCEVCGKGFSQRSNLQAHQRVHTGEKPYKCDACGKGFRWSSGLLIHQRVHSSDKFYKSEDYGKDYPSSENLHRNEDSVLF

SEQ ID NO: 6621 - protein, 613 aa, Homo sapiens
CSSAFPESCPFQKEDGMIKFQVRLSNLQERVTFKDVAVVFTKEELALLDKAQINLYQDVMLENFRNLMLVRDGIKNNILNLQAKGLSYLSQEVLHCWQIWKQRIRDLTVSQDYIVNLQEECSPHLEDVSLSEEWAGISLQISENENYVVNAIIKNQDITAWQSLTQVLTPESWRKANIMTEPQNSQGRYKGIYMEEKLYRRAQHDDSLSWTSCDHHESQECKGEDPGRHPNCGKNLGMKSTVEKRNAAHVLPQPFPCNNCGVAFADDTDPHVHHSTHLGEKSYKCDQYGKNFSQSQDLIVHCKTHSGKTPYEFHEWPMGCKQSSDLPRYQKVSSGDKPYKCKECGKGFRRSSSLHNHHRVHTGEMPYKCDECGKGFGFRSLLCIHQGVHTGKKPYKCEECGKGFDQSSNLLVHQRVHTGEKPYKCSECGKCFSSSSVLQVHWRFHTGEKPYRCGECGKGFSQCTHLHIHQRVHTGEKPYKCNVCGKDFAYSSVLHTHQRVHTGEKPYKCEVCGKCFSYSSYFHLHQRDHIREKPYKCDECGKGFSRNSDLNVHLRVHTRERPYKCKACGKGFSRNSYLLAHQRVHIDETQYTHCERGKDLLTHQRLHEQRETL

SEQ ID NO: 6622 - protein, 141 aa, Homo sapiens
METDLAEMPEKGALSSQDSPHFQEKSTEEGEVAALRLTARSQETVTFKDVAMDFTPEEWGKLDPAQRDVMLENYRNLVSLWLPVSKPESYNLENGKEPLKLERKAPKSSYSAVAVIILFLIPYVHLESWFREITGRRISRS

SEQ ID NO: 6623 - protein, 521 aa, Homo sapiens
METDLAEMPEKGALSSQDSPHFQEKSTEEGEVAALRLTARSQETVTFKDVAMDFTPEEWGKLDPAQRDVMLENYRNLVSLWLPVSKPESYNLENGKEPLKLERKAPKSSYSDMETRPQSKDSTSVQDFSKAESCKVAIIDRLTRNSVYDSNLEAALECENWLENQQGNQERHLREMFTHMNSLSEETDHKHDVYWKSFNQKSVLITEDRVPKGSYAFHTLEKSLKQKSNLMKKQRTYKEKKPHKCNDCGELFTYHSVLIRHQRVHTGEKPYTCNECGKSFSHRANLTKHQRTHTRILFECSECKKTFTESSSLATHQRIHVGERPYECNECGKGFNRSTHLVQHQLIHTGVKPYECNECDKAFIHSSALIKHQRTHTGEKPYKCQECGKAFSHCSSLTKHQRVHTGEKPYECSECGKTFSQSTHLVQHQRIHTGEKPYECNECGKTFSRSSNFAKHQRIHIGKKPYKCSECGKAFIHSSALIQHQRTHTGEKPFRCNECGKSFKCSSSLIRHQRVHTEEQP

SEQ ID NO: 6624 - protein, 511 aa, Homo sapiens
MGALSSQDSPHFQEKSTEEGEVAALRLTARSQETVTFKDVAMDFTPEEWGKLDPAQRDVMLENYRNLVSLWLPVSKPESYNLENGKEPLKLERKAPKSSYSDMETRPQSKDSTSVQDFSKAESCKVAIIDRLTRNSVYDSNLEAALECENWLENQQGNQERHLREMFTHMNSLSEETDHKHDVYWKSFNQKSVLITEDRVPKGSYAFHTLEKSLKQKSNLMKKQRTYKEKKPHKCNDCGELFTYHSVLIRHQRVHTGEKPYTCNECGKSFSHRANLTKHQRTHTRILFECSECKKTFTESSSLATHQRIHVGERPYECNECGKGFNRSTHLVQHQLIHTGVKPYECNECDKAFIHSSALIKHQRTHTGEKPYKCQECGKAFSHCSSLTKHQRVHTGEKPYECSECGKTFSQSTHLVQHQRIHTGEKPYECNECGKTFSRSSNFAKHQRIHIGKKPYKCSECGKAFIHSSALIQHQRTHTGEKPFRCNECGKSFKCSSSLIRHQRVHTEEQP

SEQ ID NO: 6625 - protein, 521 aa, Homo sapiens; identical to SEQ ID NO: 6623

SEQ ID NO: 6626 - protein, 521 aa, Homo sapiens; identical to SEQ ID NO: 6623

SEQ ID NO: 6627 - protein, 522 aa, Homo sapiens
METDLAEMPEKGVLSSQDSPHFQEKSTEEGEVAALRLTARSQAAAAAAAPGSRSLRGVHVPPPLHPAPAREEIKSTCSLKACFSLSLTLTYYRTAFLLSTENEGNLHFQCPSDVETRPQSKDSTSVQDFSKAESCKVAIIDRLTRNSVYDSNLEAALECENWLEKQQGNQERHLREMFTHMNSLSEETDHEHDVYWKSFNQKSVLITEDRVPKGSYAFHTLEKSLKQKSNLMKKQRTYKEKKPHKCNDCGELFTCHSVHIQHQRVHTGEKPYTCNECGKSFSHRANLTKHQRTHTRILFECRECKKTFTESSSLATHQRIHVGERPYECNECGKGFNRSTHLVQHQLIHTGVRPYECNECDKAFIHSSALIKHQRTHTGEKPYKCQECGKAFSHCSSLTKHQRVHTGEKPYECSECGKTFSQSTHLVQHQRIHTGEKPYECSECGKTFSQSSNFAKHQRIHIGKKPYKCSECGKAFIHSSALIQHQRTHTGEKPFRCNECGKSFKCSSSLIRHQRVHTEEQP

SEQ ID NO: 6628 - protein, 761 aa, Homo sapiens
MLASSKRMNSSSRSQILLRWKSDKAQSGPYNVEKEILTSRFLRDTETCRQNFRNFPYPDLAGPRKALSQLRELCLKWLRPEIHSKEQILELLVLEQFLTILPGEVRTWVKSQYPESSEEAVTLVEDLTQILEEEAPQNSTLSQDTPEEDPRGKHAFQTGWLNDLVTKESMTFKDVAVDITQEDWELMRPVQKELYKTVTLQNYWNMVSLGLTVYRPTVIPILEEPWMVIKEILEGPSPEWETKAQACTPVEDMSKLTKEETHTIKLEDSYDYDDRLERRGKGGFWKIHTDERGFSLKSVLSQEYDPTEECLSKYDIYRNNFEKHSNLIVQFDTQLDNKTSVYNEGRATFNHVSYGIVHRKILPGEKPYKCNVCGKKFRKYPSLLKHQSTHAKEKSYECEECGKEFRHISSLIAHQRMHTGEKPYECHQCGKAFSQRAHLTIHQRIHTGEKPYKCDDCGKDFSQRAHLTIHQRTHTGEKPYKCLECGKTFSHSSSLINHQRVHTGEKPYICNECGKTFSQSTHLLQHQKIHTGKKPYKCNECWKVFSQSTYLIRHQRIHSGEKCYKCNECGKAFAHSSTLIQHQTTHTGEKSYICNICGKAFSQSANLTQHHRTHTGEKPYKCSVCGKAFSQSVHLTQHQRIHNGEKPFKCNICGKAYRQGANLTQHQRIHTGEKPYKCNECGKAFIYSSSLNQHQRTHTGERPYKCNECDKDFSQRTCLIQHQRIHTGEKPYACRICGKTFTQSTNLIQHQRVHTGAKHRN

SEQ ID NO: 6629 - protein, 761 aa, Homo sapiens; identical to SEQ ID NO: 6628

SEQ ID NO: 6630 - protein, 57 aa, Homo sapiens
MLASSKRMNSSSRSQILLRWKSDKAQSGPYNVEKEILTSRFLRDTETCRQNFRNFPY

SEQ ID NO: 6631 - protein, 2718 aa, Homo sapiens
MADEEAEQERLSCGEGGCVAELQRLGERLQELELQLRESRVPAVEAATDYCQQLCQTLLEYAEKWKTSEDPLPLLEVYTVAIQSYVKARPYLTSECENVALVLERLALSCVELLLCLPVELSDKQWEQFQTLVQVAHEKLMENGSCELHFLATLAQETGVWKNPVLCTILSQEPLDKDKAFEGPILLDMRIKHLIKTNQLSQATALAKLCSDHPEIGIKGSFKQTYLVCLCTSSPNGKLIEEISEVDCKDALEMICNLESEGDEKSALVLCTAFLSRQLQQGDMYCAWELTLFWSKLQQRVEPSIQVYLERCRQLSLLTKTVYHIFFLIKVINSETEGAGLATCIELCVKALRLESTENTEVKISICKTISCLLPDDLEVKRACQLSEFLIEPTVDAYYAVEMLYNQPDQKYDEENLPIPNSLRCELLLVLKTQWPFDPEFWDWKTLKRQCLALMGEEASIVSSIDELNDSEVYEKVVDYQEESKETSMNGLSGGVGANSGLLKDIGDEKQKKREIKQLRERGFISARFRNWQAYMQYCVLCDKEFLGHRIVRHAQKHYKDGIYSCPICAKNFNSKETFVPHVTLHVKQSSKERLAAMKPLRRLGRPPKITTTNENQKTNTVAKQEQRPIKKNSLYSTDFIVFNDNDGSDDENDDKDKSYEPEVIPVQKPVPVNEFNCPVTFCKKGFKYFKNLIAHVKGHKDNEDAKRFLEMQSKKVICQYCRRHFVSVTHLNDHLQMHCGSKPYICIQMKCKAGFNSYAELLTHRKEHQVFRAKCMFPKCGRIFSEAYLLYDHEAQHYNTYTCKFTGCGKVYRSQGELEKHLDDHSTPPEKVLPPEAQLNSSGDSIQPSEVNQNTAENIEKERSMLPSENNIENSLLADRSDAWDKSKAESAVTKQDQISASELRQANGPLSNGLENPATTPLLQSSEVAVSIKVSLNQGIEDNFGKQENSTVEGSGEALVTDLHTPVEDTCNDLCHPGFQERKEQDCFNDAHVTQNSLVNSETLKIGDLTPQNLERQVNNLMTFSVQNQAAFQNNLPTSKFECGDNVKTSSNLYNLPLKTLESIAFVPPQSDLSNSLGTPSVPPKAPVQKFSCQVEGCTRTYNSSQSIGKHMKTAHPDQYAAFKMQRKSKKGQKANNLNTPNNGKFVYFLPSPVNSSNPFFTSQTKANGNPACSAQLQHVSPPIFPAHLASVSTPLLSSMESVINPNITSQDKNEQGGMLCSQMENLPSTALPAQMEDLTKTVLPLNIDSGSDPFLPLPAESSSMSLFPSPADSGTNSVFSQLENNTNHYSSQIEGNTNSSFLKGGNGENAVFPSQVNVANNFSSTNAQQSAPEKVKKDRGRGPNGKERKPKHNKRAKWPAIIRDGKFICSRCYRAFTNPRSLGGHLSKRSYCKPLDGAEIAQELLQSNGQPSLLASMILSTNAVNLQQPQQSTFNPEACFKDPSFLQLLAENRSPAFLPNTFPRSGVTNFNTSVSQEGSEIIKQALETAGIPSTFEGAEMLSHVSTGCVSDASQVNATVMPNPTVPPLLHTVCHPNTLLTNQNRTSNSKTSSIEECSSLPVFPTNDLLLKTVENGLCSSSFPNSGGPSQNFTSNSSRVSVISGPQNTRSSHLNKKGNSASKRRKKVAPPLIAPNASQNLVTSDLTTMGLIAKSVEIPTTNLHSNVIPTCEPQSLVENLTQKLNNVNNQLFMTDVKENFKTSLESHTVLAPLTLKTENGDSQMMALNSCTTSINSDLQISEDNVIQNFEKTLEIIKTAMNSQILEVKSGSQGAGETSQNAQINYNIQLPSVNTVQNNKLPDSSPFSSFISVMPTKSNIPQSEVSHKEDQIQEILEGLQKLKLENDLSTPASQCVLINTSVTLTPTPVKSTADITVIQPVSEMINIQFNDKVNKPFVCQNQGCNYSAMTKDALFKHYGKIHQYTPEMILEIKKNQLKFAPFKCVVPTCTKTFTRNSNLRAHCQLVHHFTTEEMVKLKIKRPYGRKSQSENVPASRSTQVKKQLAMTEENKKESQPALELRAETQNTHSNVAVIPEKQLVEKKSPDKTESSLQVITVTSEQCNTNALTNTQTKGRKIRRHKKEKEEKKRKKPVSQSLEFPTRYSPYRPYRCVHQGCFAAFTIQQNLILHYQAVHKSDLPAFSAEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQEDNLCQSERQKASNLKRVNKEKNVSQNKKRKVEKAEPASAAELSSVRKEEETAVAIQTIEEHPASFDWSSFKPMGFEVSFLKFLEESAVKQKKNTDKDHPNTGNKKGSHSNSRKNIDKTAVTSGNHVCPCKESETFVQFANPSQLQCSDNVKIVLDKNLKDCTELVLKQLQEMKPTVSLKKLEVHSNDPDMSVMKDISIGKATGRGQY

SEQ ID NO: 6632 - protein, 2723 aa, Homo sapiens
MADEEAEQERLSCGEGGCVAELQRLGERLQELELQLRESRVPAVEAATDYCQQLCQTLLEYAEKWKTSEDPLPLLEVYTVAIQSYVKARPYLTSECENVALVLERLALSCVELLLCLPVELSDKQWEQFQTLVQVAHEKLMENGSCELHFLATLAQETGVWKNPVLCTILSQEPLDKDKVNEFLAFEGPILLDMRIKHLIKTNQLSQATALAKLCSDHPEIGIKGSFKQTYLVCLCTSSPNGKLIEEISEVDCKDALEMICNLESEGDEKSALVLCTAFLSRQLQQGDMYCAWELTLFWSKLQQRVEPSIQVYLERCRQLSLLTKTVYHIFFLIKVINSETEGAGLATCIELCVKALRLESTENTEVKISICKTISCLLPDDLEVKRACQLSEFLIEPTVDAYYAVEMLYNQPDQKYDEENLPIPNSLRCELLLVLKTQWPFDPEFWDWKTLKRQCLALMGEEASIVSSIDELNDSEVYEKVVDYQEESKETSMNGLSGGVGANSGLLKDIGDEKQKKREIKQLRERGFISARFRNWQAYMQYCVLCDKEFLGHRIVRHAQKHYKDGIYSCPICAKNFNSKETFVPHVTLHVKQSSKERLAAMKPLRRLGRPPKITTTNENQKTNTVAKQEQRPIKKNSLYSTDFIVFNDNDGSDDENDDKDKSYEPEVIPVQKPVPVNEFNCPVTFCKKGFKYFKNLIAHVKGHKDNEDAKRFLEMQSKKVICQYCRRHFVSVTHLNDHLQMHCGSKPYICIQMKCKAGFNSYAELLTHRKEHQVFRAKCMFPKCGRIFSEAYLLYDHEAQHYNTYTCKFTGCGKVYRSQGELEKHLDDHSTPPEKVLPPEAQLNSSGDSIQPSEVNQNTAENIEKERSMLPSENNIENSLLADRSDAWDKSKAESAVTKQDQISASELRQANGPLSNGLENPATTPLLQSSEVAVSIKVSLNQGIEDNFGKQENSTVEGSGEALVTDLHTPVEDTCNDLCHPGFQERKEQDCFNDAHVTQNSLVNSETLKIGDLTPQNLERQVNNLMTFSVQNQAAFQNNLPTSKFECGDNVKTSSNLYNLPLKTLESIAFVPPQSDLSNSLGTPSVPPKAPVQKFSCQVEGCTRTYNSSQSIGKHMKTAHPDQYAAFKMQRKSKKGQKANNLNTPNNGKFVYFLPSPVNSSNPFFTSQTKANGNPACSAQLQHVSPPIFPAHLASVSTPLLSSMESVINPNITSQDKNEQGGMLCSQMENLPSTALPAQMEDLTKTVLPLNIDSGSDPFLPLPAESSSMSLFPSPADSGTNSVFSQLENNTNHYSSQIEGNTNSSFLKGGNGENAVFPSQVNVANNFSSTNAQQSAPEKVKKDRGRGPNGKERKPKHNKRAKWPAIIRDGKFICSRCYRAFTNPRSLGGHLSKRSYCKPLDGAEIAQELLQSNGQPSLLASMILSTNAVNLQQPQQSTFNPEACFKDPSFLQLLAENRSPAFLPNTFPRSGVTNFNTSVSQEGSEIIKQALETAGIPSTFEGAEMLSHVSTGCVSDASQVNATVMPNPTVPPLLHTVCHPNTLLTNQNRTSNSKTSSIEECSSLPVFPTNDLLLKTVENGLCSSSFPNSGGPSQNFTSNSSRVSVISGPQNTRSSHLNKKGNSASKRRKKVAPPLIAPNASQNLVTSDLTTMGLIAKSVEIPTTNLHSNVIPTCEPQSLVENLTQKLNNVNNQLFMTDVKENFKTSLESHTVLAPLTLKTENGDSQMMALNSCTTSINSDLQISEDNVIQNFEKTLEIIKTAMNSQILEVKSGSQGAGETSQNAQINYNIQLPSVNTVQNNKLPDSSPFSSFISVMPTKSNIPQSEVSHKEDQIQEILEGLQKLKLENDLSTPASQCVLINTSVTLTPTPVKSTADITVIQPVSEMINIQFNDKVNKPFVCQNQGCNYSAMTKDALFKHYGKIHQYTPEMILEIKKNQLKFAPFKCVVPTCTKTFTRNSNLRAHCQLVHHFTTEEMVKLKIKRPYGRKSQSENVPASRSTQVKKQLAMTEENKKESQPALELRAETQNTHSNVAVIPEKQLVEKKSPDKTESSLQVITVTSEQCNTNALTNTQTKGRKIRRHKKEKEEKKRKKPVSQSLEFPTRYSPYRPYRCVHQGCFAAFTIQQNLILHYQAVHKSDLPAFSAEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQEDNLCQSERQKASNLKRVNKEKNVSQNKKRKVEKAEPASAAELSSVRKEEETAVAIQTIEEHPASFDWSSFKPMGFEVSFLKFLEESAVKQKKNTDKDHPNTGNKKGSHSNSRKNIDKTAVTSGNHVCPCKESETFVQFANPSQLQCSDNVKIVLDKNLKDCTELVLKQLQEMKPTVSLKKLEVHSNDPDMSVMKDISIGKATGRGQY

SEQ ID NO: 6633 - protein, 1066 aa, Homo sapiens
MEGLLHYINPAHAISLLSALNEERLKGQLCDVLLIVGDQKFRAHKNVLAASSEYFQSLFTNKENESQTVFQLDFCEPDAFDNVLNYIYSSSLFVEKSSLAAVQELGYSLGISFLTNIVSKTPQAPFPTCPNRKKVFVEDDENSSQKRSVIVCQSRNEAQGKTVSQNQPDVSHTSRPSPSIAVKANTNKPHVPKPIEPLHNLSLTEKSWPKDSSVVYAKSLEHSGSLDDPNRISLVKRNAVLPSKPLQDREAMDDKPGVSGQLPKGKALELALKRPRPPVLSVCSSSETPYLLKETNKGNGQGEDRNLLYYSKLGLVIPSSGSGSGNQSIDRSGPLVKSLLRRSLSMDSQVPVYSPSIDLKSSQGSSSVSSDAPGNVLCALSQKSSLKDCSEKTALDDRPQVLQPHRLRSFSASQSTDREGASPVTEVRIKTEPSSPLSDPSDIIRVTVGDAATTAAASSSSVTRDLSLKTEDDQKDMSRLPAKRRFQADRRLPFKKLKVNEHGSPVSEDNFEEGSSPTLLDADFPDSDLNKDEFGELEGTRPNKKFKCKHCLKIFRSTAGLHRHVNMYHNPEKPYACDICHKRFHTNFKVWTHCQTQHGIVKNPSPASSSHAVLDEKFQRKLIDIVREREIKKALIIKLRRGKPGFQGQSSSQAQQVIKRNLRSRAKGAYICTYCGKAYRFLSQFKQHIKMHPGEKPLGVNKVAKPKEHAPLASPVENKEVYQCRLCNAKLSSLLEQGSHERLCRNAAVCPYCSLRFFSPELKQEHESKCEYKKLTCLECMRTFKSSFSIWRHQVEVHNQNNMAPTENFSLPVLDHNGDVTGSSRPQSQPEPNKVNHIVTTKDDNVFSDSSEQVNFDSEDSSCLPEDLSLSKQLKIQVKEEPVEEAEEEAPEASTAPKEAGPSKEASLWPCEKCGKMFTVHKQLERHQELLCSVKPFICHVCNKAFRTNFRLWSHFQSHMSQASEESAHKESEVCPVPTNSPSPPPLPPPPPLPKIQPLEPDSPTGLSENPTPATEKLFVPQESDTLFYHAPPLSAITFKRQFMCKLCHRTFKTAFSLWSHEQTHN

SEQ ID NO: 6634 - protein, 49 aa, Homo sapiens
MEGLLHYINPAHAISLLSALNEERLKGQLCDVLLIVGDQKFRAHKNVLA

SEQ ID NO: 6635 - protein, 1066 aa, Homo sapiens; identical to SEQ ID NO: 6633

SEQ ID NO: 6636 - protein, 865 aa, Homo sapiens
MEGLLHYINPAHAISLLSALNEERLKGQLCDVLLIVGDQKFRAHKNVLAASSEYFQSLFTNKENESQTVFQLDFCEPDAFDNVLNYIYSSSLFVEKSSLAAVQELGYSLGISFLTNIVSKTPQAPFPTCPNRKKVFVEDDENSSQKRSVIVCQSRNEAQGKTVSQNQPDVSHTSRPSPSIAVKANTNKPHVPKPIEPLHNLSLTEKSWPKDSSVVYAKSLEHSGSLDDPNRISLVKRNAVLPSKPLQDREAMDDKPGVSGQLPKGKALELALKRPRPPVLSVCSSSETPYLLKETNKGNGQGEDRNLLYYSKLGLVIPSSGSGSGNQSIDRSGPLVKSLLRRSLSMDSQVPVYSPSIDLKSSQGSSSVSSDAPGNVLCALSQKSSLKDCSEKTALDDRPQVLQPHRLRSFSASQSTDREGASPVTEVRIKTEPSSPLSDPSDIIRVTVGDAATTAAASSSSVTRDLSLKTEDDQKDMSRLPAKRRFQADRRLPFKKLKVNEHGSPVSEDNFEEGSSPTLLDADFPDSDLNKDEFEQGSHERLCRNAAVCPYCSLRFFSPELKQEHESKCEYKKLTCLECMRTFKSSFSIWRHQVEVHNQNNMAPTENFSLPVLDHNGDVTGSSRPQSQPEPNKVNHIVTTKDDNVFSDSSEQVNFDSEDSSCLPEDLSLSKQLKIQVKEEPVEEAEEEAPEASTAPKEAGPSKEASLWPCEKCGKMFTVHKQLERHQELLCSVKPFICHVCNKAFRTNFRLWSHFQSHMSQASEESAHKESEVCPVPTNSPSPPPLPPPPPLPKIQPLEPDSPTGLSENPTPATEKLFVPQESDTLFYHAPPLSAITFKRQFMCKLCHRTFKTAFSLWSHEQTHN

SEQ ID NO: 6637 - protein, 1066 aa, Homo sapiens; identical to SEQ ID NO: 6633

SEQ ID NO: 6638 - protein, 119 aa, Homo sapiens
MEGLLHYINPAHAISLLSALNEERLKGQLCDVLLIVGDQKFRAHKNVLAASSEYFQSLFTNKENESQTVFQLDFCEPDAFDNVLNYIYSSSLFVEKSSLAAVQELGYSLGISFLTNIVS

SEQ ID NO: 6639 - protein, 49 aa, Homo sapiens; identical to SEQ ID NO: 6634

SEQ ID NO: 6640 - protein, 623 aa, Homo sapiens
MAHKYVGLQYHGSVTFEDVAIAFSQQEWESLDSSQRGLYRDVMLENYRNLVSMGHSRSKPHVIALLEQWKEPEVTVRKDGRRWCTDLQLEDDTIGCKEMPTSENCPSFALHQKISRQKPRECQEYGKTLCQDSKPVQHERIHSSEKPNRCKECGKNFSNGHQLTIHQRLHVGEKPYKYEKCGKAFISGSAFVKHGRIHTGEKPLKCKQCGKTISGSYQLTVHKSIHTGKKPYECGECGKAFLVYGKLTRHQSTHTGEKPFGCEECGKAFSTFSYLVQHQRIHTSEKPYECKECGKAFSTSSPLAKHQRIHTGEKPYECKECGKSFTVYGQLTRHQSIHTGEKPFECKECGKAFRLSSFLHAHQRIHAEIKPYGCKECGRTFSRASYLVQHGRLHTGEKPYECKECGKAFSTGSYLVQHQRIHTGEKPYECKECGKAFISRHQLTVHQRVHTGEKPYECKECGKAFRVHVHLTQHRKIHTDVKPYECKECGKTFSRASYLVQHSRIHTGKKPYECKECGKAFSSGSYLVQHQRIHTGEKPYECNKCGKAFTVYGQLIGHQSVHTGEKPFECKECGKAFRLNSFLTEHQRVHTGEKPFKCKKCGKTFRYSSALKVHLRKHMSVIP

SEQ ID NO: 6641 - protein, 314 aa, Homo sapiens
ECGKAFSTFSYLVQHQRIHTSEKPYECKECGKAFSTSSPLAKHQRIHTGEKPYECKECGKSFTVYGQLTRHQSIHTGEKPFECKECGRTFSRASYLVQHGRLHTGEKPYECKECGKAFSTGSYLVQHQRIHTGEKPYECKECGKAFISRHQLTVHQRVHTGEKPYECKECGKAFRVHVHLTQHRKIHTDVKPYECKECGKTFSRASYLVQHSRIHTGKKPYECKECGKAFSSGSYLVQHQRIHTGEKPYECNKCGKAFTVYGQLIGHQSVHTGEKPFECKECGKAFRLNSFLTEHQRVHTGEKPFKCKKCGKTF

SEQ ID NO: 6642 - protein, 542 aa, Homo sapiens
MEPKDLQLEDDTIGCKEMPTSENCPSFALHQKISRQKPRECQEYGKTLCQDSKPVQHERIHSSEKPNRCKECGKNFSNGHQLTIHQRLHVGEKPYKYEKCGKAFISGSAFVKHGRIHTGEKPLKCKQCGKTISGSYQLTVHKSIHTGKKPYECGECGKAFLVYGKLTRHQSTHTGEKPFGCEECGKAFSTFSYLVQHQRIHTSEKPYECKECGKAFSTSSPLAKHQRIHTGEKPYECKECGKSFTVYGQLTRHQSIHTGEKPFECKECGKAFRLSSFLHAHQRIHAEIKPYGCKECGRTFSRASYLVQHGRLHTGEKPYECKECGKAFSTGSYLVQHQRIHTGEKPYECKECGKAFISRHQLTVHQRVHTGEKPYECKECGKAFRVHVHLTQHRKIHTDVKPYECKECGKTFSRASYLVQHSRIHTGKKPYECKECGKAFSSGSYLVQHQRIHTGEKPYECNKCGKAFTVYGQLIGHQSVHTGEKPFECKECGKAFRLNSFLTEHQRVHTGEKPFKCKKCGKTFRYSSALKVHLRKHMSVIP

SEQ ID NO: 6643 - protein, 624 aa, Homo sapiens
MAHKYVGLQYHGSVTFEDVAIAFSQQEWESLDSSQRGLYRDVMLENYRNLVSMAGHSRSKPHVIALLEQWKEPEVTVRKDGRRWCTDLQLEDDTIGCKEMPTSENCPSFALHQKISRQKPRECQEYGKTLCQDSKPVQHERIHSSEKPNRCKECGKNFSNGHQLTIHQRLHVGEKPYKYEKCGKAFISGSAFVKHGRIHTGEKPLKCKQCGKTISGSYQLTVHKSIHTGKKPYECGECGKAFLVYGKLTRHQSTHTGEKPFGCEECGKAFSTFSYLVQHQRIHTSEKPYECKECGKAFSTSSPLAKHQRIHTGEKPYECKECGKSFTVYGQLTRHQSIHTGEKPFECKECGKAFRLSSFLHAHQRIHAEIKPYGCKECGRTFSRASYLVQHGRLHTGEKPYECKECGKAFSTGSYLVQHQRIHTGEKPYECKECGKAFISRHQLTVHQRVHTGEKPYECKECGKAFRVHVHLTQHRKIHTDVKPYECKECGKTFSRASYLVQHSRIHTGKKPYECKECGKAFSSGSYLVQHQRIHTGEKPYECNKCGKAFTVYGQLIGHQSVHTGEKPFECKECGKAFRLNSFLTEHQRVHTGEKPFKCKKCGKTFRYSSALKVHLRKHMSVIP

SEQ ID NO: 6644 - protein, 623 aa, Homo sapiens; identical to SEQ ID NO: 6640

SEQ ID NO: 6645 - protein, 519 aa, Homo sapiens
MARDLVMFRDVAVDFSQEEWECLNSYQRNLYRDVILENYSNLVSLAGCSISKPDVITLLEQGKEPWMVVRDEKRRWTLDLESRYDTKKLFQGKDIYEMNLSQWKVMERIKSCGLEEQESPHEVCFRQVTKTTSEKMPTYRKLTSLPLYQKSHNREKPYECGECGKAFRVRQQLTFHQRIHTGEKPYECKECGKAFRQCAHLSRHQRIHTSDKLYECKKCGKIFTCGSDLRVHQRIHIGEKPYECKECGKAFRVRGQLNLHQRIHTGEKPYECKECGKAFRQYAHLTRHQRLNIAEKCYECKECGQAFLCSTGLRLHHKLHTGEKPYECKECGKAFRVRQQLTLHQRIHTGEKPYDCKECGKTFSRGYHLTLHQRIHTGEKPYECKECQKFFRRYSELISHQGIHIGEKPYECKECGKAFRLFSQLTQHQSIHFGEKPFKCKECEKTFRLLSQLTQHQSIHTGEKPYDCKECGKAFRLHSSLIQHQRIHSGEKPYKCKECKKAFRQHSHLTYHQRIHNVT

SEQ ID NO: 6646 - protein, 519 aa, Homo sapiens; identical to SEQ ID NO: 6645

SEQ ID NO: 6647 - protein, 434 aa, Homo sapiens
MARDLVMFRDVAVDFSQEEWECLNSYQRNLYRDVILENYSNLVSLGCSISKPDVITLLEQGKEPWMVVRDEKRRWTLDLESRYDTKKLFQGKDIYEMNLSQWKVMERIKSCGLEEQESPHEVCFRQVTKTTSEKMPTYRKLTSLPLYQKSHNREKPYECGECGKAFRVRQQLTFHQRIHTGEKPYECKECGKAFRQCAHLSRHQRIHTSDKLYECKKCGKIFTCGSDLRLHHKLHTGEKPYECKECGKAFRVRQQLTLHQRIHTGEKPYDCKECGKTFSRGYHLTLHQRIHTGEKPYECKECQKFFRRYSELISHQGIHIGEKPYECKECGKAFRLFSQLTQHQSIHFGEKPFKCKECEKTFRLLSQLTQHQSIHTGEKPYDCKECGKAFRLHSSLIQHQRIHSGEKPYKCKECKKAFRQHSHLTYHQRIHNVT

SEQ ID NO: 6648 - protein, 519 aa, Homo sapiens; identical to SEQ ID NO: 6645

SEQ ID NO: 6649 - protein, 666 aa, Homo sapiens
MQEVVLLDESSGPPSQLLWTRQDTQLPQESALLPAPYPAFTKDGSQGNLPQADITLMSQAQESVTFEDVAVNFTNREWQCLTYAQRHLYKDVMLENYGNMVSLGFPFPKPPLISHLEREVDPCVQDPQDRESLSCSYPVSADKMWPENEKASSQQEIFENGEAYWMKFNSLLKVDSRDPKVREVCVQDVKLENQWETSIREKLREEKEGSEEVTCKKGKNQKVLSKNLNPNSKHSQCNKVLIAQKLHECARCGKNFSWHSDLILHEQIHSGEKPHVCNECGKAFKTRNQLSMHRIIHTGEKPFNCTQCGKAFNSRSALCRHKKTHSGEKPHECRDCGKAFKTRNRLCMHQLIHTGEKPYKCNCCGKAFQFKHSLTIHGRIHTGEKPYECEECGKAFSGSSDLTKHIRIHTGERPYECSKCGRAFSRSSDLSKHKRIHTREKHYGCPQCGKDFSIKAELTKHRRIHTEEKRYRCEECGKAFRHNCKRRAHEREHTGEKPYQCRDCGKTFQDKHCLTIHQRIHTGEKPYKCLECGKAFSGKSNLTNHRRIHTGEKPHKCEVCGMAFHHSSVLRQHKRIHTGEKPYTCSECGTSFRQGSALIGHKRVHTGEKPYECEECGKAFRVSSNLTGHKKRKHQVWSTHELDGSRKSLSPVTVSQTSVVSILTSA

SEQ ID NO: 6650 - protein, 666 aa, Homo sapiens; identical to SEQ ID NO: 6649

SEQ ID NO: 6651 - protein, 666 aa, Homo sapiens; identical to SEQ ID NO: 6649

SEQ ID NO: 6652 - protein, 666 aa, Homo sapiens; identical to SEQ ID NO: 6649

SEQ ID NO: 6653 - protein, 666 aa, Homo sapiens; identical to SEQ ID NO: 6649

SEQ ID NO: 6654 - protein, 666 aa, Homo sapiens; identical to SEQ ID NO: 6649

SEQ ID NO: 6655 - protein, 574 aa, Homo sapiens
MLENYGNMVSLGFPFPKPPLISHLEREVDPCVQDPQDRESLSCSYPVSADKMWPENEKASSQQEIFENGEAYWMKFNSLLKVDSRDPKVREVCVQDVKLENQWETSIREKLREEKEGSEEVTCKKGKNQKVLSKNLNPNSKHSQCNKVLIAQKLHECARCGKNFSWHSDLILHEQIHSGEKPHVCNECGKAFKTRNQLSMHRIIHTGEKPFNCTQCGKAFNSRSALCRHKKTHSGEKPHECRDCGKAFKTRNRLCMHQLIHTGEKPYKCNCCGKAFQFKHSLTIHGRIHTGEKPYECEECGKAFSGSSDLTKHIRIHTGERPYECSKCGRAFSRSSDLSKHKRIHTREKHYGCPQCGKDFSIKAELTKHRRIHTEEKRYRCEECGKAFRHNCKRRAHEREHTGEKPYQCRDCGKTFQDKHCLTIHQRIHTGEKPYKCLECGKAFSGKSNLTNHRRIHTGEKPHKCEVCGMAFHHSSVLRQHKRIHTGEKPYTCSECGTSFRQGSALIGHKRVHTGEKPYECEECGKAFRVSSNLTGHKKRKHQVWSTHELDGSRKSLSPVTVSQTSVVSILTSA

SEQ ID NO: 6656 - protein, 574 aa, Homo sapiens; identical to SEQ ID NO: 6655

SEQ ID NO: 6657 - protein, 574 aa, Homo sapiens; identical to SEQ ID NO: 6655

SEQ ID NO: 6658 - protein, 574 aa, Homo sapiens; identical to SEQ ID NO: 6655

SEQ ID NO: 6659 - protein, 574 aa, Homo sapiens; identical to SEQ ID NO: 6655

SEQ ID NO: 6660 - protein, 574 aa, Homo sapiens; identical to SEQ ID NO: 6655

SEQ ID NO: 6661 - protein, 582 aa, Homo sapiens
MSESWQQPPQTQPQQPQPPQPQHHAEPPPALAEHTLPPGTAENPLGCAVYGILLQPDPGLQPPQHAPLQAAGEPGPKCGVCGHDLAHLSSPHEHQCLAGHDRSFQCTQCLKIFHQATDLLEHQCVQAEQKPFVCGVCKMGFSLLTSLAQHHSSHSGLVKCSICEKTYKPAEAAEPATTAAPSLPAAPAPSTVTPAEQADKPYSCPICQKPFKHLSELSRHERIHTGEKPYKCTLCDKSFSQSSHLVHHKRTHSSERPYKCAVCEKTFKHRSHLVRHMYAHSGEHHLFRCNVCELHFKESSELLQHPCTPSGERPFRCGECQKAFKRPSDLRQHERTHSAERPFKCDLCPMGFKQQYALMRHRRTHKTEEPFKCGLCEKGFGQPSHLLYHQHVHTLETLFKCPVCQKGFDQSAELLRHKCLPGAAERPFKCPVCNKAYKRASALQKHQLAHCAAAEKPLRCTLCERRFFSSSEFVQHRCDPAREKPLKCPDCEKRFKYASDLQRHRRVHTGEKPYKCPNCDKAFKQREHLNKHQGVHAREQQFKCVWCGERFLDVALLQEHSAQHSAAAAAAEGAYQVAACLP

SEQ ID NO: 6662 - protein, 402 aa, Homo sapiens [sequence omitted]

SEQ ID NO: 6663 - protein, 553 aa, Homo sapiens
MAFEDVAVYFSQEEWGLLDTAQRALYRRVMLDNFALVASLGLSTSRPRVVIQLERGEEPWVPSGTDTTLSRTTYRRRNPGSWSLTEDRDVSGEWPRAFPDTPPGMTTSVFPVAGACHSVKSLQRQRGASPSRERKPTGVSVIYWERLLLGSGSGQASVSLRLTSPLRPPEGVRLREKTLTEHALLGRQPRTPERQKPCAQEVPGRTFGSAQDLEAAGGRGHHRMGAVWQEPHRLLGGQEPSTWDELGEALHAGEKSFECRACSKVFVKSSDLLKHLRTHTGERPYECAQCGKAFSQTSHLTQHQRIHSGETPYACPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFKHQRVHTGEKPFACPQCGRAFSHSSNLTQHQLLHTGERPFRCVDCGKAFAKGAVLLSHRRIHTGEKPFVCTQCGRAFRERPALFHHQRIHTGEKTVRRSRASLHPQARSVAGASSEGAPAKETEPTPASGPAAVSQPAEV

SEQ ID NO: 6664 - protein, 286 aa, Homo sapiens [sequence omitted]

SEQ ID NO: 6665 - protein, 330 aa, Homo sapiens
MGAVWQEPHRLLGGQEPSTWDELGEALHAGEKSFECRACSKVFVKSSDLLKHLRTHTGERPYECAQCGKAFSQTSHLTQHQRIHSGETPYACPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFKHQRVHTGEKPFACPQCGRAFSHSSNLTQHQLLHTGERPFRCVDCGKAFAKGAVLLSHRRIHTGEKPFVCTQCGRAFRERPALFHHQRIHTGEKTVRRSRASLHPQARSVAGASSEGAPAKETEPTPASGPAAVSQPAEV

SEQ ID NO: 6666 - protein, 553 aa, Homo sapiens; identical to SEQ ID NO: 6663

SEQ ID NO: 6667 - protein, 534 aa, Homo sapiens
MGVPSVVSAIPIRADCSSKPQPLLQGQPHLYFSPKLLCQLRGSFLPVHSACPGPLLTRMPQATTVSLPLGSWSLTEDRDVSGEWPRAFPDTPPGMTTSVFPVAGACHSVKSLQRQRGASPSRERKPTGVSVIYWERLLLGSGSGQASVSLRLTSPLRPPEGVRLREKTLTEHALLGRQPRTPERQKPCAQEVPGRTFGSAQDLEAAGGRGHHRMGAVWQEPHRLLGGQEPSTWDELGEALHAGEKSFECRACSKVFVKSSDLLKHLRTHTGERPYECAQCGKAFSQTSHLTQHQRIHSGETPYACPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFKHQRVHTGEKPFACPQCGRAFSHSSNLTQHQLLHTGERPFRCVDCGKAFAKGAVLLSHRRIHTGEKPFVCTQCGRAFRERPALFHHQRIHTGEKTGDPGPACTPRPGLLPGHHQKVRQRRKPSPLPPRAQP

SEQ ID NO: 6668 - protein, 544 aa, Homo sapiens
MTFEDVAVYFSQEEWGLLDTAQRALYRHVMLENFTLVTSLGLSTSRPRVVIQLERGEEPWVPSGKDMTLARNTYGRLNSGSWSLTEDRDVSGEWPRAFPDTPPGMTTSVFPVADACHSVKSLQRQPGASPSQERKPTGVSVIYWERLLLGSRSDQASISLRLTSPLRPPKSSRPREKTFTEYRVPGRQPRTPERQKPCAQEVPGRAFGNASDLKAASGGRDRRMGAAWQEPHRLLGGQEPSTWDELGEALHAGEKSFECRACSKVFVKSSDLLKHLRTHTGERPYECTQCGKAFSQTSHLTQHQRIHSGETPYACPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFLHQRVHTGEKPFACAQCGRSFSRSSNLTQHQLLHTGERPFRCVDCGKGFAKGAVLLSHRRIHTGEKPFVCTQCGRAFRERPALLHHQRIHTTEKTNAAAPDCTPGPGFLQGHHRKVRRGGKPSPVLKPAKV

SEQ ID NO: 6669 - protein, 534 aa, Homo sapiens
MGVPTAVSATPVRADASSKPQPLLQSQPHLFFFPKLLSRLLGSPLPVHSACPGPLLTRMPQATTVSLRLGSWSLTEDRDVSGEWPRAFPDTPPGMTTSVFPVADACHSVKSLQRQPGASPSQERKPTGVSVIYWERLLLGSRSDQASISLRLTSPLRPPKSSRPREKTFTEYRVPGRQPRTPERQKPCAQEVPGRAFGNASDLKAASGGRDRRMGAAWQEPHRLLGGQEPSTWDELGEALHAGEKSFECRACSKVFVKSSDLLKHLRTHTGERPYECTQCGKAFSQTSHLTQHQRIHSGETPYACPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFLHQRVHTGEKPFACAQCGRSFSRSSNLTQHQLLHTGERPFRCVDCGKGFAKGAVLLSHRRIHTGEKPFVCTQCGRAFRERPALLHHQRIHTTEKTNAAAPDCTPGPGFLQGHHRKVRRGGKPSPVLKPAKV

SEQ ID NO: 6670 - protein, 544 aa, Homo sapiens; identical to SEQ ID NO: 6668

SEQ ID NO: 6671 - protein, 582 aa, Homo sapiens
MDFEDDYTHSACRNTYQGFNGMDRDYGPGSYGGMDRDYGHGSYGGQRSMDSYLNQSYGMDNHSGGGGGSRFGPYESYDSRSSLGGRDLYRSGYGFNEPEQSRFGGSYGGRFESSYRNSLDSFGGRNQGGSSWEAPYSRSKLRPGFMEDRGRENYSSYSSFSSPHMKPAPVGSRGRGTPAYPESTFGSRNYDAFGGPSTGRGRGRGHMGDFGSIHRPGIVVDYQNKSTNVTVAAARGIKRKMMQPFNKPSGTFIKKPKLAKPMEKISLSKSPTKTDPKNEEEEKRRIEARREKQRRRREKNSEKYGDGYRMAFTCSFCKFRTFEEKDIELHLESSSHQETLDHIQKQTKFDKVVMEFLHECMVNKFKKTSIRKQQTNNQTEVVKIIEKDVMEGVTVDDHMMKVETVHCSACSVYIPALHSSVQQHLKSPDHIKGKQAYKEQIKRESVLTATSILNNPIVKARYERFVKGENPFEIQDHSQDQQIEGDEEDEEKIDEPIEEEEDEDEEEEAEEVGEVEEVEEVEEVREGGIEGEGNIQGVGEGGEVGVVGEVEGVGEVEEVEELEEETAKEEPADFPVEQPEEN

SEQ ID NO: 6672 - protein, 70 aa, Homo sapiens
MDFEDDYTHSACRNTYQGFNGMDRDYGPGSYGGMDRDYGHGSYGGQRSMDSYLNQSYGMDNHSGGGGGSR

SEQ ID NO: 6673 - protein, 493 aa, Homo sapiens
MDFEDDYTHSACRNTYQGFNGMDRDYGPGSYGGMDRDYGHGSYGGQRSMDSYLNQSYGMDNHSGGGGGSSFSSPHMKPAPVGSRGRGTPAYPESTFGSRNYDAFGGPSTGRGRGRGHMGDFGSIHRPGIVVDYQNKSTNVTVAAARGIKRKMMQPFNKPSGTFIKKPKLAKPMEKISLSKSPTKTDPKNEEEEKRRIEARREKQRRRREKNSEKYGDGYRMAFTCSFCKFRTFEEKDIELHLESSSHQETLDHIQKQTKFDKVVMEFLHECMVNKFKKTSIRKQQTNNQTEVVKIIEKDVMEGVTVDDHMMKVETVHCSACSVYIPALHSSVQQHLKSPDHIKGKQAYKEQIKRESVLTATSILNNPIVKARYERFVKGENPFEIQDHSQDQQIEGDEEDEEKIDEPIEEEEDEDEEEEAEEVGEVEEVEEVEEVREGGIEGEGNIQGVGEGGEVGVVGEVEGVGEVEEVEELEEETAKEEPADFPVEQPEEN

SEQ ID NO: 6674 - protein, 582 aa, Homo sapiens
MMFNRDYTHSACRNTYQGFNGMDRDYGPGSYGGMDRDYGHGSYGGQRSMDSYLNQSYGMDNHSGGGGGSRFGPYESYDSRSSLGGRDLYRSGYGFNEPEQSRFGGSYGGRFESSYRNSLDSFGGRNQGGSSWEAPYSRSKLRPGFMEDRGRENYSSYSSFSSPHMKPAPVGSRGRGTPAYPESTFGSRNYDAFGGPSTGRGRGRGHMGDFGSIHRPGIVVDYQNKSTNVTVAAARGIKRKMMQPFNKPSGTFIKKPKLAKPMEKISLSKSPTKTDPKNEEEEKRRIEARREKQRRRREKNSEKYGDGYRMAFTCSFCKFRTFEEKDIELHLESSSHQETLDHIQKQTKFDKVVMEFLHECMVNKFKKTSIRKQQTNNQTEVVKIIEKDVMEGVTVDDHMMKVETVHCSACSVYIPALHSSVQQHLKSPDHIKGKQAYKEQIKRESVLTATSILNNPIVKARYERFVKGENPFEIQDHSQDQQIEGDEEDEEKIDEPIEEEEDEDEEEEAEEVGEVEEVEEVEEVREGGIEGEGNIQGVGEGGEVGVVGEVEGVGEVEEVEELEEETAKEEPADFPVEQPEEN

SEQ ID NO: 6675 - protein, 376 aa, Homo sapiens
MGDFGSIHRPGIVVDYQNKSTNVTVAAARGIKRKMMQPFNKPSGTFIKKPKLAKPMEKISLSKSPTKTDPKNEEEEKRRIEARREKQRRRREKNSEKYGDGYRMAFTCSFCKFRTFEEKDIELHLESSSHQETLDHIQKQTKFDKVVMEFLHECMVNKFKKTSIRKQQTNNQTEVVKIIEKDVMEGVTVDDHMMKVETVHCSACSVYIPALHSSVQQHLKSPDHIKGKQAYKEQIKRESVLTATSILNNPIVKARYERFVKGENPFEIQDHSQDQQIEGDEEDEEKIDEPIEEEEDEDEEEEAEEVGEVEEVEEVEEVREGGIEGEGNIQGVGEGGEVGVVGEVEGVGEVEEVEELEEETAKEEPADFPVEQPEEN

SEQ ID NO: 6676 - protein, 541 aa, Homo sapiens
MRLKMTTRNFPEREVPCDVEVERFTREVPCLSSLGDGWDCENQEGHLRQSALTLEKPGTQEAICEYPGFGEHLIASSDLPPSQRVLATNGFHAPDSNVSGLDCDPALPSYPKSYADKRTGDSDACGKGFNHSMEVIHGRNPVREKPYKYPESVKSFNHFTSLGHQKIMKRGKKSYEGKNFENIFTLSSSLNENQRNLPGEKQYRCTECGKCFKRNSSLVLHHRTHTGEKPYTCNECGKSFSKNYNLIVHQRIHTGEKPYECSKCGKAFSDGSALTQHQRIHTGEKPYECLECGKTFNRNSSLILHQRTHTGEKPYRCNECGKPFTDISHLTVHLRIHTGEKPYECSKCGKAFRDGSYLTQHERTHTGEKPFECAECGKSFNRNSHLIVHQKIHSGEKPYECKECGKTFIESAYLIRHQRIHTGEKPYGCNQCQKLFRNIAGLIRHQRTHTGEKPYECNQCGKAFRDSSCLTKHQRIHTKETPYQCPECGKSFKQNSHLAVHQRLHSREGPSRCPQCGKMFQKSSSLVRHQRAHLGEQPMET

SEQ ID NO: 6677 - protein, 541 aa, Homo sapiens; identical to SEQ ID NO: 6676

SEQ ID NO: 6678 - protein, 541 aa, Homo sapiens; identical to SEQ ID NO: 6676

SEQ ID NO: 6679 - protein, 680 aa, Homo sapiens
MKMKKFQIPVSFQDLTVNFTQEEWQQLDPAQRLLYRDVMLENYSNLVSVGYHVSKPDVIFKLEQGEEPWIVEEFSNQNYPDIDDALEKNKEIQDKHLTQTVFFSNKTLITERENVFGKTLNLGMNSVPSRKMPYKCNPGGNSLKTNSEVIVAKKSKENRKIPDGYSGFGKHEKSHLGMKKYRYNPMRKASNQNENLILHQNIQILKQPFDYNKCGKTFFKRAILITQKGRQTERKPNECNECRKTFSKRSTLIVHQRIHTGEKPYVCSDCRKTFRVKTSLTRHRRIHTGERPYECSECRKTFIDKSALIVHQKIHGGEKSYECNECGKTFFRKSALAEHFRSHTGEKPYECKECGNAFSKKSYLVVHQRTHRGEKPNECKECGKTFFCQSALTAHQRIHTGEKPYECSECEKTFFCQSALNVHRRSHTGEKPYECSQCGKFLCTKSALIAHQITHRGKKSYECNECGKFFCHKSTLTIHQRTHTGEKHGVFNKCGRISIVKSNCSQCKRMNTKENLYECSEHGHAVSKNSHLIVHQRTIWERPYECNECGRTYCRKSALTHHQRTHTGQRPYECNECGKTFCQKFSFVEHQRTHTGEKPYECNECGKSFCHKSAFRVHRRIHTGEKPYECNQCGKTYRRLWTLTEHQKIHTGEKPYECNKCEKTFRHKSNFLLHQKSHKE

SEQ ID NO: 6680 - protein, 642 aa, Homo sapiens
MLENYSNLVSVGYHVSKPDVIFKLEQGEEPWIVEEFSNQNYPDIDDALEKNKEIQDKHLTQTVFFSNKTLITERENVFGKTLNLGMNSVPSRKMPYKCNPGGNSLKTNSEVIVAKKSKENRKIPDGYSGFGKHEKSHLGMKKYRYNPMRKASNQNENLILHQNIQILKQPFDYNKCGKTFFKRAILITQKGRQTERKPNECNECRKTFSKRSTLIVHQRIHTGEKPYVCSDCRKTFRVKTSLTRHRRIHTGERPYECSECRKTFIDKSALIVHQKIHGGEKSYECNECGKTFFRKSALAEHFRSHTGEKPYECKECGNAFSKKSYLVVHQRTHRGEKPNECKECGKTFFCQSALTAHQRIHTGEKPYECSECEKTFFCQSALNVHRRSHTGEKPYECSQCGKFLCTKSALIAHQITHRGKKSYECNECGKFFCHKSTLTIHQRTHTGEKHGVFNKCGRISIVKSNCSQCKRMNTKENLYECSEHGHAVSKNSHLIVHQRTIWERPYECNECGRTYCRKSALTHHQRTHTGQRPYECNECGKTFCQKFSFVEHQRTHTGEKPYECNECGKSFCHKSAFRVHRRIHTGEKPYECNQCGKTYRRLWTLTEHQKIHTGEKPYECNKCEKTFRHKSNFLLHQKSHKE

SEQ ID NO: 6681 - protein, 751 aa, Homo sapiens
MGPQGARRQAFLAFGDVTVDFTQKEWRLLSPAQRALYREVTLENYSHLVSLGILHSKPELIRRLEQGEVPWGEERRRRPGPCAGIYAEHVLRPKNLGLAHQRQQQLQFSDQSFQSDTAEGQEKEKSTKPMAFSSPPLRHAVSSRRRNSVVEIESSQGQRENPTEIDKVLKGIENSRWGAFKCAERGQDFSRKMMVIIHKKAHSRQKLFTCRECHQGFRDESALLLHQNTHTGEKSYVCSVCGRGFSLKANLLRHQRTHSGEKPFLCKVCGRGYTSKSYLTVHERTHTGEKPYECQECGRRFNDKSSYNKHLKAHSGEKPFVCKECGRGYTNKSYFVVHKRIHSGEKPYRCQECGRGFSNKSHLITHQRTHSGEKPFACRQCKQSFSVKGSLLRHQRTHSGEKPFVCKDCERSFSQKSTLVYHQRTHSGEKPFVCRECGQGFIQKSTLVKHQITHSEEKPFVCKDCGRGFIQKSTFTLHQRTHSEEKPYGCRECGRRFRDKSSYNKHLRAHLGEKRFFCRDCGRGFTLKPNLTIHQRTHSGEKPFMCKQCEKSFSLKANLLRHQWTHSGERPFNCKDCGRGFILKSTLLFHQKTHSGEKPFICSECGQGFIWKSNLVKHQLAHSGKQPFVCKECGRGFNWKGNLLTHQRTHSGEKPFVCNVCGQGFSWKRSLTRHHWRIHSKEKPFVCQECKRGYTSKSDLTVHERIHTGERPYECQECGRKFSNKSYYSKHLKRHLREKRFCTGSVGEASS

SEQ ID NO: 6682 - protein, 639 aa, Homo sapiens
MGPQGARRQAFLAFGDVTVDFTQKEWRLLSPAQRALYREVTLENYSHLVSLGILHSKPELIRRLEQGEVPWGEERRRRPGPCAGIYAEHVLRPKNLGLAHQRQQQLQFSDQSFQSDTAEGQEKEKSTKPMAFSSPPLRHAVSSRRRNSVVEIESSQGQRENPTEIDKVLKGIENSRWGAFKCAERGQDFSRKMMVIIHKKAHSRQKLFTCRECHQGFRDESALLLHQNTHTGEKSYVCSVCGRGFSLKANLLRHQRTHSGEKPFLCKVCGRGYTSKSYLTVHERTHTGEKPYECQECGRRFNDKSSYNKHLKAHSGEKPFVCKECGRGYTNKSYFVVHKRIHSGEKPYRCQECGRGFSNKSHLITHQRTHSGEKPFACRQCKQSFSVKGSLLRHQRTHSGEKPFVCKDCERSFSQKSTLVYHQRTHSGEKPFVCRECGQGFIQKSTLVKHQITHSEEKPFVCKDCGRGFIQKSTFTLHQRTHSEEKPYGCRECGRRFRDKSSYNKHLRAHLGEKRFFCRDCGRGFTLKPNLTIHQRTHSGEKPFVCNVCGQGFSWKRSLTRHHWRIHSKEKPFVCQECKRGYTSKSDLTVHERIHTGERPYECQECGRKFSNKSYYSKHLKRHLREKRFCTGSVGEASS

SEQ ID NO: 6683 - protein, 751 aa, Homo sapiens; identical to SEQ ID NO: 6681

SEQ ID NO: 6684 - protein, 719 aa, Homo sapiens
MGPQGARRQAFLAFGDVTVDFTQKEWRLLSPAQRALYREVTLENYSHLVSLGIYAEHVLRPKNLGLAHQRQQQLQFSDQSFQSDTAEGQEKEKSTKPMAFSSPPLRHAVSSRRRNSVVEIESSQGQRENPTEIDKVLKGIENSRWGAFKCAERGQDFSRKMMVIIHKKAHSRQKLFTCRECHQGFRDESALLLHQNTHTGEKSYVCSVCGRGFSLKANLLRHQRTHSGEKPFLCKVCGRGYTSKSYLTVHERTHTGEKPYECQECGRRFNDKSSYNKHLKAHSGEKPFVCKECGRGYTNKSYFVVHKRIHSGEKPYRCQECGRGFSNKSHLITHQRTHSGEKPFACRQCKQSFSVKGSLLRHQRTHSGEKPFVCKDCERSFSQKSTLVYHQRTHSGEKPFVCRECGQGFIQKSTLVKHQITHSEEKPFVCKDCGRGFIQKSTFTLHQRTHSEEKPYGCRECGRRFRDKSSYNKHLRAHLGEKRFFCRDCGRGFTLKPNLTIHQRTHSGEKPFMCKQCEKSFSLKANLLRHQWTHSGERPFNCKDCGRGFILKSTLLFHQKTHSGEKPFICSECGQGFIWKSNLVKHQLAHSGKQPFVCKECGRGFNWKGNLLTHQRTHSGEKPFVCNVCGQGFSWKRSLTRHHWRIHSKEKPFVCQECKRGYTSKSDLTVHERIHTGERPYECQECGRKFSNKSYYSKHLKRHLREKRFCTGSVGEASS

SEQ ID NO: 6685 - protein, 847 aa, Homo sapiens
MAQAIFEALEGMDNQTVLAVQSLLDGQGAVPDPTGQSVNAPPAIQPLDDEDVFLCGKCKKQFNSLPAFMTHKREQCQGNAPALATVSLATNSIYPPSAAPTAVQQAPTPANRQISTYITVPPSPLIQTLVQGNILVSDDVLMSAMSAFTSLDQPMPQGPPPVQSSLNMHSVPSYLTQPPPPPPPPPPLPPPPPPQPPPPPPQSLGPPGRPNPGGNGVVEVYSAAAPLAGSGTVEIQALGMQPYPPLEVPNQCVEPPVYPTPTVYSPGKQGFKPKGPNPAAPMTSATGGTVATFDSPATLKTRRAKAAGKPKAQKLKCSYCDKSFTKNFDLQQHIRSHTGEKPFQCIACGRAFAQKSNVKKHMQTHKVWPPGHSGGTVSRNSVTVQVMALNPSRQEDEESTGLGQPLPGAPQPQALSTAGEEEGDKPESKQVVLIDSSYLCQFCPSKFSTYFQLKSHMTQHKNEQVYKCVVKSCAQTFPKLDTFLEHIKSHQEELSYRCHLCGKDFPSLYDLGVHQYSHSLLPQHSPKKDNAVYKCVKCVNKYSTPEALEHHLQTATHNFPCPHCQKVFPCERYLRRHLPTHGSGGRFKCQVCKKFFRREHYLKLHAHIHSGEKPYKCSVCESAFNRKDKLKRHMLIHEPFKKYKCPFSTHTGCSKEFNRPDKLKAHILSHSGMKLHKCALCSKSFSRRAHLAEHQRAHTGNYKFRCAGCAKGFSRHKYLKDHRCRLGPQKDKDLQTRRPPQRRAAPRSCGSGGRKVLTPLPDPLGLEELKDTGAGLVPEAVPGKPPFAEPDAVLSIVVGGAVGAETELVVPGHAEGLGSNLALAELQAGAEGPCAMLAVPVYIQASE

SEQ ID NO: 6686 - protein, 854 aa, Homo sapiens
MAQAIFEALEGMDNQTVLAVQSLLDGQGAVPDPTGQSVNAPPAIQPLDDEDVFLCGKCKKQFNSLPAFMTHKREQCQGNAPALATVSLATNSIYPPSAAPTAVQQAPTPANRQISTYITVPPSPLIQTLVQGNILVSDDVLMSAMSAFTSLDQPMPQGPPPVQSSLNMHSVPSYLTQPPPPPPPPPPLPPPPPPQPPPPPPQSLGPPGRPNPGGNGVVEVYSAAAPLAGSGTVEIQALGMQPYPPLEVPNQCVEPPVYPTPTVYSPGKQGFKPKGPNPAAPMTSATGGTVATFDSPATLKTRRAKGARGLPEAAGKPKAQKLKCSYCDKSFTKNFDLQQHIRSHTGEKPFQCIACGRAFAQKSNVKKHMQTHKVWPPGHSGGTVSRNSVTVQVMALNPSRQEDEESTGLGQPLPGAPQPQALSTAGEEEGDKPESKQVVLIDSSYLCQFCPSKFSTYFQLKSHMTQHKNEQVYKCVVKSCAQTFPKLDTFLEHIKSHQEELSYRCHLCGKDFPSLYDLGVHQYSHSLLPQHSPKKDNAVYKCVKCVNKYSTPEALEHHLQTATHNFPCPHCQKVFPCERYLRRHLPTHGSGGRFKCQVCKKFFRREHYLKLHAHIHSGEKPYKCSVCESAFNRKDKLKRHMLIHEPFKKYKCPFSTHTGCSKEFNRPDKLKAHILSHSGMKLHKCALCSKSFSRRAHLAEHQRAHTGNYKFRCAGCAKGFSRHKYLKDHRCRLGPQKDKDLQTRRPPQRRAAPRSCGSGGRKVLTPLPDPLGLEELKDTGAGLVPEAVPGKPPFAEPDAVLSIVVGGAVGAETELVVPGHAEGLGSNLALAELQAGAEGPCAMLAVPVYIQASE

SEQ ID NO: 6687 - protein, 599 aa, Homo sapiens
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSLAEPKPEIYTCSSCLLAFSCQQFLSQHVLQIFLGLCAENHFHPGNSSPGHWKQQGQQYSHVSCWFENAEGQERGGGSKPWSARTEERETSRAFPSPLQRQSASPRKGNMVVETEPSSAQRPNPVQLDKGLKELETLRFGAINCREYEPDHNLESNFITNPRTLLGKKPYICSDCGRSFKDRSTLIRHHRIHSMEKPYVCSECGRGFSQKSNLSRHQRTHSEEKPYLCRECGQSFRSKSILNRHQWTHSEEKPYVCSECGRGFSEKSSFIRHQRTHSGEKPYVCLECGRSFCDKSTLRKHQRIHSGEKPYVCRECGRGFSQNSDLIKHQRTHLDEKPYVCRECGRGFCDKSTLIIHERTHSGEKPYVCGECGRGFSRKSLLLVHQRTHSGEKHYVCRECRRGFSQKSNLIRHQRTHSNEKPYICRECGRGFCDKSTLIVHERTHSGEKPYVCSECGRGFSRKSLLLVHQRTHSGEKHYVCRECGRGFSHKSNLIRHQRTH

SEQ ID NO: 6688 - protein, 118 aa, Homo sapiens
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSLGQEIETILANIVKSHLY

SEQ ID NO: 6689 - protein, 101 aa, Homo sapiens
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSL

SEQ ID NO: 6690 - protein, 144 aa, Homo sapiens
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSLAEPKPEIYTCSSCLLAFSCQQFLSQHVLQIFLGLCAENHFHPG

SEQ ID NO: 6691 - protein, 113 aa, Homo sapiens
MENLTKHSIECSSFRGDWECKNQFERKQGSQEGHFSEMIFTPEDMPTFSIQHQRIHTDEKLLECKECGKDFSFVSVLVRHQRIHTGEKPYECKECGKAFGSGANLAYHQRIHT

SEQ ID NO: 6692 - protein, 252 aa, Homo sapiens
MAFSSGSALTRHQRIHTGEKPYICNECGKAFSFGSALTRHQRIHTGEKPYVCKECGKAFNSGSDLTQHQRIHTGEKPYECKECEKAFRSGSKLIQHQRMHTGEKPYECKECGKTFSSGSDLTQHHRIHTGEKPYECKECGKAFGSGSKLIQHQLIHTGERPYECKECGKSFSSGSALNRHQRIHTGEKPYECKECGKAFYSGSSLTQHQRIHTGEKLYECKNCGKAYGRDSEFQQHKKSHNGKKLCELETIN

SEQ ID NO: 6693 - protein, 488 aa, Homo sapiens
MENLTKHSIECSSFRGDWECKNQFERKQGSQEGHFSEMIFTPEDMPTFSIQHQRIHTDEKLLECKECGKDFSFVSVLVRHQRIHTGEKPYECKECGKAFGSGANLAYHQRIHTGEKPFECKECGKAFGSGSNLTHHQRIHTGEKPYECKECGKAFSFGSGLIRHQIIHSGEKPYECKECGKSFSFESALIRHHRIHTGEKPYECIDCGKAFGSGSNLTQHRRIHTGEKPYECKACGMAFSSGSALTRHQRIHTGEKPYICNECGKAFSFGSALTRHQRIHTGEKPYVCKECGKAFNSGSDLTQHQRIHTGEKPYECKECEKAFRSGSKLIQHQRMHTGEKPYECKECGKTFSSGSDLTQHHRIHTGEKPYECKECGKAFGSGSKLIQHQLIHTGERPYECKECGKSFSSGSALNRHQRIHTGEKPYECKECGKAFYSGSSLTQHQRIHTGEKLYECKNCGKAYGRDSEFQQHKKSHNGKKLCELETIN

SEQ ID NO: 6694 - protein, 488 aa, Homo sapiens; identical to SEQ ID NO: 6693

SEQ ID NO: 6695 - protein, 75 aa, Homo sapiens
MENLTKHSIECSSFRGDWECKNQFERKQGSQEGHFSEMIFTPEDMPTFSIQHQRIHTDEKLLECKECGKDFSFVS

SEQ ID NO: 6696 - protein, 488 aa, Homo sapiens; identical to SEQ ID NO: 6693

SEQ ID NO: 6697 - protein, 319 aa, Homo sapiens
MEYPAPATVQAADGGAAGPYSSSELLEGQEPDGVRFDRERARRLWEAVSGAQPVGREEAQFFPHSRTVIPILVLSETYSLCHPVEHMIQKNQCLFTNTQCKVCCALLISESQKLAHYQSKKHANKVKRYLAIHGMETLKGETKKLDSDQKSSRSKDKNQCCPICNMTFSSPVVAQSHYLGKTHAKNLKLKQQSTKVEALHQNREMIDPDKFCSLCHATFNDPVMAQQHYVGKKHRKQETKLKLMARYGRLADPAVTDFPAGKGYPCKTCKIVLNSIEQYQAHVSGFKHKNQSPKTVASSLGQIPMQRQPIQKDSTTLED

SEQ ID NO: 6698 - protein, 294 aa, Homo sapiens
MEYPAPATVQAADGGAAGPYSSSELLEGQEPDGVRFDRERARRLWEAVSGAQPVGREEVEHMIQKNQCLFTNTQCKVCCALLISESQKLAHYQSKKHANKVKRYLAIHGMETLKGETKKLDSDQKSSRSKDKNQCCPICNMTFSSPVVAQSHYLGKTHAKNLKLKQQSTKVEALHQNREMIDPDKFCSLCHATFNDPVMAQQHYVGKKHRKQETKLKLMARYGRLADPAVTDFPAGKGYPCKTCKIVLNSIEQYQAHVSGFKHKNQSPKTVASSLGQIPMQRQPIQKDSTTLED

SEQ ID NO: 6699 - protein, 319 aa, Homo sapiens; identical to SEQ ID NO: 6697

SEQ ID NO: 6700 - protein, 262 aa, Homo sapiens
MEYPAPATVQAADGGAAGPYSSSELLEGQEPDGVRFDRERARRLWEAVSGAQPVGREEVEHMIQKNQCLFTNTQCKVCCALLISESQKLAHYQSSRSKDKNQCCPICNMTFSSPVVAQSHYLGKTHAKNLKLKQQSTKVEALHQNREMIDPDKFCSLCHATFNDPVMAQQHYVGKKHRKQETKLKLMARYGRLADPAVTDFPAGKGYPCKTCKIVLNSIEQYQAHVSGFKHKNQSPKTVASSLGQIPMQRQPIQKDSTTLED

SEQ ID NO: 6701 - protein, 196 aa, Homo sapiens
MEYPAPATVQAADGGAAGPYSSSELLEGQEPDGVRFDRERARRLWEAVSGAQPVGREEALSKRLTNPFLVASTLALHQNREMIDPDKFCSLCHATFNDPVMAQQHYVGKKHRKQETKLKLMARYGRLADPAVTDFPAGKGYPCKTCKIVLNSIEQYQAHVSGFKHKNQSPKTVASSLGQIPMQRQPIQKDSTTLED

SEQ ID NO: 6702 - protein, 310 aa, Homo sapiens
MEYPAPATVQAADGGAAGPYSSSELLEGQEPDGVRFDRERARRLWEAVSGAQPVGREEVEHMIQKNQCLFTNTQCKVCCALLISESQKLAHYQSKKHANKVKRYLAIHGMETLKGETKKLDSDQKSSRSKDKNQCCPICNMTFSSPVVAQSHYLGKTHAKNLKLKQQSTKVEALSKRLTNPFLVASTLALHQNREMIDPDKFCSLCHATFNDPVMAQQHYVGKKHRKQETKLKLMARYGRLADPAVTDFPAGKGYPCKTCKIVLNSIEQYQAHVSGFKHKNQSPKTVASSLGQIPMQRQPIQKDSTTLED

SEQ ID NO: 6703 - protein, 118 aa, Homo sapiens
MEYPAPATVQAADGGAAGPYSSSELLEGQEPDGVRFDRERARRLWEAVSGAQPVGREEAGKGYPCKTCKIVLNSIEQYQAHVSGFKHKNQSPKTVASSLGQIPMQRQPIQKDSTTLED

SEQ ID NO: 6704 - protein, 839 aa, Homo sapiens
MALTQGQVTFRDVAIEFSQEEWTCLDPAQRTLYRDVMLENYRNLASLGISCFDLSIISMLEQGKEPFTLESQVQIAGNPDGWEWIKAVITALSSEFVMKDLLHKGKSNTGEVFQTVMLERQESQDIEGCSFREVQKNTHGLEYQCRDAEGNYKGVLLTQEGNLTHGRDEHDKRDARNKLIKNQLGLSLQSHLPELQLFQYEGKIYECNQVEKSFNNNSSVSPPQQMPYNVKTHISKKYLKDFISSLLLTQGQKANNWGSPYKSNGCGMVFPQNSHLASHQRSHTKEKPYKCYECGKAFRTRSNLTTHQVIHTGEKRYKCNECGKVFSRNSQLSQHQKIHTGEKPYKCNECGKVFTQNSHLVRHRGIHTGEKPYKCNECGKAFRARSSLAIHQATHSGEKPYKCNECGKVFTQNSHLTNHWRIHTGEKPYKCNECGKAFGVRSSLAIHLVIHTGEKPYKCHECGKVFRRNSHLARHQLIHTGEKPYKCNECGKAFRAHSNLTTHQVIHTGEKPYKCNECGKVFTQNSHLANHQRIHTGVKPYMCNECGKAFSVYSSLTTHQVIHTGEKPYKCNECGKVFTQNSHLARHRGIHTGEKPYKCNECGKVFRHNSYLSRHQRIHTGEKPYKYNEYGKAFSEHSNLTTHQVIHTGEKPYKCNECGKVFTQNSHLARHRRVHTGGKPYQCNECGKAFSQTSKLARHQRVHTGEKPYECNQCGKAFSVRSSLTTHQAIHTGKKPYKCNECGKVFTQNSHLARHRGIHTGEKPYKCNECGKAFSQTSKLARHQRIHTGEKPYECGKPFSICSSLTTHQTIHTGGKPYKCNVWKVLKSEFKPCKPSQNS

SEQ ID NO: 6705 - protein, 93 aa, Homo sapiens
SRNSQLSQHQKIHTGEKPYKCNECGKVFTQNSHLVRHRGIHTGEKPYKCNECGKPFSICSSLTTHQTIHTGGKPYKCNVWKVLKSEFKPCKPS

SEQ ID NO: 6706 - protein, 840 aa, Homo sapiens
MALTQGQVTFRDVAIEFSQEEWTCLDPAQRTLYRDVMLENYRNLASLAGISCFDLSIISMLEQGKEPFTLESQVQIAGNPDGWEWIKAVITALSSEFVMKDLLHKGKSNTGEVFQTVMLERQESQDIEGCSFREVQKNTHGLEYQCRDAEGNYKGVLLTQEGNLTHGRDEHDKRDARNKLIKNQLGLSLQSHLPELQLFQYEGKIYECNQVEKSFNNNSSVSPPQQMPYNVKTHISKKYLKDFISSLLLTQGQKANNWGSPYKSNGCGMVFPQNSHLASHQRSHTKEKPYKCYECGKAFRTRSNLTTHQVIHTGEKRYKCNECGKVFSRNSQLSQHQKIHTGEKPYKCNECGKVFTQNSHLVRHRGIHTGEKPYKCNECGKAFRARSSLAIHQATHSGEKPYKCNECGKVFTQNSHLTNHWRIHTGEKPYKCNECGKAFGVRSSLAIHLVIHTGEKPYKCHECGKVFRRNSHLARHQLIHTGEKPYKCNECGKAFRAHSNLTTHQVIHTGEKPYKCNECGKVFTQNSHLANHQRIHTGVKPYMCNECGKAFSVYSSLTTHQVIHTGEKPYKCNECGKVFTQNSHLARHRGIHTGEKPYKCNECGKVFRHNSYLSRHQRIHTGEKPYKYNEYGKAFSEHSNLTTHQVIHTGEKPYKCNECGKVFTQNSHLARHRRVHTGGKPYQCNECGKAFSQTSKLARHQRVHTGEKPYECNQCGKAFSVRSSLTTHQAIHTGKKPYKCNECGKVFTQNSHLARHRGIHTGEKPYKCNECGKAFSQTSKLARHQRIHTGEKPYECGKPFSICSSLTTHQTIHTGGKPYKCNVWKVLKSEFKPCKPSQNS

SEQ ID NO: 6707 - protein, 532 aa, Homo sapiens
MIQAQESITLEDVAVDFTWEEWQLLGAAQKDLYRDVMLENYSNLVAVGYQASKPDALFKLEQGEQLWTIEDGIHSGACSDIWKVDHVLERLQSESLVNRRKPCHEHDAFENIVHCSKSQFLLGQNHDIFDLRGKSLKSNLTLVNQSKGYEIKNSVEFTGNGDSFLHANHERLHTAIKFPASQKLISTKSQFISPKHQKTRKLEKHHVCSECGKAFIKKSWLTDHQVMHTGEKPHRCSLCEKAFSRKFMLTEHQRTHTGEKPYECPECGKAFLKKSRLNIHQKTHTGEKPYICSECGKGFIQKGNLIVHQRIHTGEKPYICNECGKGFIQKTCLIAHQRFHTGKTPFVCSECGKSCSQKSGLIKHQRIHTGEKPFECSECGKAFSTKQKLIVHQRTHTGERPYGCNECGKAFAYMSCLVKHKRIHTREKQEAAKVENPPAERHSSLHTSDVMQEKNSANGATTQVPSVAPQTSLNISGLLANRNVVLVGQPVVRCAASGDNRGFAQDRNLVNAVNVVVPSVINYVLFYVTENP

SEQ ID NO: 6708 - protein, 605 aa, Homo sapiens
MAAGQREARPQVSLTFEDVAVLFTRDEWRKLAPSQRNLYRDVMLENYRNLVSLGLPFTKPKVISLLQQGEDPWEVEKDGSGVSSLGSKSSHKTTKSTQTQDSSFQGLILKRSNRNVPWDLKLEKPYIYEGRLEKKQDKKGSFQIVSATHKKIPTIERSHKNTELSQNFSPKSVLIRQQILPREKTPPKCEIQGNSLKQNSQLLNQPKITADKRYKCSLCEKTFINTSSLRKHEKNHSGEKLFKCKECSKAFSQSSALIQHQITHTGEKPYICKECGKAFTLSTSLYKHLRTHTVEKSYRCKECGKSFSRRSGLFIHQKIHAEENPCKYNPGRKASSCSTSLSGCQRIHSRKKSYLCNECGNTFKSSSSLRYHQRIHTGEKPFKCSECGRAFSQSASLIQHERIHTGEKPYRCNECGKGFTSISRLNRHRIIHTGEKFYNCNECGKALSSHSTLIIHERIHTGEKPCKCKVCGKAFRQSSALIQHQRMHTGERPYKCNECGKTFRCNSSLSNHQRIHTGEKPYRCEECGISFGQSSALIQHRRIHTGEKPFKCNTCGKTFRQSSSRIAHQRIHTGEKPYECNTCGKLFNHRSSLTNHYKIHIEEDP

SEQ ID NO: 6709 - protein, 135 aa, Homo sapiens
MAAGQREARPQVSLTFEDVAVLFTRDEWRKLAPSQRNLYRDVMLENYRNLVSLGLPFTKPKVISLLQQGEDPWEVEKDGSGVSSLGSKSSHKTTKSTQTQDSSFQGLILKRSNRNVPWDLKLEKPYIYEGRLEKK

SEQ ID NO: 6710 - protein, 612 aa, Homo sapiens
MAAGQREARPQVSLTFEDVAVLFTWDEWRKLAPSQRNLYRDVMLENYRNLVSLGLSFTKPKVISLLQQGEDPWEVEKDSSGVSSLGCKSTPKMTKSTQTQDSFQEQIRKRLKRDEPWNFISERSCIYEEKLKKQQDKNENLQIISVAHTKILTVDRSHKNVEFGQNFYLKSVFIKQQRFAKEKTPSKCEIQRNSFKQNSNLLNQSKIKTAEKRYKCSTCEKAFIHNSSLRKHQKNHTGEKLFKCKECLKAFSQSSALIQHQRTHTGEKPYICKECGKAFSHSASLCKHLRTHTVEKCYRCKECGKSFSRRSGLFIHQKIHAQENPHKYNPGRKASSYSTSLSGSQKIHLRKKSYLCNECGNTFKSSSSLRYHQRIHTGEKPFKCSECGRAFSQSASLIQHERIHTGEKPYRCNECGKGFTSISRLNRHRIIHTGEKLYNCNECGKALSSHSTLIIHERIHTGEKPCKCKVCGKAFRQSSALIQHQRMHTGERPYKCNECDKTFRCNSSLSNHQRIHTGEKPYRCLECGMSFGQSAALIQHQRIHTGEKPFKCNTCGKTFRQSSSLIAHQRIHTGEKPYECNACGKLFSQRSSLTNHYKIHIEEDSLKADLHV

SEQ ID NO: 6711 - protein, 134 aa, Homo sapiens
MAAGQREARPQVSLTFEDVAVLFTWDEWRKLAPSQRNLYRDVMLENYRNLVSLGLSFTKPKVISLLQQGEDPWEVEKDSSGVSSLGCKSTPKMTKSTQTQDSFQEQIRKRLKRDEPWNFISERSCIYEEKLKKQ

SEQ ID NO: 6712 - protein, 554 aa, Homo sapiens [sequence omitted]

SEQ ID NO: 6713 - protein, 568 aa, Homo sapiens
MRRSVLVRNPGHKGLRPVYEELDSDSEDLDPNPEDLDPVSEDPEPDPEDLNTVPEDVDPSYEDLEPVSEDLDPDAEAPGSEPQDPDPMSSSFDLDPDVIGPVPLILDPNSDTLSPGDPKVDPISSGLTATPQVLATSPAVLPAPASPPRPFSCPDCGRAFRRSSGLSQHRRTHSGEKPYRCPDCGKSFSHGATLAQHRGIHTGARPYQCAACGKAFGWRSTLLKHRSSHSGEKPHHCPVCGKAFGHGSLLAQHLRTHGGPRPHKCPVCAKGFGQGSALLKHLRTHTGERPYPCPQCGKAFGQSSALLQHQRTHTAERPYRCPHCGKAFGQSSNLQHHLRIHTGERPYACPHCSKAFGQSSALLQHLHVHSGERPYRCQLCGKAFGQASSLTKHKRVHEGAAAAAAAAAAAAAAAAAGLGLGPGLSPASMMRPGQVSLLGPDAVSVLGSGLGLSPGTSSGRNPDPGSGPGTLPDPSSKPLPGSRSTPSPTPVESSDPKAGHDAGPDLVPSPDLDPVPSPDPDPVPSPDPNPVSCPDPCSPTRGTVSPALPTGESPEWVQEQGALLGPDG

SEQ ID NO: 6714 - protein, 568 aa, Homo sapiens; identical to SEQ ID NO: 6713

SEQ ID NO: 6715 - protein, 568 aa, Homo sapiens; identical to SEQ ID NO: 6713

SEQ ID NO: 6716 - protein, 420 aa, Homo sapiens
MSRSSPSGKGHSRMAEPRFNNPYFWPPPPTMPSQLDNLVLINKIKEQLMAEKIRPPHLPPTSASSQQPLLVPPAPAESSQAVMSLPKLQQVPGLHPQAVPQPDVALHARPATSTVTGLGLSTRTPSVSTSESSAGAGTGTGTSTPSTPTTTSQSRLIASSPTLISGITSPPLLDSIKTIQGHGLLGPPKSERGRKKIKAENPGGPPVLVVPYPILASGETAKEGKTYRCKVCPLTFFTKSEMQIHSKSHTEAKPHKCPHCSKSFANASYLAQHLRIHLGVKPYHCSYCDKSFRQLSHLQQHTRIHTGDRPYKCPHPGCEKAFTQLSNLQSHQRQHNKDKPYKCPNCYRAYSDSASLQIHLSAHAIKHAKAYCCSMCGRAYTSETYLMKHMSKHTVVEHLVSHHSPQRTESPGIPVRISLI

SEQ ID NO: 6717 - protein, 420 aa, Homo sapiens; identical to SEQ ID NO: 6716

SEQ ID NO: 6718 - protein, 744 aa, Homo sapiens
MQKEMKMIKDEDVHFDLAVKKTPSFPHCLQPVASRGKAPQRHPFPEALRGPFSQFRYEPPPGDLDGFPGVFEGAGSRKRKSMPTKMPYNHPAEEVTLALHSEENKNHGLPNLPLLFPQPPRPKYDSQMIDLCNVGFQFYRSLEHFGGKPVKQEPIKPSAVWPQPTPTPFLPTPYPYYPKVHPGLMFPFFVPSSSPFPFSRHTFLPKQPPEPLLPRKAEPQESEETKQKVERVDVNVQIDDSYYVDVGGSQKRWQCPTCEKSYTSKYNLVTHILGHSGIKPHACTHCGKLFKQLSHLHTHMLTHQGTRPHKCQVCHKAFTQTSHLKRHMMQHSEVKPHNCRVCGRGFAYPSELKAHEAKHASGRENICVECGLDFPTLAQLKRHLTTHRGPIQYNCSECDKTFQYPSQLQNHMMKHKDIRPYICSECGMEFVQPHHLKQHSLTHKGVKEHKCGICGREFTLLANMKRHVLIHTNIRAYQCHLCYKSFVQKQTLKAHMIVHSDVKPFKCKLCGKEFNRMHNLMGHMHLHSDSKPFKCLYCPSKFTLKGNLTRHMKVKHGVMERGLHSQGLGRGRIALAQTAGVLRSLEQEEPFDLSQKRRAKVPVFQSDGESAQGSHCHEEEEEDNCYEVEPYSPGLAPQSQQLCTPEDLSTKSEHAPEVLEEACKEEKEDASKGEWEKRSKGDLGAEGGQERDCAGRDECLSLRAFQSTRRGPSFSDYLYFKHRDESLKELLERKMEKQAVLLGI

SEQ ID NO: 6719 - protein, 238 aa, Homo sapiens
MKNVANTVTISHILPHIKIIHTEEKPDKCEECNKVFNWSSTHTKYKRIHTEDKFYKYEECDKSFKNISTLITHKIIYVVEKFYKCEECGKVFFFFLKWSLTLSPKLECNGAISVHCNLRLLGSSDSLASTSQAAGIAGACHHAQLIFVFLVETGFHHFDQAGFELLTSSDPPALASQSAPKCWDYKHEPLSPVECGKVFNKLSNHTGEKLYKPKRHDSALENTLNFSKHKRNHSVKKP

SEQ ID NO: 6720 - protein, 561 aa, Homo sapiens
MITSQGSVSFRDVTVGFTQEEWQHLDPAQRTLYRDVMLENYSHLVSVGYCIPKPEVILKLEKGEEPWILEEKFPSQSHLELINTSRNYSIMKFNEFNKGGKCFCDEKHEIIHSEEEPSEYNKNGNSFWLNEDLIWHQKIKNWEQSFEYNECGKAFPENSLFLVHKRGYTGQKTCKYTEHGKTCDMSFFITHQQTHPRENHYGNECGENIFEESILLEHQSVYPFSQKLNLTPIQRTHSINNIIEYNECGTFFSEKLVLHLQQRTHTGEKPYECHECGKTFTQKSAHTRHQRTHTGGKPYECHECGKTFYKNSDLIKHQRIHTGERPYGCHECGKSFSEKSTLTQHQRTHTGEKPYECHECGKTFSFKSVLTVHQKTHTGEKPYECYACGKAFLRKSDLIKHQRIHTGEKPYECNECGKSFSEKSTLTKHLRTHTGEKPYECIQCGKFFCYYSGFTEHLRRHTGEKPFGCNECGKTFRQKSALIVHQRTHIRQKPYGCNQCGKSFCVKSKLIAHHRTHTGEKPYECNVCGKSFYVKSKLTVHQRIHLGRNPINVVNEGNYSG

SEQ ID NO: 6721 - protein, 561 aa, Homo sapiens; identical to SEQ ID NO: 6720

SEQ ID NO: 6722 - protein, 395 aa, Homo sapiens
MRNIMYFGGTCQSPALPALVRPPAPPLQPSLDIKPFLPFPLDTAAAVNLFPNFNAMDPIQKAVINHTFGVPLPHRRKQIISCNICQLRFNSDSQAAAHYKGTKHAKKLKALEAMKNKQKSVTAKDSAKTTFTSITTNTINTSSDKTDGTAGTPAISTTTTVEIRKSSVMTTEITSKVEKSPTTATGNSSCPSTETEEEKAKRLLYCSLCKVAVNSASQLEAHNSGTKHKTMLEARNGSGTIKAFPRAGVKGKGPVNKGNTGLQNKTFHCEICDVHVNSETQLKQHISSRRHKDRAAGKPPKPKYSPYNKLQKTAHPLGVKLVFSKEPSKPLAPRILPNPLAAAAAAAAVAVSSPFSLRTAPAATLFQTSALPPALLRPAPGPIRTAHTPVLFAPY

SEQ ID NO: 6723 - protein, 358 aa, Homo sapiens
MESLRGNTAQGPTNEEDYKNEGQLSRQTKCPAQKKSSFENTVVRKVSVTLKEIFTGEEGPESSEFSLSPNLDAQQKIPKGHGSPISRKNSKDNSDLIKHQRLFSQRKPCKCNECEKAFSYQSDLLVHSRIHGGEKPFECNKCGKSFSRSTHLIEHQRTHTGEKPYECNECGKAFSRSTHLSLHQRIHTGEKPYECSECGKAFSRSTNLSQHQRTHTQERPYKCNECGKAFGDRSTIIQHQRIHTGENPYECSKCGKAFSWISSLTEHQRTHTGENPYECSECGKVFSRSSSLTEHQRIHSGEKPHECRVCGKGFSRSSSLIIHQRTHTGEKPYKCNDCGKAFCQSSTLIRHQHLHTKE

SEQ ID NO: 6724 - protein, 133 aa, Homo sapiens
MESLRGNTAQGPTNEEDYKNEGQLSRQTKCPAQKKSSFENTVVRKVSVTLKEIFTGEEGPESSEFSLSPNLDAQQKIPKGHGSPISRKNSKDNSDLIKHQRLFSQRKPCKCNECEKAFSYQSDLLVHSRIHGG

SEQ ID NO: 6725 - protein, 561 aa, Homo sapiens
MNSSLTAQRRGSDAELGPWVMAARSKDAAPSQRDGLLPVKVEEDSPGSWEPNYPAASPDPETSRLHFRQLRYQEVAGPEEALSRLRELCRRWLRPELLSKEQILELLVLEQFLTILPEELQAWVREHCPESGEEAVAVVRALQRALDGTSSQGMVTFEDTAVSLTWEEWERLDPARRDFCRESAQKDSGSTVPPSLESRVENKELIPMQQILEEAEPQGQLQEAFQGKRPLFSKCGSTHEDRVEKQSGDPLPLKLENSPEAEGLNSISDVNKNGSIEGEDSKNNELQNSARCSNLVLCQHIPKAERPTDSEEHGNKCKQSFHMVTWHVLKPHKSDSGDSFHHSSLFETQRQLHEERPYKCGNCGKSFKQRSDLFRHQRIHTGEKPYGCQECGKSFSQSAALTKHQRTHTGEKPYTCLKCGERFRQNSHLNRHQSTHSRDKHFKCEECGETCHISNLFRHQRLHKGERPYKCEECEKSFKQRSDLFKHHRIHTGEKPYGCSVCGKRFNQSATLIKHQRIHTGEKPYKCLECGERFRQSTHLIRHQRIHQNKVLSAGRGGSRL

SEQ ID NO: 6726 - protein, 162 aa, Homo sapiens
MNSSLTAQRRGSDAELGPWVMAARSKDAAPSQRDGLLPVKVEEDSPGSWEPNYPAASPDPETSRLHFRQLRYQEVAGPEEALSRLRELCRRWLRPELLSKEQILELLVLEQFLTILPEELQAWVREHCPESGEEAVAVVRALQRALDGTSSQVWKAEWRTKS

SEQ ID NO: 6727 - protein, 471 aa, Homo sapiens
MKGNYESLISMDYAINQPDVLSQIQPEGEHNTEDQAGPEESEIPTDPSEEPGISTSDILSWIKQEEEPQVGAPPESKESDVYKSTYADEELVIKAEGLARSSLCPEVPVPFSSPPAAAKDAFSDVAFKSQQSTSMTPFGRPATDLPEASEGQVTFTQLGSYPLPPPVGEQVFSCHHCGKNLSQDMLLTHQCSHATEHPLPCAQCPKHFTPQADLSSTSQDHASETPPTCPHCARTFTHPSRLTYHLRVHNSTERPFPCPDCPKRFADQARLTSHRRAHASERPFRCAQCGRSFSLKISLLLHQRGHAQERPFSCPQCGIDFNGHSALIRHQMIHTGERPYPCTDCSKSFMRKEHLLNHRRLHTGERPFSCPHCGKSFIRKHHLMKHQRIHTGERPYPCSYCGRSFRYKQTLKDHLRSGHNGGCGGDSDPSGQPPNPPGPLITGLETSGLGVNTEGLETNQWYGEGSGGGVL

SEQ ID NO: 6728 - protein, 471 aa, Homo sapiens; identical to SEQ ID NO: 6727

SEQ ID NO: 6729 - protein, 471 aa, Homo sapiens; identical to SEQ ID NO: 6727

SEQ ID NO: 6730 - protein, 642 aa, Homo sapiens
MAEAAPAPTSEWDSECLTSLQPLPLPTPPAANEAHLQTAAISLWTVVAAVQAIERKVEIHSRRLLHLEGRTGTAEKKLASCEKTVTELGNQLEGKWAVLGTLLQEYGLLQRRLENLENLLRNRNFWILRLPPGIKGDIPKVPVAFDDVSIYFSTPEWEKLEEWQKELYKNIMKGNYESLISMDYAINQPDVLSQIQPEGEHNTEDQAGPEESEIPTDPSEEPGISTSDILSWIKQEEEPQVGAPPESKESDVYKSTYADEELVIKAEGLARSSLCPEVPVPFSSPPAAAKDAFSDVAFKSQQSTSMTPFGRPATDLPEASEGQVTFTQLGSYPLPPPVGEQVFSCHHCGKNLSQDMLLTHQCSHATEHPLPCAQCPKHFTPQADLSSTSQDHASETPPTCPHCARTFTHPSRLTYHLRVHNSTERPFPCPDCPKRFADQARLTSHRRAHASERPFRCAQCGRSFSLKISLLLHQRGHAQERPFSCPQCGIDFNGHSALIRHQMIHTGERPYPCTDCSKSFMRKEHLLNHRRLHTGERPFSCPHCGKSFIRKHHLMKHQRIHTGERPYPCSYCGRSFRYKQTLKDHLRSGHNGGCGGDSDPSGQPPNPPGPLITGLETSGLGVNTEGLETNQWYGEGSGGGVL

SEQ ID NO: 6731 - protein, 471 aa, Homo sapiens; identical to SEQ ID NO: 6727

SEQ ID NO: 6732 - protein, 471 aa, Homo sapiens; identical to SEQ ID NO: 6727

SEQ ID NO: 6733 - protein, 647 aa, Homo sapiens
MIGLIQGRRLAEQTSEWDSECLTSLQPLPLPTPPAANEAHLQTAAISLWTVVAAVQAIERKVEIHSRRLLHLEGRTGTAEKKLASCEKTVTELGNQLEGKWAVLGTLLQEYGLLQRRLENLENLLRNRNFWILRLPPGIKGDIPKVPVAFDDVSIYFSTPEWEKLEEWQKELYKNIMKGNYESLISMDYAINQPDVLSQIQPEGEHNTEDQAGPEESEIPTDPSEEPGISTSDILSWIKQEEEPQVGAPPESKESDVYKSTYADEELVIKAEGLARSSLCPEVPVPFSSPPAAAKDAFSDVAFKSQQSTSMTPFGRPATDLPEASEGQVTFTQLGSYPLPPPVGEQVFSCHHCGKNLSQDMLLTHQCSHATEHPLPCAQCPKHFTPQADLSSTSQDHASETPPTCPHCARTFTHPSRLTYHLRVHNSTERPFPCPDCPKRFADQARLTSHRRAHASERPFRCAQCGRSFSLKISLLLHQRGHAQERPFSCPQCGIDFNGHSALIRHQMIHTGERPYPCTDCSKSFMRKEHLLNHRRLHTGERPFSCPHCGKSFIRKHHLMKHQRIHTGERPYPCSYCGRSFRYKQTLKDHLRSGHNGGCGGDSDPSGQPPNPPGPLITGLETSGLGVNTEGLETNQWYGEGSGGGVL

SEQ ID NO: 6734 - protein, 2248 aa, Homo sapiens
MMDSENKPENDEDEKINKEAQDLTKLSSHNEDGGPVSDVIASFPENSMGKRGFSESSNSDSVVIGEDRNKHASKRRKLDEAEPLKSGKQGICRLETSESSVTEGGIALDETGKETFLSDCTVGGTCLPNALSPSCNFSTIDVVSLKTDTEKTSAQEMVSLDLERESPFPPKEISVSCTIGNVDTVLKCSICGHLFSSCSDLEKHAESHMQQPKEHTCCHCSHKAESSSALHMHIKQAHGPQKVFSCDLCGFQCSEENLLNAHYLGKTHLRRQNLAARGGFVQILTKQPFPKKSRTMATKNVHSKPRTSKSIAKNSDSKGLRNVGSTFKDFRGSISKQSGSSSELLVEMMPSRNTLSQEVEIVEEHVTSLGLAQNPENQSRKLDTLVTSEGLLEKLESTKNTLQAAHGNSVTSRPRPERNILVLGNSFRRRSSTFTLKGQAKKRFNLLGIKRGTSETQRMYMKHLRTQMKTHDAESVLKHLEACSSVQRVCVTTSETQEAEQGQGSARPPDSGLHSLTVKPASGSQTLCACTDCGQVATNRTDLEIHVKRCHAREMKFYCRTCDFSSMSRRDLDEHLHSNQHQQTASVLSCQCCSFISLDEINLRDHMKEKHNMHFLCTPCNLFFLSEKDVEEHKATEKHINSLVQPKTLQSSNSDLVLQTLPLSTLESENAKESMDDSGKASQEEPLKSRVSHGNEVRHSSKPQFQCKKCFYKTRSSTVLTRHIKLRHGQDYHFLCKACNLYSLSKEGMEKHIKRSKHLENAKKNNIGLSFEECIERVCIGANDKKEEFDVSGNGRIEGHIGVQLQEHSYLEKGMLASEELSQSGGSTKDDELASTTTPKRGRPKGNISRTCSHCGLLASSITNLTVHIRRKHSHQYSYLCKVCKYYTVTKGDMERHCATKKHKGRVEIEASGKHSSDIIVGPEGGSLEAGKKNAGSAVTMSDEHANKPAESPTSVLEKPDRGNSIEAEVENVFHSLDGEVNSHLLDKKEQISSEPEDFAQPGDVYSQRDVTGTGENKCLHCEFSAHSSASLELHVKRKHTKEFEFYCMACDYYAVTRREMTRHAATEKHKMKRQSYLNSANVEAGSADMSKNIIMPEEEHQQNSEEFQIISGQPSDTLKSRNAADCSILNENTNLDMSKVLCAADSVEVETEEESNFNEDHSFCETFQQAPVKDKVRKPEEMMSLTMSSNYGSPSRFQNENSGSSALNCETAKKNHEISNDAGELRVHCEGEGGNAGDGGGVVPHRHLCPVTLDGERSAESPVLVVTRITREQGNLESGGQNRVARGHGLEDLKGVQEDPVLGNKEILMNSQHETEFILEEDGPASDSTVESSDVYETIISIDDKGQAMYSFGRFDSSIIRIKNPEDGELIDQSEEGLIATGVRISELPLKDCAQGVKKKKSEGSSIGESTRIRCDDCGFLADGLSGLNVHIAMKHPTKEKHFHCLLCGKSFYTESNLHQHLASAGHMRNEQASVEELPEGGATFKCVKCTEPFDSEQNLFLHIKGQHEELLREVNKYIVEDTEQINREREENQGNVCKYCGKMCRSSNSMAFLAHIRTHTGSKPFKCKICHFATAQLGDARNHVKRHLGMREYKCHVCGVAFVMKKHLNTHLLGKHGVGTPKERKFTCHLCDRSFTEKWALNNHMKLHTGEKPFKCTWPTCHYSFLTASAMKDHYRTHTGEKSFLCDLCGFAGGTRHALTKHRRQHTGEKPFKCDECNFASTTQSHLTRHKRVHTGEKPYRCPWCDYRSNCAENIRKHILHTGKHEGVKMYNCPKCDYGTNVPVEFRNHLKEQHPDIENPDLAYLHAGIVSKSYECRLKGQGATFVETDSPFTAAALAEEPLVKEKPLRSSRRPAPPPEQVQQVIIFQGYDGEFALDPSVEETAAATLQTLAMAGQVARVVHITEDGQVIATSQSGAHVGSVVPGPILPEQLADGATQVVVVGGSMEGHGMDESLSPGGAVIQQVTKQEILNLSEAGVAPPEASSALDALLCAVTELGEVEGRAGLEEQGRPGAKDVLIQLPGQEVSHVAADPEAPEIQMFPQAQESPAAVEVLTQVVHPSAAMASQERAQVAFKKMVQGVLQFAVCDTAAAGQLVKDGVTQVVVSEEGAVHMVAGEGAQIIMQEAQGEHMDLVESDGEISQIIVTEELVQAMVQESSGGFSEGTTHYILTELPPGVQDEPGLYSHTVLETADSQELLQAGATLGTEAGAPSRAEQLASVVIYTQEGSSAAAAIQSQRESSELQEA

SEQ ID NO: 6735 - protein, 1660 aa, Homo sapiens
MMDSENKPENDEDEKINKEAQDLTKLSSHNEDGGPVSDVIASFPENSMGKRGFSESSNSDSVVIGEDRNKHASKRRKLDEAEPLKSGKQGICRLETSESSVTEGGIALDETGKETFLSDCTVGGTCLPNALSPSCNFSTIDVVSLKTDTEKTSAQEMVSLDLERESPFPPKEISVSCTIGNVDTVLKCSICGHLFSSCSDLEKHAESHMQQPKEHTCCHCSHKAESSSALHMHIKQAHGPQKVFSCDLCGFQCSEENLLNAHYLGKTHLRRQNLAARGGFVQILTKQPFPKKSRTMATKNVHSKPRTSKSIAKNSDSKGLRNVGSTFKDFRGSISKQSGSSSELLVEMMPSRNTLSQEVEIVEEHVTSLGLAQNPENQSRKLDTLVTSEGLLEKLESTKNTLQAAHGNSVTSRPRPERNILVLGNSFRRRSSTFTLKGQAKKRFNLLGIKRGTSETQRMYMKHLRTQMKTHDAESVLKHLEACSSVQRVCVTTSETQEAEQGQGSARPPDSGLHSLTVKPASGSQTLCACTDCGQVATNRTDLEIHVKRCHAREMKFYCRTCDFSSMSRRDLDEHLHSNQHQQTASVLSCQCCSFISLDEINLRDHMKEKHNMHFLCTPCNLFFLSEKDVEEHKATEKHINSLVQPKTLQSSNSDLVLQTLPLSTLESENAKESMDDSGKASQEEPLKSRVSHGNEVRHSSKPQFQCKKCFYKTRSSTVLTRHIKLRHGQDYHFLCKACNLYSLSKEGMEKHIKRSKHLENAKKNNIGLSFEECIERVCIGANDKKEEFDVSGNGRIEGHIGVQLQEHSYLEKGMLASEELSQSGGSTKDDELASTTTPKRGRPKGNISRTCSHCGLLASSITNLTVHIRRKHSHQYSYLCKVCKYYTVTKGDMERHCATKKHKGRVEIEASGKHSSDIIVGPEGGSLEAGKKNAGSAVTMSDEHANKPAESPTSVLEKPDRGNSIEAEVENVFHSLDGEVNSHLLDKKEQISSEPEDFAQPGDVYSQRDVTGTGENKCLHCEFSAHSSASLELHVKRKHTKEFEFYCMACDYYAVTRREMTRHAATEKHKMKRQSYLNSANVEAGSADMSKNIIMPEEEHQQNSEEFQIISGQPSDTLKSRNAADCSILNENTNLDMSKVLCAADSVEVETEEESNFNEDHSFCETFQQAPVKDKVRKPEEMMSLTMSSNYGSPSRFQNENSGSSALNCETAKKNHEISNDAGELRVHCEGEGGNAGDGGGVVPHRHLCPVTLDGERSAESPVLVVTRITREQGNLESGGQNRVARGHGLEDLKGVQEDPVLGNKEILMNSQHETEFILEEDGPASDSTVESSDVYETIISIDDKGQAMYSFGRFDSSIIRIKNPEDGELIDQSEEGLIATGVRISELPLKDCAQGVKKKKSEGSSIGESTRIRCDDCGFLADGLSGLNVHIAMKHPTKEKHFHCLLCGKSFYTESNLHQHLASAGHMRNEQASVEELPEGGATFKCVKCTEPFDSEQNLFLHIKGQHEELLREVNKYIVEDTEQINREREENQGNVCKYCGKMCRSSNSMAFLAHIRTHTGSKPFKCKICHFATAQLGDARNHVKRHLGMREYKCHVCGVAFVMKKHLNTHLLGKHGVGTPKERVKVAYRKIGTLPGIQNNRNASSASEAQSLCEHFS

SEQ ID NO: 6736 - protein, 1815 aa, Homo sapiens
MMDSENKPENDEDEKINKEAQDLTKLSSHNEDGGPVSDVIASFPENSMGKRGFSESSNSDSVVIGEDRNKHASKRRKLDEAEPLKSGKQGICRLETSESSVTEGGIALDETGKETFLSDCTVGGTCLPNALSPSCNFSTIDVVSLKTDTEKTSAQEMVSLDLERESPFPPKEISVSCTIGNVDTVLKCSICGHLFSSCSDLEKHAESHMQQPKEHTCCHCSHKAESSSALHMHIKQAHGPQKVFSCDLCGFQCSEENLLNAHYLGKTHLRRQNLAARGGFVQILTKQPFPKKSRTMATKNVHSKPRTSKSIAKNSDSKGLRNVGSTFKDFRGSISKQSGSSSELLVEMMPSRNTLSQEVEIVEEHVTSLGLAQNPENQSRKLDTLVTSEGLLEKLESTKNTLQAAHGNSVTSRPRPERNILVLGNSFRRRSSTFTLKGQAKKRFNLLGIKRGTSETQRMYMKHLRTQMKTHDAESVLKHLEACSSVQRVCVTTSETQEAEQGQGSARPPDSGLHSLTVKPASGSQTLCACTDCGQVATNRTDLEIHVKRCHAREMKFYCRTCDFSSMSRRDLDEHLHSNQHQQTASVLSCQCCSFISLDEINLRDHMKEKHNMHFLCTPCNLFFLSEKDVEEHKATEKHINSLVQPKTLQSSNSDLVLQTLPLSTLESENAKESMDDSGKASQEEPLKSRVSHGNEVRHSSKPQFQCKKCFYKTRSSTVLTRHIKLRHGQDYHFLCKACNLYSLSKEGMEKHIKRSKHLENAKKNNIGLSFEECIERVCIGANDKKEEFDVSGNGRIEGHIGVQLQEHSYLEKGMLASEELSQSGGSTKDDELASTTTPKRGRPKGNISRTCSHCGLLASSITNLTVHIRRKHSHQYSYLCKVCKYYTVTKGDMERHCATKKHKGRVEIEASGKHSSDIIVGPEGGSLEAGKKNAGSAVTMSDEHANKPAESPTSVLEKPDRGNSIEAEVENVFHSLDGEVNSHLLDKKEQISSEPEDFAQPGDVYSQRDVTGTGENKCLHCEFSAHSSASLELHVKRKHTKEFEFYCMACDYYAVTRREMTRHAATEKHKMKRQSYLNSANVEAGSADMSKNIIMPEEEHQQNSEEFQIISGQPSDTLKSRNAADCSILNENTNLDMSKVLCAADSVEVETEEESNFNEDHSFCETFQQAPVKDKVRKPEEMMSLTMSSNYGSPSRFQNENSGSSALNCETAKKNHEISNDAGELRVHCEGEGGNAGDGGGVVPHRHLCPVTLDGERSAESPVLVVTRITREQGNLESGGQNRVARGHGLEDLKGVQEDPVLGNKEILMNSQHETEFILEEDGPASDSTVESSDVYETIISIDDKGQAMYSFGRFDSSIIRIKNPEDGELIDQSEEGLIATGVRISELPLKDCAQGVKKKKSEGSSIGESTRIRCDDCGFLADGLSGLNVHIAMKHPTKEKHFHCLLCGKSFYTESNLHQHLASAGHMRNEQASVEELPEGGATFKCVKCTEPFDSEQNLFLHIKGQHEELLREVNKYIVEDTEQINREREENQGNVCKYCGKMCRSSNSMAFLAHIRTHTGSKPFKCKICHFATAQLGDARNHVKRHLGMREYKCHVCGVAFVMKKHLNTHLLGKHGVGTPKERKFTCHLCDRSFTEKWALNNHMKLHTGEKPFKCTWPTCHYSFLTASAMKDHYRTHTGEKSFLCDLCGFAGGTRHALTKHRRQHTGEKPFKCDECNFASTTQSHLTRHKRVHTGEKPYRCPWCDYRSNCAENIRKHILHTGKHEGVKMYNCPKCDYGTNVPVEFRNHLKEQHPDIENPDLAYLHAGKGQKL

SEQ ID NO: 6737 - protein, 1660 aa, Homo sapiens; identical to SEQ ID NO: 6735

SEQ ID NO: 6738 - protein, 720 aa, Homo sapiens
MEEAEELLLEGKKALQLAREPRLGLDLGWNPSGEGCTQGLKDVPPEPTRDILALKSLPRGLALGPSLAKEQRLGVWCVGDPLQPGLLWGPLEEESASKEKGEGVKPRQEENLSLGPWGDVCACEQSSGWTSLVQRGRLESEGNVAPVRISERLHLQVYQLVLPGSELLLWPQPSSEGPSLTQPGLDKEAAVAVVTEVESAVQQEVASPGEDAAEPCIDPGSQSPSGIQAENMVSPGLKFPTQDRISKDSQPLGPLLQDGDVDEECPAQAQMPPELQSNSATQQDPDGSGASFSSSARGTQPHGYLAKKLHSPSDQCPPRAKTPEPGAQQSGFPTLSRSPPGPAGSSPKQGRRYRCGECGKAFLQLCHLKKHAFVHTGHKPFLCTECGKSYSSEESFKAHMLGHRGVRPFPCPQCDKAYGTQRDLKEHQVVHSGARPFACDQCGKAFARRPSLRLHRKTHQVPAAPAPCPCPVCGRPLANQGSLRNHMRLHTGEKPFLCPHCGRAFRQRGNLRGHLRLHTGERPYRCPHCADAFPQLPELRRHLISHTGEAHLCPVCGKALRDPHTLRAHERLHSGERPFPCPQCGRAYTLATKLRRHLKSHLEDKPYRCPTCGMGYTLPQSLRRHQLSHRPEAPCSPPSVPSAASEPTVVLLQAEPQLLDTHREEEVSPARDVVEVTISESQEKCFVVPEEPDAAPSLVLIHKDMGLGAWAEVVEVEMGT

SEQ ID NO: 6739 - protein, 198 aa, Homo sapiens
MEKPAGRKKKTPTPREEADVQKSALREEKVSGDRKPPERPTVPRKPRTEPCLSPEDEEHVFDAFDASFKDDFEGVPVFIPFQRKKPYECSECGRIFKHKTDHIRHQRVHTGEKPFKCAQCGKAFRHSSDVTKHQRTHTGEKPFKCGECGKAFNCGSNLLKHQKTHTGEKPYECTHCGKAFAYSSCLIRHQKRHPRKKP

SEQ ID NO: 6740 - protein, 198 aa, Homo sapiens; identical to SEQ ID NO: 6739

SEQ ID NO: 6741 - protein, 198 aa, Homo sapiens; identical to SEQ ID NO: 6739

SEQ ID NO: 6742 - protein, 431 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTEVLAEGSPRSLSSVPDVTHHLVTMQSGRQSYEVSVLTAVNPQELLNQGDLTERRT

SEQ ID NO: 6743 - protein, 425 aa, Homo sapiens
MLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 6744 - protein, 516 aa, Homo sapiens
MLSDELESKPELLVQFVQNTSIPLGQGLVESEAKDITCLSLLPVTEASECSRLMLPEPVPWREEDGKSGCSDLNDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQESLAPLPRLECSGAFSAHCNLCLPGSSDSPASAS

SEQ ID NO: 6745 - protein, 467 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 6746 - protein, 405 aa, Homo sapiens
MLSDELESKPELLVQFVQNTSIPLGQGLVESEAKDITCLSLLPVTEASECSRLMLPGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 6747 - protein, 70 aa, Homo sapiens
MLSDELESKPELLVQFVQNTSIPLGQGLVESEAKDITCLSLLPVTEASECSRLMLPDDTTNHSNSSKEVP

SEQ ID NO: 6748 - protein, 478 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 6749 - protein, 74 aa, Homo sapiens
MLSDELESKPELLVQFVQNTSIPLGQGLVESEAKDITCLSLLPVTEASECSRLMLPDDTTNHSNSSKEVPSSAV

SEQ ID NO: 6750 - protein, 126 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNL

SEQ ID NO: 6751 - protein, 272 aa, Homo sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRRLWEKLLCAAEAEGAHEDPQWREALYVP

SEQ ID NO: 6752 - protein, 312 aa, Homo sapiens
MEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGACR

SEQ ID NO: 6753 - protein, 390 aa, Homo sapiens
MEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGHAAPSRIVWEHTRGRYSCMQCAFSTASRPAMTLHLEDHRPGAPAAPAAGPPRPDAPADPAPLAPKVSPLLSEGELPVFSQL

SEQ ID NO: 6754 - protein, 594 aa, Homo sapiens
MAAAVLRDSTSVPVTAEAKLMGFTQGCVTFEDVAIYFSQEEWGLLDEAQRLLYRDVMLENFALITALVCWHGMEDEETPEQSVSVEGVPQVRTPEASPSTQKIQSCDMCVPFLTDILHLTDLPGQELYLTGACAVFHQDQKHHSAEKPLESDMDKASFVQCCLFHESGMPFTSSEVGKDFLAPLGILQPQAIANYEKPNKISKCEEAFHVGISHYKWSQCRRESSHKHTFFHPRVCTGKRLYESSKCGKACCCECSLVQLQRVHPGERPYECSECGKSFSQTSHLNDHRRIHTGERPYVCGQCGKSFSQRATLIKHHRVHTGERPYECGECGKSFSQSSNLIEHCRIHTGERPYECDECGKAFGSKSTLVRHQRTHTGEKPYECGECGKLFRQSFSLVVHQRIHTTARPYECGQCGKSFSLKCGLIQHQLIHSGARPFECDECGKSFSQRTTLNKHHKVHTAERPYVCGECGKAFMFKSKLVRHQRTHTGERPFECSECGKFFRQSYTLVEHQKIHTGLRPYDCGQCGKSFIQKSSLIQHQVVHTGERPYECGKCGKSFTQHSGLILHRKSHTVERPRDSSKCGKPYSPRSNIV

SEQ ID NO: 6755 - protein, 477 aa, Homo sapiens
MAAAVLRDSTSGCVTFEDVAIYFSQEEWGLLDEAQRLLYRDVMLENFALITALVCWHGMEDEETPEQSVSVEGVPQVRTPEASPSTQKIQSCDMCVPFLTDILHLTDLPGQELYLTGACAVFHQDQKHHSAEKPLESDMDKASFVQCCLFHESGMPFTSSEVGKDFLAPLGILQPQAIANYEKPNKISKCEEAFHVGISHYKWSQCRRESSHKHTFFHPRVCTGKRLYESSKCGKACCCECSLVQLQRVHPGERPYECSECGKSFSQTSHLNDHRRIHTGERPYYECGECGKSFSQSSNLIEHCRIHTGERPYECDECGKAFGSKSTLVRHQRTHTGEKPYECGECGKLFRQSFSLVVHQRIHTTARPYECGQCGKSFSLKSKLVRHQRTHTGERPFECSECGKFFRQSYTLVEHQKIHTGLRPYDCGQCGKSFIQKSSLIQHQVVHTGERPYECGKCGKSFTQHSGLILHRKSHTV

SEQ ID NO: 6756 - protein, 472 aa, Homo sapiens
MGFTQGCVTFEDVAIYFSQEEWGLLDEAQRLLYRDVMLENFALITALVCWHGMEDEETPEQSVSVEGVPQVRTPEASPSTQKIQSCDMCVPFLTDILHLTDLPGQELYLTGACAVFHQDQKHHSAEKPLESDMDKASFVQCCLFHESGMPFTSSEVGKDFLAPLGILQPQAIANYEKPNKISKCEEAFHVGISHYKWSQCRRESSHKHTFFHPRVCTGKRLYESSKCGKACCCECSLVQLQRVHPGERPYECSECGKSFSQTSHLNDHRRIHTGERPYPYECGECGKLFRQSFSLVVHQRIHTTARPYECGQCGKSFSLKCGLIQHQLIHSGARPFECDECGKSFSQRTTLNKHHKVHTAERPYVCGECGKAFMFKSKLVRHQRTHTGERPFECSECGKFFRQSYTLVEHQKIHTGLRPYDCGQCGKSFIQKSSLIQHQVVHTGERPYECGKCGKSFTQHSGLILHRKSHTV

SEQ ID NO: 6757 - protein, 575 aa, Homo sapiens
MAAAAPRRPTQQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEAAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGKTAYPCEECGKSFSQKGSLISHQRVHTGERPYECREYGKSFGQKGNLIQHQQGHTGERAYHCGECGKSFRQKFCFINHQRVHTGERPYKCGECGKSFGQKGNLVQHQRGHTGERPYECKECGKSFRYRSHLTEHQRLHTGERPYNCRECGKLFNRKYHLLVHERVHTGERPYACEVCGKLFGNKNCVTIHQRIHTGERPYECNECGKSFLSSSALHVHKRVHSGQKPYKCSECGKSFAECSSLIKHRRIHTGERPYECTKCGKTFQRSSTLLHHQSSHRRKAL

SEQ ID NO: 6758 - protein, 376 aa, Homo sapiens
MHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGKTAYPCEECGKSFSQKGSLISHQRVHTGERPYECREYGKSFGQKGNLIQHQQGHTGERAYHCGECGKSFRQKFCFINHQRVHTGERPYKCGECGKSFGQKGNLVQHQRGHTGERPYECKECGKSFRYRSHLTEHQRLHTGERPYNCRECGKLFNRKYHLLVHERVHTGERPYACEVCGKLFGNKNCVTIHQRIHTGERPYECNECGKSFLSSSALHVHKRVHSGQKPYKCSECGKSFAECSSLIKHRRIHTGERPYECTKCGKTFQRSSTLLHHQSSHRRKAL

SEQ ID NO: 6759 - protein, 676 aa, Homo sapiens
MQGTVAFEDVAVNFSQEEWSLLSEVQRCLYHDVMLENWVLISSLGCWCGSEDEEAPSKKSISIQRVSQVSTPGAGVSPKKAHSCEMCGAILGDILHLADHQGTHHKQKLHRCEAWGNKLYDSSNRPHQNQYLGEKPYRSSVEEALFVKRCKFHVSEESSIFIQSGKDFLPSSGLLLQEATHTGEKSNSKPECESPFQWGDTHYSCGECMKHSSTKHVFVQQQRLPSREECYCWECGKSFSKYDSVSNHQRVHTGKRPYECGECGKSFSHKGSLVQHQRVHTGKRPYECGECGKSFSHKGSLVQHQRVHTGERPYECGECGKSFSQNGTLIKHQRVHTGERPYECEECGKCFTQKGNLIQHQRGHTSERPYECEECGKCFSQKGTLTEHHRVHTRERPYECGECGKSFSRKGHLRNHQRGHTGERPYECGECGKSFSRKGNLIQHQRSHTGERPYECRECRKLFRGKSHLIEHQRVHTGERPYECNECGKSFQDSSGFRVHQRVHTGEKPFECSECGKSFPQSCSLLRHRRVHTGERPYECGECGKSFHQSSSLLRHQKTHTAERPYECRECGKFFSSLLEHRRVHTGERPYECRECGKTFTRRSAHFKHQRLHTRGKPYECSECGKSFAETFSLTEHRRVHTGERPYECSECGKSFHRSSSLLRHQRVHTERSPYK

SEQ ID NO: 6760 - protein, 697 aa, Homo sapiens
MQEGLHRMTWDCIAIGSHENSVQGTVAFEDVAVNFSQEEWSLLSEVQRCLYHDVMLENWVLISSLGCWCGSEDEEAPSKKSISIQRVSQVSTPGAGVSPKKAHSCEMCGAILGDILHLADHQGTHHKQKLHRCEAWGNKLYDSSNRPHQNQYLGEKPYRSSVEEALFVKRCKFHVSEESSIFIQSGKDFLPSSGLLLQEATHTGEKSNSKPECESPFQWGDTHYSCGECMKHSSTKHVFVQQQRLPSREECYCWECGKSFSKYDSVSNHQRVHTGKRPYECGECGKSFSHKGSLVQHQRVHTGKRPYECGECGKSFSHKGSLVQHQRVHTGERPYECGECGKSFSQNGTLIKHQRVHTGERPYECEECGKCFTQKGNLIQHQRGHTSERPYECEECGKCFSQKGTLTEHHRVHTRERPYECGECGKSFSRKGHLRNHQRGHTGERPYECGECGKSFSRKGNLIQHQRSHTGERPYECRECRKLFRGKSHLIEHQRVHTGERPYECNECGKSFQDSSGFRVHQRVHTGEKPFECSECGKSFPQSCSLLRHRRVHTGERPYECGECGKSFHQSSSLLRHQKTHTAERPYECRECGKFFSSLLEHRRVHTGERPYECRECGKTFTRRSAHFKHQRLHTRGKPYECSECGKSFAETFSLTEHRRVHTGERPYECSECGKSFHRSSSLLRHQRVHTERSPYK

SEQ ID NO: 6761 - protein, 642 aa, Homo sapiens
MAAAALRLPAQVVGVDQKMRRHLLRRAFLYKECLRSALLGQVSPKKAHSCEMCGAILGDILHLADHQGTHHKQKLHRCEAWGNKLYDSSNRPHQNQYLGEKPYRSSVEEALFVKRCKFHVSEESSIFIQSGKDFLPSSGLLLQEATHTGEKSNSKPECESPFQWGDTHYSCGECMKHSSTKHVFVQQQRLPSREECYCWECGKSFSKYDSVSNHQRVHTGKRPYECGECGKSFSHKGSLVQHQRVHTGKRPYECGECGKSFSHKGSLVQHQRVHTGERPYECGECGKSFSQNGTLIKHQRVHTGERPYECEECGKCFTQKGNLIQHQRGHTSERPYECEECGKCFSQKGTLTEHHRVHTRERPYECGECGKSFSRKGHLRNHQRGHTGERPYECGECGKSFSRKGNLIQHQRSHTGERPYECRECRKLFRGKSHLIEHQRVHTGERPYECNECGKSFQDSSGFRVHQRVHTGEKPFECSECGKSFPQSCSLLRHRRVHTGERPYECGECGKSFHQSSSLLRHQKTHTAERPYECRECGKFFSSLLEHRRVHTGERPYECRECGKTFTRRSAHFKHQRLHTRGKPYECSECGKSFAETFSLTEHRRVHTGERPYECSECGKSFHRSSSLLRHQRVHTERSPYK

SEQ ID NO: 6762 - protein, 510 aa, Homo sapiens
MAAAALRDPAQVPVAADLLTDHEEGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 6763 - protein, 429 aa, Homo sapiens
DPVQGYVTFEDVAVYFSQEEWRLLDDAQRLLYRNVMLENFTLLASLGKHPELGSAFPPFPRERSLAVSLMDLIPGGLSVQLSHQCDCCLTVLFLVLHVSPSHQQNPSAVAFTECVVVGMERLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKP

SEQ ID NO: 6764 - protein, 478 aa, Homo sapiens
MAAAALRDPAQVPVAADLLTDHEEQGYVTFEDVAVYFSQEEWRLLDDAQRLLYRNVMLENFTLLASLGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 6765 - protein, 442 aa, Homo sapiens
MAAAALRDPAQQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSSLVKHQRVHTGAKPYECRECGKFFRHNSSLFKHRRIHTGEMQ

SEQ ID NO: 6766 - protein, 464 aa, Homo sapiens
MAAAALRDPAQGYVTFEDVAVYFSQEEWRLLDDAQRLLYRNVMLENFTLLASLGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 6767 - protein, 511 aa, Homo sapiens
MAAAALRDPAQVPVAADLLTDHEEQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 6768 - protein, 498 aa, Homo sapiens
MAAAALRDPAQQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 6769 - protein, 158 aa, Homo sapiens
MAAAALRDPAQVPVAADLLTDHEEGYVTFEDVAVYFSQEEWRLLDDAQRLLYRNVMLENFTLLASLGCWHGAEAEEAPEQIASVGLLEVLAKQGGCSGKKTYECSECGKLFRDMSNLFIHQIVHTGERPYGCSNCGKSFSRNAHLIEHQRVHTGEKPF

SEQ ID NO: 6770 - protein, 497 aa, Homo sapiens
MAAAALRDPAQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 6771 - protein, 444 aa, Homo sapiens
MAAAALRDPAQVPVAADLLTDHEEQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLM

SEQ ID NO: 6772 - protein, 121 aa, Homo sapiens
MAAAALRDPAQQGYVTFEDVAVYFSQEEWRLLDDAQRLLYRNVMLENFTLLASLGCWHGAEAEEAPEQIASVGLLSSNIQQHQKQHCGEKPLKRQEGRVPVLRSCKVHLSEKSLQSREVGK

SEQ ID NO: 6773 - protein, 135 aa, Homo sapiens
MAAAALRDPAQQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVL

SEQ ID NO: 6774 - protein, 536 aa, Homo sapiens
MARKLVMFRDVAIDFSQEEWECLDSAQRDLYRDVMLENYSNLVSLDLPSRCASKDLSPEKNTYETELSQWEMSDRLENCDLEESNSRDYLEAKGKMEKQQENQKEYFRQGMIIYDKMSIFNQHTYLSQHSRCHSTEKPYKCKECGKAFRRASHLTQHQSIHTGEKPYECKQCGKAFSRDSQLSLHQRLHTGEKPYACKECGKAFTQSSQLILHHRIHTGEKPYKCEECGKAFIRSSQLTRHQKVHTGEKPYECKECGKAFTQNSQLTLHQRLHTGEKLYECKECRKVFTQLSQLILHKRIHTGEKPYECKECGKAFICGSQLSQHQKIHNGEKPYECKECGRAFIRGSLLMQHQRIHTGEKPYKCEECGKAFIRGSQLTQHQRIHTNEKPYECKECGKMFSHGSQLTQHQRIHTGEKPYQCKECGKAFNRGSLLTRHQRIHTGEKPYECKECGKTFSRGSELTQHERIHTAFLAGQQDRSDIYMSRRFTKSIFPVFFSVPTMWTSKLELRYSHGDFENGIWVLWIMEQKYRRSLQP

SEQ ID NO: 6775 - protein, 688 aa, Homo sapiens
MARKLVMFRDVAIDFSQEEWECLDSAQRDLYRDVMLENYSNLVSLDLPSRCASKDLSPEKNTYETELSQWEMSDRLENCDLEESNSRDYLEAKGKMEKQQENQKEYFRQGMIIYDKMSIFNQHTYLSQHSRCHSTEKPYKCKECGKAFRRASHLTQHQSIHTGEKPYECKQCGKAFSRDSQLSLHQRLHTGEKPYACKECGKAFTQSSQLILHHRIHTGEKPYKCEECGKAFIRSSQLTRHQKVHTGEKPYECKECGKAFTQNSQLTLHQRLHTGEKLYECKECRKVFTQLSQLILHKRIHTGEKPYECKECGKAFICGSQLSQHQKIHNGEKPYECKECGRAFIRGSLLMQHQRIHTGEKPYKCEECGKAFIRGSQLTQHQRIHTNEKPYECKECGKMFSHGSQLTQHQRIHTGEKPYQCKECGKAFNRGSLLTRHQRIHTGEKPYECKECGKTFSRGSELTQHERIHTGEKPYECKECGKSFIRGSQLTQHQRIHTGEKPYECKECRMAFTQSSHLSQHQRLHTGEKPYVCNECGKAFARGLLLIQHQRIHTGEKPYQCKECGKAFIRGSQLTQHQRIHTGEKPYECKECGKAFSHGSQLTLHQRIHTGEKPYECRECRKAFTQSSHLSRHQRIHTGEKPYQCKECGKAFTRGSQLTQHQRIHISEKSFEYKECGIDFSHGSQVYM

SEQ ID NO: 6776 - protein, 554 aa, Homo sapiens
MAAADLSHGHYLSGDPVCLHEEKTPAGRIVADCLTDCYQDSVTFDDVAVDFTQEEWTLLDSTQRSLYSDVMLENYKNLATVGGQIIKPSLISWLEQEESRTVQGGVLQGWEMRLETQWSILQQDFLRGQTSIGIQLEGKHNGRELCDCEQCGEVFSEHSCLKTHVRTQSTGNTHDCNQYGKDFLTLCEKTSTGEKLSEFNQSEKIFSLTPNIVYQRTSTQEKSFECSHCGKSFINESYLQAHMRTHNGEKLYEWRNYGPGFIDSTSLSVLIETLNAKKPYKCKECGKGYRYPAYLSIHMRTHTGEKPYECKECGKAFNYSNSFQIHGRTHTGEKPYVCKECGKAFTQYSGLSMHVRSHSGDKPYECKECGKSFLTSSRLIQHIRTHTGEKPFVCVECGKAFAVSSNLSGHLRTHTEEKACECKICGKVFGYPSCLNNHMRTHSAQKPYTCKECGKAFNYSTHLKIHMRIHTGEKPYECKQCGKAFSHSSSFQIHERTHTGEKPYECKECGKAFTCSSSFRIHEKTHTEEKPYKCQQCGKAYSHPRSLRRHEQIH

SEQ ID NO: 6777 - protein, 554 aa, Homo sapiens; identical to SEQ ID NO: 6776

SEQ ID NO: 6778 - protein, 541 aa, Homo sapiens
SDGDINERRVLTRSHLAGWQLLICPMDSVTFDDVAVDFTQEEWTLLDSTQRSLYSDVMLENYKNLATVGGQIIKPSLISWLEQEESRTVQGGVLQGWEMRLETQWSILQQDFLRGQTSIGIQLEGKHNGRELCDCEQCGEVFSEHSCLKTHVRTQSTGNTHDCNQYGKDFLTLCEKTSTGEKLSEFNQSEKIFSLTPNIVYQRTSTQEKSFECSHCGKSFINESYLQAHMRTHNGEKLYEWRNYGPGFIDSTSLSVLIETLNAKKPYKCKECGKGYRYPAYLSIHMRTHTGEKPYECKECGKAFNYSNSFQIHGRTHTGEKPYVCKECGKAFTQYSGLSMHVRSHSGDKPYECKECGKSFLTSSRLIQHIRTHTGEKPFVCVECGKAFAVSSNLSGHLRTHTEEKACECKICGKVFGYPSCLNNHMRTHSAQKPYTCKECGKAFNYSTHLKIHMRIHTGEKPYECKQCGKAFSHSSSFQIHERTHTGEKPYECKECGKAFTCSSSFRIHEKTHTEEKPYKCQQCGKAYSHPRSLRRHEQIH

SEQ ID NO: 6779 - protein, 674 aa, Homo sapiens
MGPLTFTDVAIEFSLEEWQCLDTAQQNLYRNVMLENYRNLVFLGIAVSKPDLITCLEKEKEPCKMKRHEMVDEPPVVCSHFAEDFWPEQDIKDSFQKVTLRRYDKRGHENLQLRKGYKTVGDCKLYKGGYNGLNQCLTLTQSKMYHCDIYVKVFYAFSNADRYKTRHTGKKPFQCKKCGKSFCMLSQLTQHKKIHIRENTYRCKEFGNAFNQSSALTNHKRIYVGEKHYRCEECGKAFNHYSTLTNHKRIHTGEKPYKCKECGKAFSRYSTLTTHKRIHSGEKPYKCDECGKTFSISSTFTKHKIIHTEEKPYKCKECGKAFNRSSTLTSHKRIHTGEKPYKCEECGKAFNWSSTLTKHKVIHTGEKPYKCEECGKAFNQSSRLTRHKKIHTGEEPYKFEKCGRVFTCSSTLTQDKKIHTGEKPYNCEECGKVFTYSSTLTRHKRIHTEEKPYKCNECGKAFNRSSHLTSHRRIHTGEKPYKCEECGKAFKQSSNLNSHKKIHSGEKPYKCEECGKAFILSSRLTQHKKIHTGEKPYKCEECGKAFNRSSRLTQHKKIHTGEKPYKCKQCDKAFTHSSNLSSHKKIHSGEKPYKCEECGKAFNRSSRLTQHKKIHTREKPYKCEECAKAFTRSSRLTQHKKIHRMGVVAHACNPSTLGGRGGRITRSGDRDRPG

SEQ ID NO: 6780 - protein, 576 aa, Homo sapiens
MDDLKYGVYPLKEASGCPGAERNLLVYSYFEKETLTFRDVAIEFSLEEWECLNPAQQNLYMNVMLENYKNLVFLGVAVSKQDPVTCLEQEKEPWNMKRHEMVDEPPAMCSYFTKDLWPEQDIKDSFQQVILRRYGKCEHENLQLRKGSASVDEYKVHKEGYNELNQCLTTTQSKIFPCDKYVKVFHKFLNANRHKTRHTGKKPFKCKKCGKSFCMLLHLSQHKRIHIRENSYQCEECGKAFKWFSTLTRHKRIHTGEKPFKCEECGKAFKQSSTLTTHKIIHTGEKPYRCEECGKAFNRSSHLTTHKIIHTGEKPYKCEECGKAFNQSSTLSTHKFIHAGEKPYKCEECDKAFNRFSYLTKHKIIHTGEKSYKCEECGKGFNWSSTLTKHKRIHTGEKPYKCEVCGKAFNESSNLTTHKMIHTGEKPYKCEECGKAFNRSPQLTAHKIIHTGEKPYKCEECGKAFSQSSILTTHKRIHTGEKPYKCEECGKAFNRSSNLTKHKIIHTGEKSYKCEECGKAFNQSSTLTKHRKIHTRQKPYNCEECDNTFNQSSNLIKQNNSYWRETLQMSRMWESL

SEQ ID NO: 6781 - protein, 652 aa, Homo sapiens
MINAQELLTLEDVTVEFTWEEWQLLGPFQKDLYRDVMLEIYSNLLSMGYQVSKPDALSKLERGEEPWTMEDERHSRICPENNEVDDHLQDHLENQRMLKSVEQYHEHNAFGNTASQTKSLCLFRENHDTFELYIKTLKSNLSLVNQNKSCEINNSTKFSGDGKSFLHGNYEELYSAAKFSVSTKANSTKSQVSKHQRTHEIEKNHVCSECGKAFVKKSQLTDHERVHTGEKPYGCTLCAKVFSRKSRLNEHQRIHKREKSFICSECGKVFTMKSRLIEHQRTHTGEKPYICNECGKGFPGKRNLIVHQRNHTGEKSYICSECGKGFTGKSMLIIHQRTHTGEKPYICSECGKGFTTKHYVIIHQRNHTGEKPYICNECGKGFTMKSRMIEHQRTHTGEKPYICSECGKGFPRKSNLIVHQRNHTVEKSYLCSECGKGFTVKSMLIIHQRTHTGEKPYTCSECGKGFPLKSRLIVHQRTHTGEKPYRCSECGKGFIVNSGLMLHQRTHTGEKPYICNECGKGFAFKSNLVVHQRTHTGEKPFMCSECGKGFTMKRYLIVHQQIHTEEKSCICSECGRGFAKETELALHKQVHTGEKPYGCNECGKGFTMKSRLIVHQRTHTGEKPFVCSECRKAFSSKRNLIVHQRTHNGNKP

SEQ ID NO: 6782 - protein, 673 aa, Homo sapiens
MMFQDSVAFEDVAVTFTQEEWALLDPSQKNLCRDVMQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCLSSVQTHERAHSGRKLYVCEECGKTFISHSNLQRHRIMHRGDGPYKCKFCGKALMFLSLYLIHKRTHTGEKPYQCKQCGKAFSHSSSLRIHERTHTGEKPYKCNECGKAFHSSTCLHAHKRTHTGEKPYECKQCGKAFSSSHSFQIHERTHTGEKPYECKECGKAFKCPSSVRRHERTHSRKKPYECKHCGKVLSYLTSFQNHLGMHTGEISHKCKICGKAFYSPSSLQTHEKTHTGEKPYKCNQCGKAFNSSSSFRYHERTHTGEKPYECKQCGKAFRSASLLQTHGRTHTGEKPYACKECGKPFSNFSFFQIHERMHREEKPYECKGYGKTFSLPSLFHRHERTHTGGKTYECKQCGRSFNCSSSFRYHGRTHTGEKPYECKQCGKAFRSASQLQIHGRTHTGEKPYECKQCGKAFGSASHLQMHGRTHTGEKPYECKQCGKSFGCASRLQMHGRTHTGEKPYKCKQCGKAFGCPSNLRRHGRTHTGEKPYKCNQCGKVFRCSSQLQVHGRAHCIDTP

SEQ ID NO: 6783 - protein, 638 aa, Homo sapiens
MQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCLSSVQTHERAHSGRKLYVCEECGKTFISHSNLQRHRIMHRGDGPYKCKFCGKALMFLSLYLIHKRTHTGEKPYQCKQCGKAFSHSSSLRIHERTHTGEKPYKCNECGKAFHSSTCLHAHKRTHTGEKPYECKQCGKAFSSSHSFQIHERTHTGEKPYECKECGKAFKCPSSVRRHERTHSRKKPYECKHCGKVLSYLTSFQNHLGMHTGEISHKCKICGKAFYSPSSLQTHEKTHTGEKPYKCNQCGKAFNSSSSFRYHERTHTGEKPYECKQCGKAFRSASLLQTHGRTHTGEKPYACKECGKPFSNFSFFQIHERMHREEKPYECKGYGKTFSLPSLFHRHERTHTGGKTYECKQCGRSFNCSSSFRYHGRTHTGEKPYECKQCGKAFRSASQLQIHGRTHTGEKPYECKQCGKAFGSASHLQMHGRTHTGEKPYECKQCGKSFGCASRLQMHGRTHTGEKPYKCKQCGKAFGCPSNLRRHGRTHTGEKPYKCNQCGKVFRCSSQLQVHGRAHCIDTP

SEQ ID NO: 6784 - protein, 52 aa, Homo sapiens
MQETFRNLASIGKKWKPQNIYVEYENLRRNLRIVGERLFESKEGHQHGEILT

SEQ ID NO: 6785 - protein, 119 aa, Homo sapiens
MQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCL

SEQ ID NO: 6786 - protein, 485 aa, Homo sapiens
MRDNRAVSLCQQEWMCPGPAQRALYRGATQRKDSHVSLATGVPWGYEETKTLLAILSSSQFYGKLQTCQQNSQIYRAMAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGFEFKNEIKKENLKWDDSEEVEINKALQRKSRGVYWHSELQKGLESEPTSRRQCRNSPGESEEKTPSQEKMSHQSFCARDKACTHILCGKNCSQSVHSPHKPALKLEKVSQCPECGKTFSRSSYLVRHQRIHTGEKPHKCSECGKGFSERSNLTAHLRTHTGERPYQCGQCGKSFNQSSSLIVHQRTHTGEKPYQCIVCGKRFNNSSQFSAHRRIHTGESPYKCAVCGKIFNNSSHFSAHRKTHTGEKPYRCSHCERGFTKNSALTRHQTVHMKAVLSSQEGRDAL

SEQ ID NO: 6787 - protein, 697 aa, Homo sapiens
MMAAVKSTEAHPSSNKDPTQGQKSALQGNSPDSEASRQRFRQFCYQEVTGPHEAFSKLWELCCQWLRPKTHSKEEILELLVLEQFLTILPEEIQTWVREQHPENGEEAVALVEDVQRAPGQQVLDSEKDLKVLMKEMAPLGATRESLRSQWKQEVQPEEPTFKGSQSSHQRPGEQSEAWLAPQAPRNLPQNTGLHDQETGAVVWTAGSQGPAMRDNRAVSLCQQEWMCPGPAQRALYRGATQRKDSHVSLATGVPWGYEETKTLLAILSSSQFYGKLQTCQQNSQIYRAMAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGFEFKNEIKKENLKWDDSEEVEINKALQRKSRGVYWHSELQKGLESEPTSRRQCRNSPGESEEKTPSQEKMSHQSFCARDKACTHILCGKNCSQSVHSPHKPALKLEKVSQCPECGKTFSRSSYLVRHQRIHTGEKPHKCSECGKGFSERSNLTAHLRTHTGERPYQCGQCGKSFNQSSSLIVHQRTHTGEKPYQCIVCGKRFNNSSQFSAHRRIHTGESPYKCAVCGKIFNNSSHFSAHRKTHTGEKPYRCSHCERGFTKNSALTRHQTVHMKAVLSSQEGRDAL

SEQ ID NO: 6788 - protein, 697 aa, Homo sapiens; identical to SEQ ID NO: 6787

SEQ ID NO: 6789 - protein, 256 aa, Homo sapiens
MAAVKSTEAHPSSNKDPTQGQKSALQGNSPDSEASRQRFRQFCYQEVTGPHEAFSKLWELCCQWLRPKTHSKEEILELLVLEQFLTILPEEIQTWVREQHPENGEEAVALVEDVQRAPGQQVLDSEKDLKVLMKEMAPLGATRESLRSQWKQEVQPEEPTFKGSQSSHQRPGEQSEAWLAPQAPRNLPQNTGLHDQETGAVVWTAGSQGPAMRDNRAVSLCQQEWMCPGPAQRALYRGATQRKDSHVSLATGALGL

SEQ ID NO: 6790 - protein, 215 aa, Homo sapiens
MRDNRAVSLCQQEWMCPGPAQRALYRGATQRKDSHVSLATGVPWGYEETKTLLAILSSSQFYGKLQTCQQNSQIYRAMAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGKTPLALMVKGWQSPL

SEQ ID NO: 6791 - protein, 408 aa, Homo sapiens
MAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGFEFKNEIKKENLKWDDSEEVEINKALQRKSRGVYWHSELQKGLESEPTSRRQCRNSPGESEEKTPSQEKMSHQSFCARDKACTHILCGKNCSQSVHSPHKPALKLEKVSQCPECGKTFSRSSYLVRHQRIHTGEKPHKCSECGKGFSERSNLTAHLRTHTGERPYQCGQCGKSFNQSSSLIVHQRTHTGEKPYQCIVCGKRFNNSSQFSAHRRIHTGESPYKCAVCGKIFNNSSHFSAHRKTHTGEKPYRCSHCERGFTKNSALTRHQTVHMKAVLSSQEGRDAL

SEQ ID NO: 6792 - protein, 818 aa, Homo sapiens
MDSESNIPSGTIQSRKGLQNKSQFRTIAPKIVPKVLTSRMLPCHSPSRSDQVNLGPSINSKLLGMSTQNYALMQVAGQEGTFSLVALPHVASAQPIQKPRMSLPENLKLPIPRYQPPRNSKASRKKPILIFPKSGCSKAPAQTQMCPQMSPSPPHHPELLYKPSPFEEVPSLEQAPASISTAALTNGSDHGDLRPPVTNTHGSLNPPATPASSTPEEPAKQDLTALSGKAHFVSKITSSKPSAVASEKFKEQVDLAKTMTNLSPTILGNAVQLISSVPKGKLPIPPYSRMKTMEVYKIKSDANIAGFSLPGPKADCDKIPSTTEGFNAATKVASRLPVPQVSQQSACESAFCPPTKLDLNHKTKLNSGAAKRKGRKRKVPDEILAFQGKRRKYIINKCRDGKERVKNDPQEFRDQKLGTLKKYRSIMPKPIMVIPTLASLASPTTLQSQMLGGLGQDVLLNNSLTPKYLGCKQDNSSSPKPSSVFRNGFSGIKKPWHRCHVCNHHFQFKQHLRDHMNTHTNRRPYSCRICRKSYVRPGSLSTHMKLHHGENRLKKLMCCEFCAKVFGHIRVYFGHLKEVHRVVISTEPAPSELQPGDIPKNRDMSVRGMEGSLERENKSNLEEDFLLNQADEVKLQIKCGRCQITAQSFAEIKFHLLDVHGEEIEGRLQEGTFPGSKGTQEELVQHASPDWKRHPERGKPEKVHSSSEESHACPRLKRQLHLHQNGVEMLMENEGPQSGTNKPRETCQGPECPGLHTFLLWSHSGFNCLLCAEMLGRKEDLLHHWKHQHNCEDPSKLWAILNTVSNQGVIELSSEAEK

SEQ ID NO: 6793 - protein, 828 aa, Homo sapiens
MQNSVSVPPKDEGESNIPSGTIQSRKGLQNKSQFRTIAPKIVPKVLTSRMLPCHSPSRSDQVNLGPSINSKLLGMSTQNYALMQVAGQEGTFSLVALPHVASAQPIQKPRMSLPENLKLPIPRYQPPRNSKASRKKPILIFPKSGCSKAPAQTQMCPQMSPSPPHHPELLYKPSPFEEVPSLEQAPASISTAALTNGSDHGDLRPPVTNTHGSLNPPATPASSTPEEPAKQDLTALSGKAHFVSKITSSKPSAVASEKFKEQVDLAKTMTNLSPTILGNAVQLISSVPKGKLPIPPYSRMKTMEVYKIKSDANIAGFSLPGPKADCDKIPSTTEGFNAATKVASRLPVPQVSQQSACESAFCPPTKLDLNHKTKLNSGAAKRKGRKRKVPDEILAFQGKRRKYIINKCRDGKERVKNDPQEFRDQKLGTLKKYRSIMPKPIMVIPTLASLASPTTLQSQMLGGLGQDVLLNNSLTPKYLGCKQDNSSSPKPSSVFRNGFSGIKKPWHRCHVCNHHFQFKQHLRDHMNTHTNRRPYSCRICRKSYVRPGSLSTHMKLHHGENRLKKLMCCEFCAKVFGHIRVYFGHLKEVHRVVISTEPAPSELQPGDIPKNRDMSVRGMEGSLERENKSNLEEDFLLNQADEVKLQIKCGRCQITAQSFAEIKFHLLDVHGEEIEGRLQEGTFPGSKGTQEELVQHASPDWKRHPERGKPEKVHSSSEESHACPRLKRQLHLHQNGVEMLMENEGPQSGTNKPRETCQGPECPGLHTFLLWSHSGFNCLLCAEMLGRKEDLLHHWKHQHNCEDPSKLWAILNTVSNQGVIELSSEAEK

SEQ ID NO: 6794 - protein, 392 aa, Homo sapiens
MPKPIMVIPTLASLASPTTLQSQMLGGLGQDVLLNNSLTPKYLGCKQDNSSSPKPSSVFRNGFSGIKKPWHRCHVCNHHFQFKQHLRDHMNTHTNRRPYSCRICRKSYVRPGSLSTHMKLHHGENRLKKLMCCEFCAKVFGHIRVYFGHLKEVHRVVISTEPAPSELQPGDIPKNRDMSVRGMEGSLERENKSNLEEDFLLNQADEVKLQIKCGRCQITAQSFAEIKFHLLDVHGEEIEGRLQEGTFPGSKGTQEELVQHASPDWKRHPERGKPEKVHSSSEESHACPRLKRQLHLHQNGVEMLMENEGPQSGTNKPRETCQGPECPGLHTFLLWSHSGFNCLLCAEMLGRKEDLLHHWKHQHNCEDPSKLWAILNTVSNQGVIELSSEAEK

SEQ ID NO: 6795 - protein, 828 aa, Homo sapiens; identical to SEQ ID NO: 6793

SEQ ID NO: 6796 - protein, 547 aa, Homo sapiens
MQNSVSVPPKDEGESNIPSGTIQSRKGLQNKSQFRTIAPKIVPKVLTSRMLPCHSPSRSDQDLRPTVIRYPPPQKALMQPPRWQAGYLFHKTKLNSGAAKRKGRKRKVPDEILAFQGKRRKYIINKCRDGKERVKNDPQEFRDQKLGTLKKYRSIMPKPIMVIPTLASLASPTTLQSQMLGGLGQDVLLNNSLTPKYLGCKQDNSSSPKPSSVFRNGFSGIKKPWHRCHVCNHHFQFKQHLRDHMNTHTNRRPYSCRICRKSYVRPGSLSTHMKLHHGENRLKKLMCCEFCAKVFGHIRVYFGHLKEVHRVVISTEPAPSELQPGDIPKNRDMSVRGMEGSLERENKSNLEEDFLLNQADEVKLQIKCGRCQITAQSFAEIKFHLLDVHGEEIEGRLQEGTFPGSKGTQEELVQHASPDWKRHPERGKPEKVHSSSEESHACPRLKRQLHLHQNGVEMLMENEGPQSGTNKPRETCQGPECPGLHTFLLWSHSGFNCLLCAEMLGRKEDLLHHWKHQHNCEDPSKLWAILNTVSNQGVIELSSEAEK

SEQ ID NO: 6797 - protein, 828 aa, Homo sapiens; identical to SEQ ID NO: 6793

SEQ ID NO: 6798 - protein, 828 aa, Homo sapiens; identical to SEQ ID NO: 6793

SEQ ID NO: 6799 - protein, 818 aa, Homo sapiens; identical to SEQ ID NO: 6792

SEQ ID NO: 6800 - protein, 818 aa, Homo sapiens; identical to SEQ ID NO: 6792

SEQ ID NO: 6801 - protein, 779 aa, Homo sapiens
MLPCHSPSRSDQVNLGPSINSKLLGMSTQNYALMQVAGQEGTFSLVALPHVASAQPIQKPRMSLPENLKLPIPRYQPPRNSKASRKKPILIFPKSGCSKAPAQTQMCPQMSPSPPHHPELLYKPSPFEEVPSLEQAPASISTAALTNGSDHGDLRPPVTNTHGSLNPPATPASSTPEEPAKQDLTALSGKAHFVSKITSSKPSAVASEKFKEQVDLAKTMTNLSPTILGNAVQLISSVPKGKLPIPPYSRMKTMEVYKIKSDANIAGFSLPGPKADCDKIPSTTEGFNAATKVASRLPVPQVSQQSACESAFCPPTKLDLNHKTKLNSGAAKRKGRKRKVPDEILAFQGKRRKYIINKCRDGKERVKNDPQEFRDQKLGTLKKYRSIMPKPIMVIPTLASLASPTTLQSQMLGGLGQDVLLNNSLTPKYLGCKQDNSSSPKPSSVFRNGFSGIKKPWHRCHVCNHHFQFKQHLRDHMNTHTNRRPYSCRICRKSYVRPGSLSTHMKLHHGENRLKKLMCCEFCAKVFGHIRVYFGHLKEVHRVVISTEPAPSELQPGDIPKNRDMSVRGMEGSLERENKSNLEEDFLLNQADEVKLQIKCGRCQITAQSFAEIKFHLLDVHGEEIEGRLQEGTFPGSKGTQEELVQHASPDWKRHPERGKPEKVHSSSEESHACPRLKRQLHLHQNGVEMLMENEGPQSGTNKPRETCQGPECPGLHTFLLWSHSGFNCLLCAEMLGRKEDLLHHWKHQHNCEDPSKLWAILNTVSNQGVIELSSEAEK

SEQ ID NO: 6802 - protein, 499 aa, Homo sapiens
MLSLSPILLYTCEMFQDPVAFKDVAVNFTQEEWALLDISQKNLYREVMLETFWNLTSIGKKWKDQNIEYEYQNPRRNFRSVTEEKVNEIKEDSHCGETFTPVPDDRLNFQKKKASPEVKSCDSFVCEVGLGNSSSNMNIRGDTGHKACECQEYGPKPWKSQQPKKAFRYHPSLRTQERDHTGKKPYACKECGKNIIYHSSIQRHMVVHSGDGPYKCKFCGKAFHCLSLYLIHERTHTGEKPYECKQCGKSFSYSATHRIHERTHIGEKPYECQECGKAFHSPRSCHRHERSHMGEKAYQCKECGKAFMCPRYVRRHERTHSRKKLYECKQCGKALSSLTSFQTHIRMHSGERPYECKTCGKGFYSAKSFQRHEKTHSGEKPYKCKQCGKAFTRSGSFRYHERTHTGEKPYECKQCGKAFRSAPNLQLHGRTHTGEKPYQCKECGKAFRSASQLRIHRRIHTGEKPYECKKCGKAFRYVQNFRFHERTQTHKNALWRKTL

SEQ ID NO: 6803 - protein, 595 aa, Homo sapiens
MDPVAFKDVAVNFTQEEWALLDISQRKLYREVMLETFRNLTSLGKRWKDQNIEYEHQNPRRNFRSLIEEKVNEIKDDSHCGETFTPVPDDRLNFQEKKASPEVKSCESFVCGEVGLGNSSFNMNIRGDIGHKAYEYQEYGPKPCKCQQPKKAFRYRPSFRTQERDHTGEKPNACKVCGKTFISHSSVRRHMVMHSGDGPYKCKFCGKAFHCLRLYLIHERIHTGEKPCECKQCGKSFSYSATHRIHKRTHTGEKPYEYQECGKAFHSPRSYRRHERIHMGEKAYQCKECGKAFTCPRYVRIHERTHSRKNLYECKQCGKALSSLTSFQTHVRLHSGERPYECKICGKDFCSVNSFQRHEKIHSGEKPYKCKQCGKAFPHSSSLRYHERTHTGEKPYECKQCGKAFRSASHLRVHGRTHTGEKPYECKECGKAFRYVNNLQSHERTQTHIRIHSGERRYKCKICGKGFYCPKSFQRHEKTHTGEKLYECKQRSVVPSVVPVPFDIMKGLTLERSPINASNVGKPSELCQSFECMVGLTLKRNPMSVSNDGKPSDLPHTFEYVVGHTMERSPMHVRNVGNPSDLPRTFEFMKGHKHT

SEQ ID NO: 6804 - protein, 693 aa, Homo sapiens
MDSVAFEDVAINFTCEEWALLGPSQKSLYRDVMQETIRNLDCIGMIWQNHDIEEDQYKDLRRNLRCHMVERACEIKDNSQCGGPFTQTQDSIVNEKIPGVDPWESSECTDVLMGRSSLNCYVRVDSEHKPCEYQEYGEKPYTHTQCGTAFSYQPCFQIHERPQHGKKLYDCKECASFSSLENLQRHMAAHHGDGPRICKLCGNAFIWPSLFHMLRRTHTEEKPYEYEQCSTAFPAYSSTLRHERTHSGEKPYQCKQCGKAFSCSCYTQLYERTHTGEQSYECKQCGKAFYHLGSFQRHMIVHTGDGPHKCKICGKGFLSPSSVRRHKRTHTGEKPYECKYCGKAFSDCTGFRRHMITHTGDGPHKCKVCGKAFDSPSLCRRHETTHTGEKPYKCECGKAFSDFYYFRNHETTHTGEKPYKCKQCGKAFICCTYLQIHERIHTGERPYKCKQCGKAFRSSNYIRVHEKTHTGEKPYECKQCGKALSHLKSFQRHMIMHTGDGPHKCKICGKSFDSPSSFRRHERIHTGERPYKCKLCGKGFRSSSYIQLHERTHTGEKPYGCQQCGKALSDLSSFRRHMITHTGNGPHKCKICGKGFDYPSSVQRHERTHTGEKPYECKECGKAFSHSSYLRIHERVHTGEKPYKCKECGKPFHCPSAFHKHERTHSMEKPYKCKECGEAFHCISSFHKHEMTH

SEQ ID NO: 6805 - protein, 626 aa, Homo sapiens [sequence omitted]

SEQ ID NO: 6806 - protein, 627 aa, Homo sapiens
MIVFGGEDRSDLFLPDSQTNEERKQYDSVAFEDVAVNFTQEEWALLGPSQKSLYRDVMWETIRNLDCIGMKWEDTNIEDQHRNPRRSLRCHIIERFSESRQPDSTVNEKPPGVDPCKSSVCGEIMGCSFLNCYITFDAGHKPDECQEYGEKPHTHKQCGTAFNYHHSFQTQERPHTGKKRYDCKECGKTFSSSGNLRRHIIVQRGGGPYICKLCGKAFFWPSLFRMHERTHTGEKPYECKQCCKAFPIYSSYLRHERTHTGEKPYECKHCSKAFPDYSSYVRHERTHTGEKPYKCKRCGRAFSVSSSLRIHERTHTGEKPYECKQCGKAFHHLGSFQRHMIRHTGDGPHKCKICGKGFDCPSSLQSHERTHTGEKPYECKQCGKALSHHSSFRSHMIMHTGDGPHKCKVCGKAFIYPSVFQGHERTHTGEKPYECKECGKAFRISSSLRRHETTHTGEKPYKCKCGKAFIDFYSFQNHETTHTGEKPYECKECGKAFSCFTYLSQHRRTHMAEKPYECKTCKKAFSHFGNLKVHERIHTGEKPYECKECRKAFSWLTCLLRHERIHTGKKSYECQQCGKAFTRSRFLRGHEKTHTGEKMHECKECGKALSSLSSLHRHKRTHWRDTL

SEQ ID NO: 6807 - protein, 558 aa, Homo sapiens
MKWEDTNIEDQHRNPRRSLRCHIIERFSESRQPDSTVNEKPPGVDPCKSSVCGEIMGCSFLNCYITFDAGHKPDECQEYGEKPHTHKQCGTAFNYHHSFQTQERPHTGKKRYDCKECGKTFSSSGNLRRHIIVQRGGGPYICKLCGKAFFWPSLFRMHERTHTGEKPYECKQCCKAFPIYSSYLRHERTHTGEKPYECKHCSKAFPDYSSYVRHERTHTGEKPYKCKRCGRAFSVSSSLRIHERTHTGEKPYECKQCGKAFHHLGSFQRHMIRHTGDGPHKCKICGKGFDCPSSLQSHERTHTGEKPYECKQCGKALSHHSSFRSHMIMHTGDGPHKCKVCGKAFIYPSVFQGHERTHTGEKPYECKECGKAFRISSSLRRHETTHTGEKPYKCKCGKAFIDFYSFQNHETTHTGEKPYECKECGKAFSCFTYLSQHRRTHMAEKPYECKTCKKAFSHFGNLKVHERIHTGEKPYECKECRKAFSWLTCLLRHERIHTGKKSYECQQCGKAFTRSRFLRGHEKTHTGEKMHECKECGKALSSLSSLHRHKRTHWRDTL

SEQ ID NO: 6808 - protein, 671 aa, Homo sapiens
MASVALEDVAVNFTREEWALLGPCQKNLYKDVMQETIRNLDCVVMKWKDQNIEDQYRYPRKNLRCRMLERFVESKDGTQCGETSSQIQDSIVTKNTLPGVGPCESSMRGEKVMGHSSLNCYIRVGAGHKPHEYHECGEKPDTHKQRGKAFSYHNSFQTHERLHTGKKPYDCKECGKSFSSLGNLQRHMAVQRGDGPYKCKLCGKAFFWPSLLHMHERTHTGEKPYECKQCSKAFSFYSSYLRHERTHTGEKPYECKQCSKAFPFYSSYLRHERTHTGEKPYKCKQCSKAFPDSSSCLIHERTHTGEKPYTCKQCGKAFSVSGSLQRHETTHSAEKPYACQQCGKAFHHLGSFQRHMIRHTGNGPHKCKICGKGFDCPSSLQSHERTHTGEKPYECKQCGKALSHRSSFRSHMIMHTGDGPHKCKVCGKAFVYPSVFQRHERTHTAEKPYKCKQCGKAYRISSSLRRHETTHTGEKPYKCKLGKACIDFCSFQNHKTTHTGEKPYECKECGKAFSRFRYLSRHKRTHTGEKPYECKTCRKAFGHYDNLKVHERIHSGEKPYECKECGKAFSWLTCFLRHERIHMREKSYECPQCGKAFTHSRFLQGHEKTHTGENPYECKECGKAFASLSSLHRHKKTHWKKTHTGENPYECKECGKAFASLSSLHRHKKTH

SEQ ID NO: 6809 - protein, 643 aa, Homo sapiens
MASVALEDVAVNFTREEWALLGPCQKNLYKDVMQETIRNLDCVVMKWKDQNIEDQYRYPRKNLRCRMLERFVESKDGTQCGETSSQIQDSIVTKNTLPGVGPCESSMRGEKVMGHSSLNCYIRVGAGHKPHEYHECGEKPDTHKQRGKAFSYHNSFQTHERLHTGKKPYDCKECGKSFSSLGNLQRHMAVQRGDGPYKCKLCGKAFFWPSLLHMHERTHTGEKPYECKQCSKAFSFYSSYLRHERTHTGEKPYECKQCSKAFPFYSSYLRHERTHTGEKPYKCKQCSKAFPDSSSCLIHERTHTGEKPYTCKQCGKAFSVSGSLQRHETTHSAEKPYACQQCGKAFHHLGSFQRHMIRHTGNGPHKCKICGKGFDCPSSLQSHERTHTGEKPYECKQCGKALSHRSSFRSHMIMHTGDGPHKCKVCGKAFVYPSVFQRHERTHTAEKPYKCKQCGKAYRISSSLRRHETTHTGEKPYKCKLGKACIDFCSFQNHKTTHTGEKPYECKECGKAFSRFRYLSRHKRTHTGEKPYECKTCRKAFGHYDNLKVHERIHMREKSYECPQCGKAFTHSRFLQGHEKTHTGENPYECKECGKAFASLSSLHRHKKTHWKKTHTGENPYECKECGKAFASLSSLHRHKKTH

SEQ ID NO: 6810 - protein, 350 aa, Homo sapiens
MPPGRWHAASSGPVFEGARLQTVKKEEEDESYTPVQAARPQTLNRPGQELFRQLFRQLRYHESSGPLETLSRLRELCRWWLRPDVLSKAQILELLVLEQFLSILPGELRVWVQLHNPESGEEWPCWRSCRGTLMGHPGGTRAPEPRCALDGYRSRSAQIWSLASPLRSSSALGDHLEPPYEIEARDFLAGQSDTPAAQMPALFPREGCPGDQVTPTRSLTAQLQETMTFKDVEVTFSQDEWGWLDSAQRNLYRDVMLENYRNMASLVGPFTKPALISWLEAREPWGLNMQAAQPKGNPVAAPTGDDLQSKTNKFILNQEPLEEAETLAVSSGCPATSVSEGIGLRESFQQ

SEQ ID NO: 6811 - protein, 1031 aa, Homo sapiens
MPPGRWHAAYPAQAQSSRERGRLQTVKKEEEDESYTPVQAARPQTLNRPGQELFRQLFRQLRYHESSGPLETLSRLRELCRWWLRPDVLSKAQILELLVLEQFLSILPGELRVWVQLHNPESGEEAVALLEELQRDLDGTSWRDPGPAQSPDVHWMGTGALRSAQIWSLASPLRSSSALGDHLEPPYEIEARDFLAGQSDTPAAQMPALFPREGCPGDQVTPTRSLTAQLQETMTFKDVEVTFSQDEWGWLDSAQRNLYRDVMLENYRNMASLVGPFTKPALISWLEAREPWGLNMQAAQPKGNPVAAPTGDDLQSKTNKFILNQEPLEEAETLAVSSGCPATSVSEGIGLRESFQQKSRQKDQCENPIQVRVKKEETNFSHRTGKDSEVSGSNSLDLKHVTYLRVSGRKESLKHGCGKHFRMSSHHYDYKKYGKGLRHMIGGFSLHQRIHSGLKGNKKDVCGKDFSLSSHHQRGQSLHTVGVSFKCSDCGRTFSHSSHLAYHQRLHTQEKAFKCRVCGKAFRWSSNCARHEKIHTGVKPYKCDLCEKAFRRLSAYRLHRETHAKKKFLELNQYRAALTYSSGFDHHLGDQSGEKLFDCSQCRKSFHCKSYVLEHQRIHTQEKPYKCTKCRKTFRWRSNFTRHMRLHEEEKFYKQDECREGFRQSPDCSQPQGAPAVEKTFLCQQCGKTFTRKKTLVDHQRIHTGEKPYQCSDCGKDFAYRSAFIVHKKKHAMKRKPEGGPSFSQDTVFQVPQSSHSKEEPYKCSQCGKAFRNHSFLLIHQRVHTGEKPYKCRECGKAFRWSSNLYRHQRIHSLQKQYDCHESEKTPNVEPKILTGEKRFWCQECGKTFTRKRTLLDHKGIHSGEKRYKCNLCGKSYDRNYRLVNHQRIHSTERPFKCQWCGKEFIGRHTLSSHQRKHTRAAQAERSPPARSSSQDTKLRLQKLKPSEEMPLEDCKEACSQSSRLTGLQDISIGKKCHKCSICGKTFNKSSQLISHKRFHTRERPFKCSKCGKTFRWSSNLARHMKNHIRD

SEQ ID NO: 6812 - protein, 1031 aa, Homo sapiens; identical to SEQ ID NO: 6811

SEQ ID NO: 6813 - protein, 273 aa, Homo sapiens [sequence omitted]

SEQ ID NO: 6814 - protein, 450 aa, Homo sapiens
MPSPLGPPCLPVMDPETTLEEPETARLRFRGFCYQEVAGPREALARLRELCCQWLQPEAHSKEQMLEMLVLEQFLGTLPPEIQAWVRGQRPGSPEEAAALVEGLQHDPGQLLGWITAHVLKQEVLPAAQKTEEPLGSPHPSGTVESPGEGPQDTRIEGSVQLSCSVKEEPNVDGQEVAPSSPPLAAQSPEGNHGHQEPASTSFHPPRIQEEWGLLDRSQKELYWDAMLEKYGTVVSLGLPPHQPEAQAQSELGMLLTGTGVCRSLRSGNESEGPPGCPEAQPPQGPGPAAWEGLSGAATPAPTVRPGTPPVPTQPTPAETRLEPAATPRKPYTCEQCGRGFDWKSVFVIHHRTHTSGPGVQSPGLATGESTEKPPQGEVAFPHHPRRSLTGPRSYPCEECGCSFSWKSQLVIHRKSHTGQRRHFCSDCGRAFDWKSQLVIHRKGHRPEVP

SEQ ID NO: 6815 - protein, 347 aa, Homo sapiens
MSMDRKWHPPALHLQHSPLRGTMDTKNQPPHPSTHPGFRRSGGCWTGHRRNCTGMRCWRSTAQWSPWVRTSQPHPAPLPGACTHPAAGLAGQGLCATSPTQLSHLPEEHPVTYQNRPHPSFMQTPCLTVPPTRAGLPPHQPEAQAQSELGMLLTGTGVCRSLRSGNESEGPPGCPEAQPPQGPGPAAWEGLSGAATPAPTVRPGTPPVPTQPTPAETRLEPAATPRKPYTCEQCGRGFDWKSVFVIHHRTHTSGPGVQSPGLATGESTEKPPQGEVAFPHHPRRSLTGPRSYPCEECGCSFSWKSQLVIHRKSHTGQRRHFCSDCGRAFDWKSQLVIHRKGHRPEVP

SEQ ID NO: 6816 - protein, 155 aa, Homo sapiens
MPSPLGPPCLPVMDPETTLEEPETARLRFRGFCYQEVAGPREALARLRELCCQWLQPEAHSKEQMLEMLVLEQFLGTLPPEIQAWVRGQRPGSPEEAAALVEGLQHDPGQLLGWITAHVLKQEVLPAAQKTEEPLGAPTPQGQWSPLGKVPRTPE

SEQ ID NO: 6817 - protein, 422 aa, Homo sapiens
MPSPLGPPCLPVMDPETTLEEPETARLRFRGFCYQEVAGPREALARLRELCCQWLQPEAHSKEQMLEMLVLEQFLGTLPPEIQAWVRGQRPGSPEEAAALVEGLQHDPGQLLGWITAHVLKQEVLPAAQKTEEPLGSPHPSGTVESPGEGPQDTRIEGSVQLSCSVKEEPNVDGQEVAPSSPPLAAQSPEGNHGHQEPASTSFHPPRIQEEWGLLDRSQKELYWDAMLEKYGTVVSLGLPPHQPEAQAQSELGMLLTGTGVCRSLRSGNESEGPPGCPEAQPPQGPGPAAWEGLSGAATPAPTVRPGTPPVPTQPTPAETRLEPAATPRKPYTCEQCGRGFDWKSVFVIHHRTHTSGPGVQSPGLATGESTEKPPQGEVAFPHHPRRSLTGPRSYPCEECGCSFSWKSQLVIHRKSHRPEVP

SEQ ID NO: 6818 - protein, 450 aa, Homo sapiens; identical to SEQ ID NO: 6814

SEQ ID NO: 6819 - protein, 1013 aa, Homo sapiens
MGDPGSEIIESVPPAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKRFDHSPCDPTITLHGPFFSSFACVVCYKKFVTQQQYRDHLFDKEATDDGHNNNLLPQIIQCFACPNCFLLFSRKEECSKHMSGKNHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTETSIKTEDDFPVIETSNQLTCGCRESYICKVNRKEDYSRCLQIMLDKGKLWFRCSLCSATAQNLTDMNTHIHQVHKEKSDEEEQQYVIKCGTCTKAFHDPESAQQHFHRKHCFLQKPSVAHFGSEKSNLYKFTASASHTERKLKQAINYSKSLDMEKGVENDLSYQNIGGNTNWKPPLNCKIYNYLNRIGCFFLHPRCSKRKDAADFAICMHAGRLDEQLPKQIPFTILSGDQGFLELENQFKKTQRPAHILNPHHLEGDMMCALLNSISDTTKECDSDDNMGAKNTSIGEEFISTEDVELEEAIRRSLEEM

SEQ ID NO: 6820 - protein, 1061 aa, Homo sapiens
MGDPGSEIIESVPPAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKRFDHSPCDPTITLHGPFFSSFACVVCYKKFVTQQQYRDHLFDKEATDDGHNNNLLPQIIQCFACPNCFLLFSRKEECSKHMSGKNHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTETSIKTEDDFPVIETSNQLTCGCRESYICKVNRKEDYSRCLQIMLDKGKLWFRCSLCSATAQNLTDMNTHIHQVHKEKSDEEEQQYVIKCGTCTKAFHDPESAQQHFHRKHCFLQKPSVAHFGSEKSNLYKFTASASHTERKLKQAINYSKSLDMEKGVENDLSYQNIEEEIVELPDLDYLRTMTHIVFVDFDNWSNFFGHLPGHLNQGTFIWGFQGGNTNWKPPLNCKIYNYLNRIGCFFLHPRCSKRKDAADFAICMHAGRLDEQLPKQIPFTILSGDQGFLELENQFKKTQRPAHILNPHHLEGDMMCALLNSISDTTKECDSDDNMGAKNTSIGEEFISTEDVELEEAIRRSLEEM

SEQ ID NO: 6821 - protein, 559 aa, Homo sapiens
MGDPGSEIIESVPPAGPEASESTTDENEDDIQFVSEGPLRPVLEYIDLVSSDDEEPSTSYTDRMPESKVPSSENHRPEMCSSCNVPLPIGDSSSFSGSCSSSPERIVSQTSSVENPLENQKNDQNNSDTKISETETLKSSQNFQTLPSSPLLVPQESLASSEVKENLRIDSSSASQHGRDAILYLQTQVAEMSRVIRDLQSRSCFRFHHSRPSENSSVPWDISTSKEENLSTVEEETDYKSPSADDKGQPSDPSQSSFTGLLKRMEQRGVIKRVTLQSEAESCEGKPDCVTSKKRLVPPLHPLLRIATTEVFKDPADCHPSSFMGHRVYPVAKDTSPFQPNPPAEGPIVEALEHSKRGNTTSPLDSTSKEMEVMGCRFYHAASIAARAASYMAYMTQYQRKLWEDMEDLVHDPEFDRGKARCIISDGMDAGLWQLCTTRDIMDSVVRVMAMAIDYRRQAWLRLTSLTKKTQEKISHLPFDGTSLFGQDVKAVVAEDNNIKENDYKDHKYYNQHRYFYSHDQKAHYHNRGYSKGDWYKPRNHPYRYRKKGDSPERHGYKN

SEQ ID NO: 6822 - protein, 522 aa, Homo sapiens
MAVSHLPTMVQESVTFKDVAILFTQEEWGQLSPAQRALYRDVMLENYSNLVSLGLLGPKPDTFSQLEKREVWMPEDTPGGFCLDWMTMPASKKSTVKAEIPEEELDQWTIKERFSSSSHWKCASLLEWQCGGQEISLQRVVLTHPNTPSQECDESGSTMSSSLHSDQSQGFQPSKNAFECSECGKVFSKSSTLNKHQKIHNEKNANQKIHIKEKRYECRECGKAFHQSTHLIHHQRIHTGEKPYECKECGKAFSVSSSLTYHQKIHTGEKPFECNLCGKAFIRNIHLAHHHRIHTGEKPFKCNICEKAFVCRAHLTKHQNIHSGEKPYKCNECGKAFNQSTSFLQHQRIHTGEKPFECNECGKAFRVNSSLTEHQRIHTGEKPYKCNECGKAFRDNSSFARHRKIHTGEKPYRCGLCEKAFRDQSALAQHQRIHTGEKPYTCNICEKAFSDHSALTQHKRIHTREKPYKCKICEKAFIRSTHLTQHQRIHTGEKPYKCNKCGKAFNQTANLIQHQRHHIGEK

SEQ ID NO: 6823 - protein, 522 aa, Homo sapiens; identical to SEQ ID NO: 6822

SEQ ID NO: 6824 - protein, 2506 aa, Homo sapiens
MEVLQCDGCDFRAPSYEDLKAHIQDVHTAFLQPTDVAEDNVNELRCGSVNASNQTEVEFSSIKDEFAIAEDLSGQNATSLGTGGYYGHSPGYYGQHIAANPKPTNKFFQCKFCVRYFRSKNLLIEHTRKVHGAQAEGSSSGPPVPGSLNYNIMMHEGFGKVFSCQFCTYKSPRRARIIKHQKMYHKNNLKETTAPPPAPAPMPDPVVPPVSLQDPCKELPAEVVERSILESMVKPLTKSRGNFCCEWCSYQTPRRERWCDHMMKKHRSMVKILSSLRQQQEGTNLPDVPNKSAPSPTSNSTYLTMNAASREIPNTTVSNFRGSMGNSIMRPNSSASKFSPMSYPQMKPKSPHNSGLVNLTERSRYGMTDMTNSSADLETNSMLNDSSSDEELNEIDSENGLSAMDHQTSGLSAEQLMGSDGNKLLETKGIPFRRFMNRFQCPFCPFLTMHRRSISRHIENIHLSGKTAVYKCDECPFTCKSSLKLGAHKQCHTGTTSDWDAVNSQSESISSSLNEGVVSYESSSINGRKSGVMLDPLQQQQPPQPPPPPPPPPPSQPQPLQQPQPPQLQPPHQVPPQPQTQPPPTQQPQPPTQAAPLHPYKCTMCNYSTTTLKGLRVHQQHKHSFCDNLPKFEGQPSSLPLENETDSHPSSSNTVKKSQTSILGLSSKNNFVAKASRKLANDFPLDLSPVKKRTRIDEIASNLQSKINQTKQQEDAVINVEDDEEEEEDNEVEIEVELDREEEPTEPIIEVPTSFSAQQIWVRDTSEPQKEPNFRNITHDYNATNGAEIELTLSEDEEDYYGSSTNLKDHQVSNTALLNTQTPIYGTEHNSENTDFGDSGRLYYCKHCDFNNKSARSVSTHYQRMHPYIKFSFRYILDPNDHSAVYRCLECYIDYTNFEDLQQHYGEHHPEAMNVLNFDHSDLIYRCRFCSYTSPNVRSLMPHYQRMHPTVKINNAMIFSSYVVEQQEGLNTESQTLREILNSAPKNMATSTPVARGGGLPATFNKNTPKTFTPECENQKDPLVNTVVVYDCDVCSFASPNMHSVLVHYQKKHPEEKASYFRIQKTMRMVSVDRGSALSQLSFEVGAPMSPKMSNMGSPPPPQPPPPDLSTELYYCKHCSYSNRSVVGVLVHYQKRHPEIKVTAKYIRQAPPTAAMMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 6825 - protein, 208 aa, Homo sapiens
  MOD_RES (1)..(1): Any amino acid
XEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHRGNLSNLVFLDAAGGRQQRWPSRDALSEWQ

SEQ ID NO: 6826 - protein, 2566 aa, Homo sapiens
MEVLQCDGCDFRAPSYEDLKAHIQDVHTAFLQPTDVAEDNVNELRCGSVNASNQTEVEFSSIKDEFAIAEDLSGQNATSLGTGGYYGHSPGYYGQHIAANPKPTNKFFQCKFCVRYFRSKNLLIEHTRKVHGAQAEGSSSGPPVPGSLNYNIMMHEGFGKVFSCQFCTYKSPRRARIIKHQKMYHKNNLKETTAPPPAPAPMPDPVVPPVSLQDPCKELPAEVVERSILESMVKPLTKSRGNFCCEWCSYQTPRRERWCDHMMKKHRSMVKILSSLRQQQEGTNLPDVPNKSAPSPTSNSTYLTMNAASREIPNTTVSNFRGSMGNSIMRPNSSASKFSPMSYPQMKPKSPHNSGLVNLTERSRYGMTDMTNSSADLETNSMLNDSSSDEELNEIDSENGLSAMDHQTSGLSAEQLMGSDGNKLLETKGIPFRRFMNRFQCPFCPFLTMHRRSISRHIENIHLSGKTAVYKCDECPFTCKSSLKLGAHKQCHTGTTSDWDAVNSQSESISSSLNEGVVSYESSSINGRKSGVMLDPLQQQQPPQPPPPPPPPPPSQPQPLQQPQPPQLQPPHQVPPQPQTQPPPTQQPQPPTQAAPLHPYKCTMCNYSTTTLKGLRVHQQHKHSFCDNLPKFEGQPSSLPLENETDSHPSSSNTVKKSQTSILGLSSKNNFVAKASRKLANDFPLDLSPVKKRTRIDEIASNLQSKINQTKQQEDAVINVEDDEEEEEDNEVEIEVELDREEEPTEPIIEVPTSFSAQQIWVRDTSEPQKEPNFRNITHDYNATNGAEIELTLSEDEEDYYGSSTNLKDHQVSNTALLNTQTPIYGTEHNSENTDFGDSGRLYYCKHCDFNNKSARSVSTHYQRMHPYIKFSFRYILDPNDHSAVYRCLECYIDYTNFEDLQQHYGEHHPEAMNVLNFDHSDLIYRCRFCSYTSPNVRSLMPHYQRMHPTVKINNAMIFSSYVVEQQEGLNTESQTLREILNSAPKNMATSTPVARGGGLPATFNKNTPKTFTPECENQKDPLVNTVVVYDCDVCSFASPNMHSVLVHYQKKHPEEKASYFRIQKTMRMVSVDRGSALSQLSFEVGAPMSPKMSNMGSPPPPQPPPPDLSTELYYCKHCSYSNRSVVGVLVHYQKRHPEIKVTAKYIRQAPPTAAMMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKEADDPAHLFLDGLEAAKDASGALVGRVDGEHCLLDGMLEDETRPGGYHCSQCDRVLMSMQGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 6827 - protein, 463 aa, Homo sapiens
MQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 6828 - protein, 522 aa, Homo sapiens
MALPQGLLTFRDVAIEFSQEEWKCLDPAQRTLYRDVMLENYRNLVSLDISSKCMLKTLSSTGQGNTEVIHTGTLHRQASHHIGEFCFHEIEKDIHGFEFQWKEDETNGHAAPMTEIKELAGSTGQHDQRHAGNKRIKDQLGSSFHLHLPEPHIFQSEGKIGNQVEKSINNASSVSTSQRICCRPKTHISNKYGNNSLHSSLLTQKWEVHMREKSFECIQSFKSFNCSSLLKKHQIIHLEEKQCKCDVCGKVFNQKRYLACHRRCHTGEKPYKCNECGKTFGHNSSLFIHKALHTGEKPYECEECDKVFSRKSHLERHKRIHTGEKPYKCKVCDEAFAYNSYLAKHTILHTGEKPYTCNECGKVFNRLSTLARHHRLHTGEKPYKCEECDKVFSRKSHLERHRRIHSGEKPYKCEECCKVFSRKSNLERHRRIHTGEKPYKCKVCDKAFQRDSHLAQHQRVHTGEKPYKCNECGKTFGQTSSLIIHRRLHTGEKPYKCNECGKTFSQMSSLVYHHRLHSGEKP

SEQ ID NO: 6829 - protein, 469 aa, Homo sapiens
MLKTLSSTGQGNTEVIHTGTLHRQASHHIGEFCFHEIEKDIHGFEFQWKEDETNGHAAPMTEIKELAGSTGQHDQRHAGNKRIKDQLGSSFHLHLPEPHIFQSEGKIGNQVEKSINNASSVSTSQRICCRPKTHISNKYGNNSLHSSLLTQKWEVHMREKSFECIQSFKSFNCSSLLKKHQIIHLEEKQCKCDVCGKVFNQKRYLACHRRCHTGEKPYKCNECGKTFGHNSSLFIHKALHTGEKPYECEECDKVFSRKSHLERHKRIHTGEKPYKCKVCDEAFAYNSYLAKHTILHTGEKPYTCNECGKVFNRLSTLARHHRLHTGEKPYKCEECDKVFSRKSHLERHRRIHSGEKPYKCEECCKVFSRKSNLERHRRIHTGEKPYKCKVCDKAFQRDSHLAQHQRVHTGEKPYKCNECGKTFGQTSSLIIHRRLHTGEKPYKCNECGKTFSQMSSLVYHHRLHSGEKP

SEQ ID NO: 6830 - protein, 217 aa, Homo sapiens
VFNQKRYLACHRRCHTGEKPYKCNECGKTFGHNSSLFIHKALHTGEKPYECEECDKVFSRKSHLERHKRIHTGEKPYKCKVCDEAFAYNSYLAKHTILHTGEKPYTCNECGKVFNRLSTLARHHRLHTGEKPYKCEECDKVFSRKSHLERHRRIVERNLTNVKNVAKFSSQIKPGKTQEFILERNHTNVRFVTRLSRGIHTWHNIREFILERNLTSV

SEQ ID NO: 6831 - protein, 469 aa, Homo sapiens; identical to SEQ ID NO: 6829

SEQ ID NO: 6832 - protein, 522 aa, Homo sapiens; identical to SEQ ID NO: 6828

SEQ ID NO: 6833 - protein, 717 aa, Homo sapiens
MKSQEEVEVAGIKLCKAMSLGSVTFTDVAIDFSQDEWEWLNLAQRSLYKKVMLENYRNLVSVGLCISKPDVISLLEQEKDPWVIKGGMNRGLCPDLECVWVTKSLSLNQDIYEEKLPPAIIMERLKSYDLECSTLGKNWKCEDLFERELVNQKTHFRQETITHIDTLIEKRDHSNKSGTVFHLNTLSYIKQIFPMEERIFNFHTDKKSLKTHSVVKKHKQDRGEKKLLKCNDCEKIFSKISTLTLHQRIHTGEKPYECIECGKAFSQSAHLAQHQRIHTGEKPFECTECGKAFSQNAHLVQHQRVHTGEKPYQCKQCNKAFSQLAHLAQHQRVHTGEKPYECIECGKAFSDCSSLAHHRRIHTGKRPYECIDCGKAFRQNASLIRHRRYYHTGEKPFDCIDCGKAFTDHIGLIQHKRTHTGERPYKCNVCGKAFSHGSSLTVHQRIHTGEKPYECNICEKAFSHRGSLTLHQRVHTGEKPYECKECGKAFRQSTHLAHHQRIHTGEKPYECKECSKTFSQNAHLAQHQKIHTGEKPYECKECGKAFSQIAHLVQHQRVHTGEKPYECIECGKAFSDGSYLVQHQRLHSGKRPYECLECGKAFRQRASLICHQRCHTGEKPYECNVCGKAFSHRKSLTLHQRIHTGEKPYECKECSKAFSQVAHLTLHKRIHTGERPYECKECGKAFRQSVHLAHHQRIHTGESSVILSSALPYHQVL

SEQ ID NO: 6834 - protein, 717 aa, Homo sapiens; identical to SEQ ID NO: 6833

SEQ ID NO: 6835 - protein, 626 aa, Homo sapiens
MNVEVVKVMPQDLVTFKDVAIDFSQEEWQWMNPAQKRLYRSMMLENYQSLVSLGLCISKPYVISLLEQGREPWEMTSEMTRSPFSDWESIYVTQELPLKQFMYDDACMEGITSYGLECSTFEENWKWEDLFEKQMGSHEMFSKKEIITHKETITKETEFKYTKFGKCIHLENIEESIYNHTSDKKSFSKNSMVIKHKKVYVGKKLFKCNECDKTFTHSSSLTVHFRIHTGEKPYACEECGKAFKQRQHLAQHHRTHTGEKLFECKECRKAFKQSEHLIQHQRIHTGEKPYKCKECRKAFRQPAHLAQHQRIHTGEKPYECKECGKAFSDGSSFARHQRCHTGKRPYECIECGKAFRYNTSFIRHWRSYHTGEKPFNCIDCGKAFSVHIGLILHRRIHTGEKPYKCGVCGKTFSSGSSRTVHQRIHTGEKPYECDICGKDFSHHASLTQHQRVHSGEKPYECKECGKAFRQNVHLVSHLRIHTGEKPYECKECGKAFRISSQLATHQRIHTGEKPYECIECGNAFKQRSHLAQHQKTHTGEKPYECNECGKAFSQTSNLTQHQRIHTGEKPYKCTECGKAFSDSSSCAQHQRLHTGQRPYQCFECGKAFRRKLSLICHQRSHTGEEP

SEQ ID NO: 6836 - protein, 871 aa, Homo sapiens
MAEEFVTLKDVGMDFTLGDWEQLGLEQGDTFWDTALDNCQDLFLLDPPRPNLTSHPDGSEDLEPLAGGSPEATSPDVTETKNSPLMEDFFEEGFSQEIIEMLSKDGFWNSNFGEACIEDTWLDSLLGDPESLLRSDIATNGESPTECKSHELKRGLSPVSTVSTGEDSMVHNVSEKTLTPAKSKEYRGEFFSYSDHSQQDSVQEGEKPYQCSECGKSFSGSYRLTQHWITHTREKPTVHQECEQGFDRNASLSVYPKTHTGYKFYVCNEYGTTFSQSTYLWHQKTHTGEKPCKSQDSDHPPSHDTQPGEHQKTHTDSKSYNCNECGKAFTRIFHLTRHQKIHTRKRYECSKCQATFNLRKHLIQHQKTHAAKTTSECQECGKIFRHSSLLIEHQALHAGEEPYKCNERGKSFRHNSTLKIHQRVHSGEKPYKCSECGKAFHRHTHLNEHRRIHTGYRPHKCQECVRSFSRPSHLMRHQAIHTAEKPYSCAECKETFSDNNRLVQHQKMHTVKTPYECQECGERFICGSTLKCHESVHAREKQGFFVSGKILDQNPEQKEKCFKCNKCEKTFSCSKYLTQHERIHTRGVKPFECDQCGKAFGQSTRLIHHQRIHSRVRLYKWGEQGKAISSASLIKLQSFHTKEHPFKCNECGKTFSHSAHLSKHQLIHAGENPFKCSKCDRVFTQRNYLVQHERTHARKKPLVCNECGKTFRQSSCLSKHQRIHSGEKPYVCDYCGKAFGLSAELVRHQRIHTGEKPYVCQECGKAFTQSSCLSIHRRVHTGEKPYRCGECGKAFAQKANLTQHQRIHTGEKPYSCNVCGKAFVLSAHLNQHLRVHTQETLYQCQRCQKAFRCHSSLSRHQRVHNKQQYCL

SEQ ID NO: 6837 - protein, 871 aa, Homo sapiens; identical to SEQ ID NO: 6836

SEQ ID NO: 6838 - protein, 859 aa, Homo sapiens
MDFTLGDWEQLGLEQGDTFWDTALDNCQDLFLLDPPRPNLTSHPDGSEDLEPLAGGSPEATSPDVTETKNSPLMEDFFEEGFSQEIIEMLSKDGFWNSNFGEACIEDTWLDSLLGDPESLLRSDIATNGESPTECKSHELKRGLSPVSTVSTGEDSMVHNVSEKTLTPAKSKEYRGEFFSYSDHSQQDSVQEGEKPYQCSECGKSFSGSYRLTQHWITHTREKPTVHQECEQGFDRNASLSVYPKTHTGYKFYVCNEYGTTFSQSTYLWHQKTHTGEKPCKSQDSDHPPSHDTQPGEHQKTHTDSKSYNCNECGKAFTRIFHLTRHQKIHTRKRYECSKCQATFNLRKHLIQHQKTHAAKTTSECQECGKIFRHSSLLIEHQALHAGEEPYKCNERGKSFRHNSTLKIHQRVHSGEKPYKCSECGKAFHRHTHLNEHRRIHTGYRPHKCQECVRSFSRPSHLMRHQAIHTAEKPYSCAECKETFSDNNRLVQHQKMHTVKTPYECQECGERFICGSTLKCHESVHAREKQGFFVSGKILDQNPEQKEKCFKCNKCEKTFSCSKYLTQHERIHTRGVKPFECDQCGKAFGQSTRLIHHQRIHSRVRLYKWGEQGKAISSASLIKLQSFHTKEHPFKCNECGKTFSHSAHLSKHQLIHAGENPFKCSKCDRVFTQRNYLVQHERTHARKKPLVCNECGKTFRQSSCLSKHQRIHSGEKPYVCDYCGKAFGLSAELVRHQRIHTGEKPYVCQECGKAFTQSSCLSIHRRVHTGEKPYRCGECGKAFAQKANLTQHQRIHTGEKPYSCNVCGKAFVLSAHLNQHLRVHTQETLYQCQRCQKAFRCHSSLSRHQRVHNKQQYCL

SEQ ID NO: 6839 - protein, 871 aa, Homo sapiens; identical to SEQ ID NO: 6836

SEQ ID NO: 6840 - protein, 524 aa, Homo sapiens
MAKRPGPPGSREMGLLTFRDIAIEFSLEEWQCLDCAQRNLYRDVMLENYRNLVSLGIAVSKPDLITCLEQNKESQNIKRNEMVAKHPVTRSHFTQDLQPEQGIKDSLQKVIPRTYGKCGHEKLQFKKCCKSVGEYEVHKGGYSEVNQCLSTTQNKIFQTHKYVKVFGKFSNSNRDKTRYTGNKHFKCNKYGKSFCMLSHLNQHQVIHTREKSYKCKECGKSFNCSSNHTTHKIIHTGEKPYRCEECGKAFSWSANLTRHKRTHTGEKPYTCEECGQAFRRSSALTNHKRIHTGERPYKCEECGKAFSVSSTLTDHKRIHTGEKPCRCEECGKAFSWSSNLTRHKRIHTREKPYACEECGQAFSLSSNLMRHRRIHTGEKPYTCEECGQDFRRSSALTIHKRIHTGERPYKCEECGKVFSLSSTLTDHKRIHTGERPYKCEECGKAFSLSSTLTDHKRIHTGERPYTCEECGKAFNCSSTLMQHKRIHTGEKPYKCEECEQAFKWHSSLAKHKIIHTGEKPYKCE

SEQ ID NO: 6841 - protein, 618 aa, Homo sapiens
MERAVEPWGPDLHRPEEREPQRGARTGLGSENVISQPNEFEHTPQEDDLGFKEEDLAPDHEVGNASLKPEGIQNWDDLWVQREGLGKPQPRDRGPRLLGEPRWGQASSDRAAVCGECGKSFRQMSDLVKHQRTHTGEKPYKCGVCGKGFGDSSARIKHQRTHSGEKPYRARPPAQGPPKIPRSRIPAGERPTICGECGKSFRQSSDLVKHQRTHTGEKPYKCGICGKGFGDSSARIKHQRTHRGEQPPRPVVPRRQPSRAATAATQGPKAQDKPYICTDCGKRFVLSCSLLSHQRSHLGPKPFGCDVCGKEFARGSDLVKHLRVHTGEKPYLCPECGKGFADSSARVKHLRTHSGERPHACPECDRTFSLSSTLLRHRLTHMEPQDFSFPGYPLPALIPSPPPPPLGTSPPLTPRSPSHSGEPFGLPGLEPEPGGPQAGEPPPPLAGDKPHKCPECGKGFRRSSDLVKHHRVHTGEKPYLCPECGKGFADSSARVKHLRTHRGERARPPPPSTLLRPHNPPGPVPMAPRPRVRAQPSGPSQPHVCGFCGKEFPRSSDLVKHRRTHTGEKPYKCAECGKGFGDSSARIKHQRGHLVLTPFGIGDGRARPLKQEAATGLE

SEQ ID NO: 6842 - protein, 143 aa, Homo sapiens
MERAVEPWGPDLHRPEEREPQRGARTGLGSENVISQPNEFEHTPQEDDLGFKEEDLAPDHEVGNASLKPEGIQNWDDLWVQREGLGKPQPRDRGPRLLGEPRWGQASSDRAAVCGECGKSFRQMSDLVKHQRTHTGEKPYKCG

SEQ ID NO: 6843 - protein, 147 aa, Homo sapiens
MERAVEPWGPDLHRPEEREPQRGARTGLGSENVISQPNEFEHTPQEDDLGFKEEDLAPDHEVGNASLKPEGIQNWDDLWVQREGLGKPQPRDRGPRLLGEPRWGQASSDRAAVCGECGKSFRQMSDLVKHQRTHTGEKPYKCGVCGK

SEQ ID NO: 6844 - protein, 744 aa, Homo sapiens
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTILPGEIRIWVKSQHPESSEEVVTLIEDLTQMLEEKDPVSQDSTVSQEENSKEDKMVTVCPNTESCESITLKDVAVNFSRGEWKKLEPFQKELYKEVLLENLRNLEFLDFPVSKLELISQLKWVELPWLLEEVSKSSRLDESALDKIIERCLRDDDHGLMEESQQYCGSSEEDHGNQGNSKGRVAQNKTLGSGSRGKKFDPDKSPFGHNFKETSDLIKHLRVYLRKKSRRYNESKKPFSFHSDLVLNRKEKTAGEKSRKSNDGGKVLSHSSALTEHQKRQKIHLGDRSQKCSKCGIIFIRRSTLSRRKTPMCEKCRKDSCQEAALNKDEGNESGEKTHKCSKCGKAFGYSASLTKHRRIHTGEKPYMCNECGKAFSDSSSLTPHHRTHSGEKPFKCDDCGKGFTLSAHLIKHQRIHTGEKPYKCKDCGRPFSDSSSLIQHQRIHTGEKPYTCSNCGKSFSHSSSLSKHQRIHTGEKPYKCGECGKAFRQNSCLTRHQRIHTGEKPYLCNDCGMTFSHFTSVIYHQRLHSGEKPYKCNQCEKAFPTHSLLSRHQRIHTGVKPYKCKECGKSFSQSSSLNEHHRIHTGEKPYECNYCGATFSRSSILVEHLKIHTGRREYECNECEKTFKSNSGLIRHRGFHSAE

SEQ ID NO: 6845 - protein, 244 aa, Homo sapiens
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTILPGEIRIWVKSQHPESSEEVVTLIEDLTQMLEEKDPVSQDSTVSQEENSKEDKMVTVCPNTESCESITLKDVAVNFSRGEWKKLEPFQKELYKEVLLENLRNLEFLDFPVSKLELISQLKWVELPWLLEEVSKSSRLGSVI

SEQ ID NO: 6846 - protein, 256 aa, Homo sapiens
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTILPGEIRIWVKSQHPESSEEVVTLIEDLTQMLEEKDPVSQDSTVSQEENSKEDKMVTVCPNTESCESITLKDVAVNFSRGEWKKLEPFQKELYKEVLLENLRNLEFLDFPVSKLELISQLKWVELPWLLEEVSKSSRLDIHGAVKKMQMFSEAE

SEQ ID NO: 6847 - protein, 178 aa, Homo sapiens
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTILPGEIRIWVKSQHPESSEEVVTLIEDLTQMLEEKGEIYRWREEAGDIASKSESKFLKRRQFTAKEESEVRSWDWV

SEQ ID NO: 6848 - protein, 816 aa, Homo sapiens
MLENYFNLISVGCQVPKPEVIFSLEQEEPCMLDGEIPSQSRPDGDIGFGPLQQRMSEEVSFQSEININLFTRDDPYSILEELWKDDEHTRKCGENQNKPLSRVVFINKKTLANDSIFEYKDIGEIVHVNTHLVSSRKRPHNCNSCGKNLEPIITLYNRNNATENSDKTIGDGDIFTHLNSHTEVTACECNQCGKPLHHKQALIQQQKIHTRESLYLFSDYVNVFSPKSHAFAHESICAEEKQHECHECEAVFTQKSQLDGSQRVYAGICTEYEKDFSLKSNRQKTPYEGNYYKCSDYGRAFIQKSDLFRCQRIHSGEKPYEYSECEKNLPQNSNLNIHKKIHTGGKHFECTECGKAFTRKSTLSMHQKIHTGEKPYVCTECGKAFIRKSHFITHERIHTGEKPYECSDCGKSFIKKSQLHVHQRIHTGENPFICSECGKVFTHKTNLIIHQKIHTGERPYICTVCGKAFTDRSNLIKHQKIHTGEKPYKCSDCGKSFTWKSRLRIHQKCHTGERHYECSECGKAFIQKSTLSMHQRIHRGEKPYVCTECGKAFFHKSHFITHERIHTGEKPYECSICGKSFTKKSQLHVHQQIHTGEKPYRCAECGKAFTDRSNLFTHQKIHTGEKPYKCSDCGKAFTRKSGLHIHQQSHTGERHYECSECGKAFARKSTLIMHQRIHTGEKPYICNECGKSFIQKSHLNRHRRIHTGEKPYECSDCGKSFIKKSQLHEHHRIHTGEKPYICAECGKAFTIRSNLIKHQKIHTKQKPYKCSDLGKALNWKPQLSMPQKSDNGEVECSMPQLWCGDSEGDQGQLSSI

SEQ ID NO: 6849 - protein, 852 aa, Homo sapiens
MTKSLESVSFKDVTVDFSRDEWQQLDLAQKSLYREVMLENYFNLISVGCQVPKPEVIFSLEQEEPCMLDGEIPSQSRPDGDIGFGPLQQRMSEEVSFQSEININLFTRDDPYSILEELWKDDEHTRKCGENQNKPLSRVVFINKKTLANDSIFEYKDIGEIVHVNTHLVSSRKRPHNCNSCGKNLEPIITLYNRNNATENSDKTIGDGDIFTHLNSHTEVTACECNQCGKPLHHKQALIQQQKIHTRESLYLFSDYVNVFSPKSHAFAHESICAEEKQHECHECEAVFTQKSQLDGSQRVYAGICTEYEKDFSLKSNRQKTPYEGNYYKCSDYGRAFIQKSDLFRCQRIHSGEKPYEYSECEKNLPQNSNLNIHKKIHTGGKHFECTECGKAFTRKSTLSMHQKIHTGEKPYVCTECGKAFIRKSHFITHERIHTGEKPYECSDCGKSFIKKSQLHVHQRIHTGENPFICSECGKVFTHKTNLIIHQKIHTGERPYICTVCGKAFTDRSNLIKHQKIHTGEKPYKCSDCGKSFTWKSRLRIHQKCHTGERHYECSECGKAFIQKSTLSMHQRIHRGEKPYVCTECGKAFFHKSHFITHERIHTGEKPYECSICGKSFTKKSQLHVHQQIHTGEKPYRCAECGKAFTDRSNLFTHQKIHTGEKPYKCSDCGKAFTRKSGLHIHQQSHTGERHYECSECGKAFARKSTLIMHQRIHTGEKPYICNECGKSFIQKSHLNRHRRIHTGEKPYECSDCGKSFIKKSQLHEHHRIHTGEKPYICAECGKAFTIRSNLIKHQKIHTKQKPYKCSDLGKALNWKPQLSMPQKSDNGEVECSMPQLWCGDSEGDQGQLSSI

SEQ ID NO: 6850 - protein, 816 aa, Homo sapiens; identical to SEQ ID NO: 6848

SEQ ID NO: 6851 - protein, 854 aa, Homo sapiens
MSVLSLPESVSFKDVTVDFSRDEWQQLDLAQKSLYREVMLENYFNLISVGCQVPKPEVIFSLEQEEPCMLDGEIPSQSRPDGDIGFGPLQQRMSEEVSFQSEININLFTRDDPYSILEELWKDDEHTRKCGENQNKPLSRVVFINKKTLANDSIFEYKDIGEIVHVNTHLVSSRKRPHNCNSCGKNLEPIITLYNRNNATENSDKTIGDGDIFTHLNSHTEVTACECNQCGKPLHHKQALIQQQKIHTRESLYLFSDYVNVFSPKSHAFAHESICAEEKQHECHECEAVFTQKSQLDGSQRVYAGICTEYEKDFSLKSNRQKTPYEGNYYKCSDYGRAFIQKSDLFRCQRIHSGEKPYEYSECEKNLPQNSNLNIHKKIHTGGKHFECTECGKAFTRKSTLSMHQKIHTGEKPYVCTECGKAFIRKSHFITHERIHTGEKPYECSDCGKSFIKKSQLHVHQRIHTGENPFICSECGKVFTHKTNLIIHQKIHTGERPYICTVCGKAFTDRSNLIKHQKIHTGEKPYKCSDCGKSFTWKSRLRIHQKCHTGERHYECSECGKAFIQKSTLSMHQRIHRGEKPYVCTECGKAFFHKSHFITHERIHTGEKPYECSICGKSFTKKSQLHVHQQIHTGEKPYRCAECGKAFTDRSNLFTHQKIHTGEKPYKCSDCGKAFTRKSGLHIHQQSHTGERHYECSECGKAFARKSTLIMHQRIHTGEKPYICNECGKSFIQKSHLNRHRRIHTGEKPYECSDCGKSFIKKSQLHEHHRIHTGEKPYICAECGKAFTIRSNLIKHQKIHTKQKPYKCSDLGKALNWKPQLSMPQKSDNGEVECSMPQLWCGDSEGDQGQLSSI

SEQ ID NO: 6852 - protein, 441 aa, Homo sapiens
MAPRAQIQGPLTFGDVAVAFTRIEWRHLDAAQRALYRDVMLENYGNLVSVGLLSSKPKLITQLEQGAEPWTEVREAPSGTHAVEDYWFETKMSALKQSTSEASVLGERTKSVMMEKGLDWEGRSSTEKNYKCKECGKVFKYNSSFISHQRNHTSEKPHKCKECGIAFMNSSSLLNHHKVHAGKQPYRCIECGKFLKKHSTFINHQRIHSREKPHKCIECGKTFRKNSILLSHQRIHTGQKPYKCNDCGKAFAQNAALTRHERIHSGEKPFKCNKCGRAFRDNSTVLEHQKIHTGEKPYQCNECGKAFRKSSTLISHQRMHTGEKPYHCSKCGKSFRYSSSFAGHQKTHSGNKPYQCRDCGKAFTKSSTLTGHQRIHTGEKPYHCKKCGKAFRHSSGLVEHQRLHTGEKPYKCNECGKAFPRSSALKQHKKIHNKERAMKCS

SEQ ID NO: 6853 - protein, 441 aa, Homo sapiens; identical to SEQ ID NO: 6852

SEQ ID NO: 6854 - protein, 350 aa, Homo sapiens
MSALKQSTSEASVLGERTKSVMMEKGLDWEGRSSTEKNYKCKECGKVFKYNSSFISHQRNHTSEKPHKCKECGIAFMNSSSLLNHHKVHAGKQPYRCIECGKFLKKHSTFINHQRIHSREKPHKCIECGKTFRKNSILLSHQRIHTGQKPYKCNDCGKAFAQNAALTRHERIHSGEKPFKCNKCGRAFRDNSTVLEHQKIHTGEKPYQCNECGKAFRKSSTLISHQRMHTGEKPYHCSKCGKSFRYSSSFAGHQKTHSGNKPYQCRDCGKAFTKSSTLTGHQRIHTGEKPYHCKKCGKAFRHSSGLVEHQRLHTGEKPYKCNECGKAFPRSSALKQHKKIHNKERAMKCS

SEQ ID NO: 6855 - protein, 117 aa, Homo sapiens
MAPRAQIQGPLTFGDVAVAFTRIEWRHLDAAQRALYRDVMLENYGNLVSVGLLSSKPKLITQLEQGAEPWTEVREAPSGTHAVEDYWFETKMSALKQSTSEASVLGERTKSVMMEKG

SEQ ID NO: 6856 - protein, 463 aa, Homo sapiens
MPGPLRSLEMESLQFRDVAVEFSLEEWHCLDTAQQNLYRDVMLENYRHLVFLGIIVSKPDLITCLEQGIKPLTMKRHEMIAKPPVVCSHFAQDLWPEQSIKDSYQKVILRKFEKCGHGNLHFKKGCESVDECKLHKRGYNGLNQCLTTTQSKIFQCGKYVKVFHQFSNSKRHKRRHTEKKPLKYIEGDKAFNQSSTHTTHKKIDTGEKPYKCEECGKAFNRSSHLTTHKITHTREKPYKCEECGKVFKYFSSFTTHKKIHSGEKPYICEECGKAFMYPYTLTTHKIIHTGEQPYKCKECDKAFNHPATLSSHKKIHTGEKPYTCDKCGKAFISSSILSKHEKIHTGEKPYKCEECGKAFTRSSHLTMHKIIHTGEKPYKCEECGKAFTWSAGLHKHRRTHTGEKPYKCEECGKAYTTSSNLTEHKTTHTGEKPYKCKECGKAFNWSSDLNKHKRIHIGQKPRT

SEQ ID NO: 6857 - protein, 502 aa, Homo sapiens
VSRCIWSSRSPLRYSVSSAPRGPPSVALCPVGIGRSTAKMPGPLRSLEMESLQFRDVAVEFSLEEWHCLDTAQQNLYRDVMLENYRHLVFLGIIVSKPDLITCLEQGIKPLTMKRHEMIAKPPVVCSHFAQDLWPEQSIKDSYQKVILRKFEKCGHGNLHFKKGCESVDECKLHKRGYNGLNQCLTTTQSKIFQCGKYVKVFHQFSNSKRHKRRHTEKKPLKYIEGDKAFNQSSTHTTHKKIDTGEKPYKCEECGKAFNRSSHLTTHKITHTREKPYKCEECGKVFKYFSSFTTHKKIHSGEKPYICEECGKAFMYPYTLTTHKIIHTGEQPYKCKECDKAFNHPATLSSHKKIHTGEKPYTCDKCGKAFISSSILSKHEKIHTGEKPYKCEECGKAFTRSSHLTMHKIIHTGEKPYKCEECGKAFTWSAGLHKHRRTHTGEKPYKCEECGKAYTTSSNLTEHKTTHTGEKPYKCKECGKAFNWSSDLNKHKRIHIGQKPRT

SEQ ID NO: 6858 - protein, 190 aa, Homo sapiens
  MOD_RES (1)..(1): Any amino acid
XRPRPRTPSRGPSDLRFRGEAGLRRVFLKKAGGSVSFSDVAVGFTQEEWQHLDSAQRTPYRDMMLENYSLLLSVGYCITKPEVVCKLEHGQVLWILEEESPSQSHLDCCIDDDLMEKRQENQDQHLQKVDFVNNKTLTMDRNGVLGKTFSLDTNPILSRKIRGNCDSSGMNLNNISELIISNRSSFVRNP

SEQ ID NO: 6859 - protein, 448 aa, Homo sapiens [sequence omitted]

SEQ ID NO: 6860 - protein, 208 aa, Homo sapiens
MMLENYSLLLSVGYCITKPEVVCKLEHGQVLWILEEESPSQSHLDCCIDDDLMEKRQENQDQHLQKVDFVNNKTLTMDRNGVLGKTFSLDTNPILSRKIRGNCDSSGMNLNNISELIISNRSSFVRNPAECNVRGKFLLCMKRENPYARGKPLEYDGNGKAVSQNEDLFRHQYIQTLKQCFEYNQCGKAFHEEAACSTHKRVCSWETL

SEQ ID NO: 6861 - protein, 139 aa, Homo sapiens
MMLENYSLLLSVGYCITKPEVVCKLEHGQVLWILEEESPSQSHLDCCIDDDLMEKRQENQDQHLQKVDFVNNKTLTMDRNGVLGKTFSLDTNPILSRKIRGNCDSSGMNLNNISELIISNRSSFVRNPAECNVRGKFLL

SEQ ID NO: 6862 - protein, 119 aa, Homo sapiens
MMLENYSLLLSVGYCITKPEVVCKLEHGQVLWILEEESPSQSHLDCCIDDDLMEKRQENQDQHLQKVDFVNNKTLTMDRNGVLGKTFSLDTNPILSRKIRGNCDSSGMNLNNISELIIS

SEQ ID NO: 6863 - protein, 340 aa, Homo sapiens
MPEWPPCLSVAPALVITMAAGKGAPLSPSAENRWRLSEPELGRGCKPVLLEKTNRLGPEAAVGRAGRDVGSAELALLVAPGKPRPGKPLPPKTRGEQRQSAFTELPRMKDRQVDAQAQEREHDDPTGQPGAPQLTQNIPRGPAGSKVFSVWPSGARSEQRSAFSKPTKRPAERPELTSVFPAGESADALGELSGLLNTTDLACWGRLSTPKLLVGDLWNLQALPQNAPLCSTFLGAPTLWLEHTQAQVPPPSSSSTTSWALLPPTLTSLGLSTQNWCAKCNLSFRLTSDLVFHMRSHHKKEHAGPDPHSQKRREEALACPVCQEHFRERHHLSRHMTSHS

SEQ ID NO: 6864 - protein, 73 aa, Homo sapiens
MPEWPPCLSVAPALVITMAAGKGAPLSPSAENRWRLSEPELGRGCKPVLLEKTNRLGPEAAVGRAGRDVGSAE

SEQ ID NO: 6865 - protein, 119 aa, Homo sapiens
MPEWPPCLSVAPALVITMAAGKGAPLSPSAENRWRLSEPELGRGCKPVLLEKTNRLGPEAAVGRAGRDVGSAELALLVAPGKPRPGKPLPPKTRGEQRQSAFTELPRMKDRQVDAQAQE

SEQ ID NO: 6866 - protein, 105 aa, Homo sapiens
MPEWPPCLSVAPALVITMAAGKGAPLSPSAENRWRLSEPELGRGCKPVLLEKTNRLGPEAAVGRAGRDVGSAELALLVAPGKPRPGKPLPPKTRGEQRQSAFTEL

SEQ ID NO: 6867 - protein, 86 aa, Homo sapiens
MPEWPPCLSVAPALVITMAAGKGAPLSPSAENRWRLSEPELGRGCKPVLLEKTNRLGPEAAVGRAGRDVGSAELALLVAPGKPRPG

SEQ ID NO: 6868 - protein, 69 aa, Homo sapiens
MPEWPPCLSVAPALVITMAAGKGAPLSPSAENRWRLSEPELGRGCKPVLLEKTNRLGPEAAVGRAGRDV

SEQ ID NO: 6869 - protein, 130 aa, Homo sapiens
MPEWPPCLSVAPALVITMAAGKGAPLSPSAENRWRLSEPELGRGCKPVLLEKTNRLGPEAAVGRAGRDVGSAELALLVAPGKPRPGKPLPPKTRGEQRQSAFTELPRMKDRQVDAQAQEREHDDPTGQPG

SEQ ID NO: 6870 - protein, 529 aa, Homo sapiens
MRRNSSLSFQMERPLEEQVQSKWSSSQGRTGTGGSDVLQMQNSEHHGQSIKTQTDSISLEDVAVNFTLEEWALLDPGQRNIYRDVMRATFKNLACIGEKWKDQDIEDEHKNQGRNLRSPMVEALCENKEDCPCGKSTSQIPDLNTNLETPTGLKPCDCSVCGEVFMHQVSLNRHMRSHTEQKPNECHEYGEKPHKCKECGKTFTRSSSIRTHERIHTGEKPYECKECGKAFAFLFSFRNHIRIHTGETPYECKECGKAFRYLTALRRHEKNHTGEKPYKCKQCGKAFIYYQPFLTHERTHTGEKPYECKQCGKAFSCPTYLRSHEKTHTGEKPFVCRECGRAFFSHSSLRKHVKTHTGVQPYTCKKCGEAFKSSSSCEVHERTHFGEKPYECKQCGKAFNSSSYLQLHERVHTGEKTYECKECGKAFLYSTHFRIHERTHTREKPYECKQCGRVFIYFSHLRRHERSHTGVKPCECKQCGKAFTCLNSLKVHKRIHTGERPFQCRQCGKAFSYSKSLHVHERTHSRQKP

SEQ ID NO: 6871 - protein, 437 aa, Homo sapiens
MGERLFESAEGSQCGETFTQVPEDMLNKKTLPGVKSCESGTCGEIFMGYSSFNRNIRTDTGHQPHKCQKFLEKPYKHKQRRKALSHSHCFRTHERPHTREKPFDCKECEKSFISPASIRRYMVTHSGDGPYKCKFCGKALDCLSLYLTHERTHTGEKRYECKQCGKAFSWHSSVRIHERTHTGEKPYECKECGKSFNFSSSFRRHERTHTGEKPYKCKECGKAFNCPSSFHRHERTHTGEKPYECKLYGKALSRLISFRRHMRMHTGERPHKCKICGKAFYSPSSFQRHERSHTGEKPYKCKQCGKAFTCSTSFQYHERTHTGEKPDGCKQCGKAFRSAKYIRIHGRTHTGEKPYECKQCGKAFHCVSSFHRHERTHAGEKPYECKHCGKAFTCSIYIRIHERIHTGEKPYQCKECGKAFIRSSYCRKHERTHTINI

SEQ ID NO: 6872 - protein, 139 aa, Homo sapiens
MGERLFESAEGSQCGETFTQVPEDMLNKKTLPGVKSCESGTCGEIFMGYSSFNRNIRTDTGHQPHKCQKFLEKPYKHKQRRKALSHSHCFRTHERPHTREKPFDCKECEKSFISPASIRRYMVTHSGDGPYKCKFCGKA

SEQ ID NO: 6873 - protein, 409 aa, Homo sapiens
MGERLFESAEGSQCGETFTQVPEDMLNKKTLPGVKSCESGTCGEIFMGYSSFNRNIRTDTGHQPHKCQKFLEKPYKHKQRRKALSHSHCFRTHERPHTREKPFDCKECEKSFISPASIRRYMVTHSGDGPYKCKFCGKALDCLSLYLTHERTHTGEKRYECKQCGKAFSWHSSVRIHERTHTGEKPYECKECGKSFNFSSSFRRHERTHTGEKPYECKLYGKALSRLISFRRHMRMHTGERPHKCKICGKAFYSPSSFQRHERSHTGEKPYKCKQCGKAFTCSTSFQYHERTHTGEKPDGCKQCGKAFRSAKYIRIHGRTHTGEKPYECKQCGKAFHCVSSFHRHERTHAGEKPYECKHCGKAFTCSIYIRIHERIHTGEKPYQCKECGKAFIRSSYCRKHERTHTINI

SEQ ID NO: 6874 - protein, 531 aa, Homo sapiens
MLENYRNLVFVGIAASKPDLITCLEQGKEPWNVKRHEMVAEPPVVCSYFARDLWPKQGKKNYFQKVILRRYKKCGCENLQLRKYCKSMDECKVHKECYNGLNQCLTTTQNKIFQCDKYVKVFHKFSNSNRHTIRHTGKKSFKCKECEKSFCMLSHLAQHKRIHSGEKPYKCKECGKAYNETSNLSTHKRIHTGKKPYKCEECGKAFNRLSHLTTHKIIHTGKKPYKCEECGKAFNQSANLTTHKRIHTGEKPYKCEECGRAFSQSSTLTAHKIIHAGEKPYKCEECGKAFSQSSTLTTHKIIHTGEKFYKCEECGKAFSQLSHLTTHKRIHSGEKPYKCEECGKAFKQSSTLTTHKRIHAGEKFYKCEVCSKAFSRFSHLTTHKRIHTGEKPYKCEECGKAFNLSSQLTTHKIIHTGEKPYKCEECGKAFNQSSTLSKHKVIHTGEKPYKYEECGKAFNQSSHLTTHKMIHTGEKPYKCEECGKAFNNSSILNRHKMIHTGEKLYKPESCNNACDNIAKISKYKRNCAGEK

SEQ ID NO: 6875 - protein, 646 aa, Homo sapiens
MNECNVHKEGYNELNQYLTTTQSKIFQCDKYVKVFHKLLNSNRHNTKHTGKKPFKCKKCGKSFCMLLHLCQHKRIHIRENSYRCEECGKAFIWFSTLTRHRRVHTGEKSYKYECGKSFNQDSNLTTHKRIHTGQKPYKCEECGTSFYQFSYLTRHKLIHTREKPYKCEQYGKTFNQSSTLTGHKIIHNGEKPYKCEECGKAFSIFSTPTKHKIIHTEEKSHRCEEYCKAYKESSHLTTHKRIHTGEKPYKCEECGKAFSIFSTLTKHKIIHTEEKSHRCEECGKAYKESSHLTTHKRIHTGEKPYKCEECGKTFSVFSILTKHKIIHTEEKPYKCEECGKAFKRSSTLTKHRIIHTEEKPYKCEECGKAFNQSSTLSIHKIIHTGEKPYKCEECGKAFKRSSTLTIHKMIHTGEKPYKCEECGKAFNRSSHLTTHKRIHTGHKPYKCKECGKSFSVFSTLTKHKIIHTDKKPYKCEECGKAFNRSSILSIHKKIHTGEKPYKCEECGKAFKRSSHLAGHKQIHSVQKPYKCEECGKAFSIFSTLTKHKIIHTEEKPYKCEKCGKTFYRFSNLNTHKIIHTGEKPCKCEECGKAFNHSSNLIKHKLIHTGDKPYKCEACGKAFRRSSHLSRHKIIHIGIHTEETVQK

SEQ ID NO: 6876 - protein, 774 aa, Homo sapiens
MPGPPESLDMGPLTFRDVAIEFSLEEWQCLDTAQQDLYRKVMLENYRNLVFLGIAVSKPDLVTCLEQGKDPWNMKGHSTVVKPPVICSHFAEDFCPGPGIKDSFQKVILREYVKCGHKDLQLRKGCKSMNECNVHKEGYNELNQYLTTTQSKIFQCDKYVKVFHKLLNSNRHNTKHTGKKPFKCKKCGKSFCMLLHLCQHKRIHIRENSYRCEECGKAFIWFSTLTRHRRVHTGEKSYKYECGKSFNQDSNLTTHKRIHTGQKPYKCEECGTSFYQFSYLTRHKLIHTREKPYKCEQYGKTFNQSSTLTGHKIIHNGEKPYKCEECGKAFSIFSTPTKHKIIHTEEKSHRCEEYCKAYKESSHLTTHKRIHTGEKPYKCEECGKAFSIFSTLTKHKIIHTEEKSHRCEECGKAYKESSHLTTHKRIHTGEKPYKCEECGKTFSVFSILTKHKIIHTEEKPYKCEECGKAFKRSSTLTKHRIIHTEEKPYKCEECGKAFNQSSTLSIHKIIHTGEKPYKCEECGKAFKRSSTLTIHKMIHTGEKPYKCEECGKAFNRSSHLTTHKRIHTGHKPYKCKECGKSFSVFSTLTKHKIIHTDKKPYKCEECGKAFNRSSILSIHKKIHTGEKPYKCEECGKAFKRSSHLAGHKQIHSVQKPYKCEECGKAFSIFSTLTKHKIIHTEEKPYKCEKCGKTFYRFSNLNTHKIIHTGEKPCKCEECGKAFNHSSNLIKHKLIHTGDKPYKCEACGKAFRRSSHLSRHKIIHIGIHTEETVQK

SEQ ID NO: 6877 - protein, 103 aa, Homo sapiens
MPGPPESLDMGPLTFRDVAIEFSLEEWQCLDTAQQDLYRKVMLENYRNLVFLAGIAVSKPDLVTCLEQGKDPWNMKGHSTVVKPPVETGFHRFSQDGLYLLTS

SEQ ID NO: 6878 - protein, 498 aa, Homo sapiens
MESPRGWTLQVAPEEGQVLCNVKTATRGLSEGAVSGGWGAWENSTEVPREAGDGQRQQATLGAADEQGGPGRELGPADGGRDGAGPRSEPADRALRPSPLPEEPGCRCGECGKAFSQGSYLLQHRRVHTGEKPYTCPECGKAFAWSSNLSQHQRIHSGEKPYACRECGKAFRAHSQLIHHQETHSGLKPFRCPDCGKSFGRSTTLVQHRRTHTGEKPYECPECGKAFSWNSNFLEHRRVHTGARPHACRDCGKAFSQSSNLAEHLKIHAGARPHACPDCGKAFVRVAGLRQHRRTHSSEKPFPCAECGKAFRESSQLLQHQRTHTGERPFECAECGQAFVMGSYLAEHRRVHTGEKPHACAQCGKAFSQRSNLLSHRRTHSGAKPFACADCGKAFRGSSGLAHHRLSHTGERPFACAECGKAFRGSSELRQHQRLHSGERPFVCAHCSKAFVRKSELLSHRRTHTGERPYACGECGKPFSHRCNLNEHQKRHGGRAAP

SEQ ID NO: 6879 - protein, 225 aa, Homo sapiens
HSGEKPYACRECGKAFRAHSQLIHHQETHSGLKPFRCPDCGKSFGRSTTLVQHRRTHTGEKPYECPECGKAFVRVAGLRQHRRTHSSEKPFPCAECGKAFRESSQLLQHQRTHTGERPFECAECGQAFVMGSYLAEHRRVHTGEKPHACAQCGKAFSQRSNLLSHRRTHSGAKPFACADCGKAFRGSSGLAHHRLSHTGERPFACAECGKAFRGSSELRQHQRLH

SEQ ID NO: 6880 - protein, 498 aa, Homo sapiens; identical to SEQ ID NO: 6878

SEQ ID NO: 6881 - protein, 472 aa, Homo sapiens
MLKEHPEMAEAPQQQLGIPVVKLEKELPWGRGREDPSPETFRLRFRQFRYQEAAGPQEALRELQELCRRWLRPELHTKEQILELLVLEQFLTILPREFYAWIREHGPESGKALAAMVEDLTERALEAKAVPCHRQGEQEETALCRGAWEPGIQLGPVEVKPEWGMPPGEGVQGPDPGTEEQLSQDPGDETRAFQEQGGGSKEKEAKPPQEDLKGALVALTSERFGEASLQGPGLGRVCEQEPGGPAGSAPGLPPPQHGAIPLPDEVKTHSSFWKPFQCPECGKGFSRSSNLVRHQRTHEEKSYGCVECGKGFTLREYLMKHQRTHLGKRPYVCSECWKTFSQRHHLEVHQRSHTGEKPYKCGDCWKSFSRRQHLQVHRRTHTGEKPYTCECGKSFSRNANLAVHRRAHTGEKPYGCQVCGKRFSKGERLVRHQRIHTGEKPYHCPACGRSFNQRSILNRHQKTQHRQEPLVQ

SEQ ID NO: 6882 - protein, 544 aa, Homo sapiens
MLKEHPEMAEAPQQQLGIPVVKLEKELPWGRGREDPSPETFRLRFRQFRYQEAAGPQEALRELQELCRRWLRPELHTKEQILELLVLEQFLTILPREFYAWIREHGPESGKALAAMVEDLTERALEAKAVPCHRQGEQEETALCRGAWEPGIQLGPVEVKPEWGMPPGEGVQGPDPGTEEQLSQDPGDETRAFQEQALPVLQAGPGLPAVNPRDQEMAAGFFTAGSQGLGPFKDMALAFPEEEWRHVTPAQIDCFGEYVEPQDCRVSPGGGSKEKEAKPPQEDLKGALVALTSERFGEASLQGPGLGRVCEQEPGGPAGSAPGLPPPQHGAIPLPDEVKTHSSFWKPFQCPECGKGFSRSSNLVRHQRTHEEKSYGCVECGKGFTLREYLMKHQRTHLGKRPYVCSECWKTFSQRHHLEVHQRSHTGEKPYKCGDCWKSFSRRQHLQVHRRTHTGEKPYTCECGKSFSRNANLAVHRRAHTGEKPYGCQVCGKRFSKGERLVRHQRIHTGEKPYHCPACGRSFNQRSILNRHQKTQHRQEPLVQ

SEQ ID NO: 6883 - protein, 544 aa, Homo sapiens; identical to SEQ ID NO: 6882

SEQ ID NO: 6884 - protein, 70 aa, Homo sapiens
MLKEHPEMAEAPQQQLGIPVVKLEKELPWGRGREDPSPETFRLRFRQFRYQEAAGPQEALRELQELCRRW

SEQ ID NO: 6885 - protein, 480 aa, Homo sapiens
MATVPGLQPLPTLEQDLEQEEILIVKVEEDFCLEEEPSVETEDPSPETFRQLFRLFCYQEVAGPREALSRLWELCCRWLRPELRTKEQILELLVLEQFLTVLPGEIQARVREQQPESGEEAVVLVEGLQRKPRKHRQRGSELLSDDEVPLGIGGQFLKHQAEAQPEDLSLEEEARFSSQQPPAQLSHRPQRGPLLWPERGPPAPRHQEMASASPFLSAWSQVPVNLEDVAVYLSGEEPRCMDPAQRDAPLENEGPGIQLEDGGDGREDAPLRMEWYRVLSARCQGPGHPLPGQRPAPVRGLVRPDQPRGGPPPGRRASHGADKPYTCPECGKGFSKTSHLTKHQRTHTGERPYKCLVCGKGFSDRSNFSTHQRVHTGEKPYPCPECGKRFSQSSSLVIHRRTHSGERPYACTQCGKRFNNSSHFSAHRRTHTGEKPYTCPACGRGFRRGTDLHKHQRTHMGAGSLPTLQPVAPGGPGAKA

SEQ ID NO: 6886 - protein, 441 aa, Homo sapiens
MATVPGLQPLPTLEQDLEQEEILIVKVEEDFCLEEEPSVETEDPSPETFRQLFRLFCYQEVAGPREALSRLWELCCRWLRPELRTKEQILELLVLEQFLTVLPGEIQARVREQQPESGEEAVVLVEGLQRKPRKHRQRGSELLSDDEVPLGIGGQFLKHQAEAQPEDLSLEEEARFSSQQPPAQLSHRPQRGPLLWPERGPPAPRHQEMASASPFLSAWSQVPVNLEDVAVYLSGEEPRCMDPAQRDAPLENEGPGIQLEDGGDGREDAPLRMEWYRVLSARCQGPGHPLPGQRPAPVRGLVRPDQPRGGPPPGRRASHGADKPYTCPECGKGFSKTSHLTKHQRTHTGERPYKCLVCGKGFSDRSNFSTHQRVHTGEKPYPCPECGKRFSQSSSLVIHRRTHSGERPYACTQCGKRFNNSSHFSAHRRTHTGHILRSGCT

SEQ ID NO: 6887 - protein, 215 aa, Homo sapiens
MNSSQISLRMKHGRVNMQKKPSKCSECGKFFTQRSSLTQHQRIHRGEKPYVCSECGSCFRKQSNLTQHLRIHTGEKPYKCNECEKAFQTKAILVQHLRIHTGEKPYKCNECGKAFCQSPSLIKHQRIHTGEKPYTCTECGKAFTQNSSLVEHERTHTGEKLYKCSECEKTFRKQAHLSEHYRIHTGEKPYECVGCGKSFRHSSALLRHQRLHAGE

SEQ ID NO: 6888 - protein, 271 aa, Homo sapiens
MNSSQISLRMKHGRVNMQKKPSKCSECGKFFTQRSSLTQHQRIHRGEKPYVCSECGSCFRKQSNLTQHLRIHTGEKPYKCNECEKAFQTKAILVQHLRIHTGEKPYKCNECGKAFCQSPSLIKHQRIHTGEKPYKCTECGKAFSQSICLTRHQRSHSGDKPFKCNECGKAFNQSACLMQHQRIHSGEKPYTCTECGKAFTQNSSLVEHERTHTGEKLYKCSECEKTFRKQAHLSEHYRIHTGEKPYECVGCGKSFRHSSALLRHQRLHAGE

SEQ ID NO: 6889 - protein, 544 aa, Homo sapiens
MLNMQGAEERDIRRETCPGWVNKNKPALEQDVCKIDSSGIVVKRFQEDEYQDSTFEEKYACEGMKENSPREIAESCLFQEGGFGRITFIHKEAPPEIISQGYNFEKSLLLTSSLVTRLRVSTEESLHQWETSNIQTNDISDQSKCPTLCTQKKSWKCNECGKTFTQSSSLTQHQRTHTGERPYTCEECGKAFSRSSFLVQHQRIHTGVKPYGCEQCGKTFRCRSFLTQHQRIHTGEKPYKCNECGNSFRNHSHLTEHQRIHTGEKPYKCNRCGKAFNQNTHLIHHQRIHTGEKPYICSECGSSFRKHSNLTQHQRIHTGEKPHKCDECGKTFQTKANLSQHQRIHSGEKPYKCKECGKAFCQSPSLIKHQRIHTGEKPYKCKECGKAFTQSTPLTKHQRIHTGERPYKCSECGKAFIQSICLIRHQRSHTGEKPYKCNECGKGFNQNTCLTQHMRIHTGEKPYKCKECGKAFAHSSSLTEHHRTHTGEKLYKCSECEKTFRKYAHLSEHYRIHTGEKPYECIECGKFFRHSSVLFRHQKLHSGD

SEQ ID NO: 6890 - protein, 155 aa, Homo sapiens
MLNMQGAEERDIRRETCPGWVNKNKPALEQDVCKIDSSGIVVKRFQEDEYQDSTFEEKYACEGMKENSPREIAESCLFQEGGFGRITFIHKEAPPEIISQGYNFEKSLLLTSSLVTRLRVSTEESLHQWETSNIQTNDISDQSKCPTLCTQKKSW

SEQ ID NO: 6891 - protein, 453 aa, Homo sapiens
MLNMQGAEERDIRRETCPGWVNKNKPALEQDVCKIDSSGIVVKRFQEDEYQDSTFEEKYACEGMKENSPREIAESCLFQEGGFGRITFIHKEAPPEIISQGYNFEKSLLLTSSLVTRLRVSTEESLHQWETSNIQTNDISDQSKCPTLCTQKKSWKCNECGKTFTQSSSLTQHQRTHTGERPYTCEECGKAFSRSSFLVQHQRIHTGVKPYGCEQCGKHFDVDHFLLSIKEFTLERNLINAMNVGIPSAITHISLNTREFTLERNLINAIGVGRHSIRIHTLFIIREFTLVRSLTYAVNVALLFENTQILRNIREFTLGKNPINVTNVGKLSKQRQTSLSIREFIVERNPINVKNVAKPFVRAHLLLNTSEFILEKNHISVKNVAKRLLRAPHSLNIREYIQGRDPTNAVNVVKPSFRAFALFGTREVTLEKNPINAMNVERALIRTPASLSI

SEQ ID NO: 6892 - protein, 544 aa, Homo sapiens; identical to SEQ ID NO: 6889

SEQ ID NO: 6893 - protein, 544 aa, Homo sapiens; identical to SEQ ID NO: 6889

SEQ ID NO: 6894 - protein, 444 aa, Homo sapiens
MGPLQFRDVAIEFSLEEWHCLDAAQRNLYRDVMLENYRNLIFLGIVVSKPNLITCLEQGKKPLTMKRHEMIAKPPVMYSHFAQDLWSEQSIKDSFQKVILRRYEKCRHDNLQLKKGCESVDECPVHKRGYNGLKQCLATTQRKIFQCDEYVKFLHKFSNSNKHKIRDTGKKSFKCIEYGKTFNQSSTRTTYKKIDAGEKRYKCEECGKAYKQSSHLTTHKKIHTGEKPYKCEECGKAYKQSCNLTTHKIIHTGEKPYRCRECGKAFNHPATLFSHKKIHTGEKPYKCDKCGKAFISSSTLTKHEIIHTGEKPYKCEECGKAFNRSSNLTKHKRIHTGDVPYKCDECGKTFTWYSSLSKHKRAHTGEKPYKCEECGKAFTAFSTLTEHKIIHTGEKPYKCEECGKAFNWSSALNKHKKIHIRQKPCIVKNVENLLNVPQPLISIR

SEQ ID NO: 6895 - protein, 412 aa, Homo sapiens
MGPLQFRDVAIEFSLEEWHCLDAAQRNLYRDVMLENYRNLIFLVMYSHFAQDLWSEQSIKDSFQKVILRRYEKCRHDNLQLKKGCESVDECPVHKRGYNGLKQCLATTQRKIFQCDEYVKFLHKFSNSNKHKIRDTGKKSFKCIEYGKTFNQSSTRTTYKKIDAGEKRYKCEECGKAYKQSSHLTTHKKIHTGEKPYKCEECGKAYKQSCNLTTHKIIHTGEKPYRCRECGKAFNHPATLFSHKKIHTGEKPYKCDKCGKAFISSSTLTKHEIIHTGEKPYKCEECGKAFNRSSNLTKHKRIHTGDVPYKCDECGKTFTWYSSLSKHKRAHTGEKPYKCEECGKAFTAFSTLTEHKIIHTGEKPYKCEECGKAFNWSSALNKHKKIHIRQKPCIVKNVENLLNVPQPLISIR

SEQ ID NO: 6896 - protein, 444 aa, Homo sapiens; identical to SEQ ID NO: 6894

SEQ ID NO: 6897 - protein, 78 aa, Homo sapiens
MGPLQFRDVAIEFSLEEWHCLDAAQRNLYRDVMLENYRNLIFLGIVVSKPNLITCLEQGKKPLTMKRHEMIAKPPGGL

SEQ ID NO: 6898 - protein, 953 aa, Homo sapiens
MEESSSVAMLVPDIGEQEAILTAESIISPSLEIDEQRKTKPDPLIHVIQKLSKIVENEKSQKCLLIGKKRPRSSAATHSLETQELCEIPAKVIQSPAADTRRAEMSQTNFTPDTLAQNEGKAMSYQCSLCKFLSSSFSVLKDHIKQHGQQNEVILMCSECHITSRSQEELEAHVVNDHDNDANIHTQSKAQQCVSPSSSLCRKTTERNETIPDIPVSVDNLQTHTVQTASVAEMGRRKWYAYEQYGMYRCLFCSYTCGQQRMLKTHAWKHAGEVDCSYPIFENENEPLGLLDSSAAAAPGGVDAVVIAIGESELSIHNGPSVQVQICSSEQLSSSSPLEQSAERGVHLSQSVTLDPNEEEMLEVISDAEENLIPDSLLTSAQKIISSSPNKKGHVNVIVERLPSAEETLSQKRFLMNTEMEEGKDLSLTEAQIGREGMDDVYRADKCTVDIGGLIIGWSSSEKKDELMNKGLATDENAPPGRRRTNSESLRLHSLAAEALVTMPIRAAELTRANLGHYGDINLLDPDTSQRQVDSTLAAYSKMMSPLKNSSDGLTSLNQSNSTLVALPEGRQELSDGQVKTGISMSLLTVIEKLRERTDQNASDDDILKELQDNAQCQPNSDTSLSGNNVVEYIPNAERPYRCRLCHYTSGNKGYIKQHLRVHRQRQPYQCPICEHIADNSKDLESHMIHHCKTRIYQCKQCEESFHYKSQLRNHEREQHSLPDTLSIATSNEPRISSDTADGKCVQEGNKSSVQKQYRCDVCDYTSTTYVGVRNHRRIHNSDKPYRCSLCGYVCSHPPSLKSHMWKHASDQNYNYEQVNKAINDAISQSGRVLGKSPGKTQLKSSEESADPVTGSSENAVSSSELMSQTPSEVLGTNENEKLSPTSNTSYSLEKISSLAPPSMEYCVLLFCCCICGFESTSKENLLDHMKEHEGEIVNIILNKDHNTALNTN

SEQ ID NO: 6899 - protein, 953 aa, Homo sapiens; identical to SEQ ID NO: 6898

SEQ ID NO: 6900 - protein, 957 aa, Homo sapiens
MEESSSVAMLVPDIGEQEAILTAESIISPSLEIDEQRKTKPDPLIHVIQKLSKIVENEKSQKCLLIGKKRPRSSAATHSLETQELCEIPAKVIQSPAADTRRAEMSQTNFTPDTLAQNEGKAMSYQCSLCKFLSSSFSVLKDHIKQHGQQNEVILMCSECHITSRSQEELEAHVVNDHDNDANIHTQSKAQQCVSPSSSLCRKTTERNETIPDIPVSVDNLQTHTVQTASVAEMGRRKWYAYEQYGMYRCLFCSYTCGQQRMLKTHAWKHAGEVDCSYPIFENENEPLGLLDSSAAAAPGGVDAVVIAIGESELSIHNGPSVQVQICSSEQLSSSSPLEQSAERGVHLSQSVTLDPNEEEMLEVISDAEENLIPDSLLTSAQKIISSSPNKKGHVNVIVERLPSAEETLSQKRFLMNTEMEEGKDLSLTEAQIGREGMDDVYRADKCTVDIGGLIIGWSSSEKKDELMNKGLATDENAPPGRRRTNSESLRLHSLAAEALVTMPIRAAELTRANLGHYGDINLLDPDTSQRQVDSTLAAYSKMMSPLKNSSDGLTSLNQSNSTLVALPEGRQELSDGQVKTGISMSLLTVIEKLRERTDQNASDDDILKELQDNAQCQPNSDTSLSGNNVVEYIPNAERPYRCRLCHYTSGNKGYIKQHLRVHRQRQPYQCPICEHIADNSKDLESHMIHHCKTRIYQCKQCEESFHYKSQLRNHEREQHSLPDTLSIATSNEPRISSDTADGKCVQEGNKSSVQKQYRCDVCDYTSTTYVGVRNHRRIHNSDKPYRKEFRCSLCGYVCSHPPSLKSHMWKHASDQNYNYEQVNKAINDAISQSGRVLGKSPGKTQLKSSEESADPVTGSSENAVSSSELMSQTPSEVLGTNENEKLSPTSNTSYSLEKISSLAPPSMEYCVLLFCCCICGFESTSKENLLDHMKEHEGEIVNIILNKDHNTALNTN

SEQ ID NO: 6901 - protein, 683 aa, Homo sapiens
MSPHPEAITDCVTLNTVGQLAEGGYPLRFSTLFQEQQKMNISQASVSFKDVTIEFTQEEWQQMAPVQKNLYRDVMLENYSNLVSVGYCCFKPEVIFKLEQGEEPWFSEEEFSNQSHPKDYRGDDLIKQNKKIKDKHLEQAICINNKTLTTEEEKVLGKPFTLHVAAVASTKMSCKCNSWEVNLQSISEFIINNRNYSTKKIGCGNVCENSPFKINFEKTQTGEKFYEHNKNMKALNYNENLPKHPKFQTLEQAFECNKIGKAFNDKANCVKHNSSHTGETSSKDDEFRKNCDKKTLFDHRRTGTGKKHLHLNQCGKSFEKSTVEEYNKLNMGIKHYELNPSGNNFNRKAHLTDPQTAVIEENPLVSNDRTQTWVKSSEYHENKKSYQTSVHRVRRRSHSMMKPYKCNECGKSFCQKGHLIQHQRTHTGEKPFECSECGKTFSQKSHLSTHQRIHTAEKPYKCNECGKTFVQKSTLRGHQRIHTGEKPYECSECGKTFVQKSTLRDHHRIHTGEKSFQCNQCGKTFGQKSNLRIHQRTHTGEKTYQCNECEKSFWRKDHLIQHQKTHTGEKPFKCNECGKTFARTSTLRVHQRIHTGEKPFKCNECGKKFVRKAILSDHQRIHTGEKPFQCNKCGKTFGQKSNLRIHQRTHSGEKSYECNEYGKLCKKSTLSLYQKIQGEGNPY

SEQ ID NO: 6902 - protein, 134 aa, Homo sapiens
MSPHPEAITDCVTLNTVGQLAEGGYPLRFSTLFQEQQKMNISQASVSFKDVTIEFTQEEWQQMAPVQKNLYRDVMLENYSNLVSVGYCCFKPEVIFKLEQGEEPWFSEEEFSNQSHPSELLSSSRHNSAGVVRL

SEQ ID NO: 6903 - protein, 683 aa, Homo sapiens; identical to SEQ ID NO: 6901

SEQ ID NO: 6904 - protein, 262 aa, Homo sapiens
MQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGERRIYRHRSVSELFLKPVLNMCSVLRILGCTWAAALLILNSER

SEQ ID NO: 6905 - protein, 252 aa, Homo sapiens
MQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGERRIYRHRIPSTICFGQGAARGFKSNKKKTKQC

SEQ ID NO: 6906 - protein, 310 aa, Homo sapiens
MQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGERRIYRHRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGHVLSPEPDHDSLYHPPPEEDQGEERPRLWVMPNHQVLLGPEEDQDHIYHPQ

SEQ ID NO: 6907 - protein, 567 aa, Homo sapiens
MSSRLGAVPATSGPTTFKQQRSTRIVGAKNSRTQCSIKDNSFQYTIPHDDSLSGSSSASSCEPVSDFPASFRKSTYWMKMRRIKPAATSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHKRGRK

SEQ ID NO: 6908 - protein, 566 aa, Homo sapiens
MSSRLGAVPATSGPTTFKQQRSTRIVGAKNRTQCSIKDNSFQYTIPHDDSLSGSSSASSCEPVSDFPASFRKSTYWMKMRRIKPAATSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHKRGRK

SEQ ID NO: 6909 - protein, 490 aa, Homo sapiens
MKMRRIKPAATSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHKRGRK

SEQ ID NO: 6910 - protein, 538 aa, Homo sapiens
MSSRLGAVPATSGPTTFKQQRSTRIVGAKNRTQCSIKDNSFQYTIPHDDSLSGSSSASSCEPVSDFPASFRKSTYWMKMRRIKPAATSHVEGSGGVSAKGKRKPRQEEDEDYREFPQKKHKLYGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHKRGRK

SEQ ID NO: 6911 - protein, 385 aa, Homo sapiens
MSKGQVEYQPRGKGNPGRKKMKTIENFLRRSISFMGGSNGLKLSPIPNPRPVVFGRNHQFMQQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRGSQDTCMPKALHRM

SEQ ID NO: 6912 - protein, 892 aa, Homo sapiens
MTDPFCVGGRRLPGSSKSGPGKDGSRKEVRLPMLHDPPKMGMPVVRGGQTVPGQAPLCFDPGSPASDKTEGKKKGRPKAENQALRDIPLSLMNDWKDEFKAHSRVKCPNSGCWLEFPSIYGLKYHYQRCQGGAISDRLAFPCPFCEAAFTSKTQLEKHRIWNHMDRPLPASKPGPISRPVTISRPVGVSKPIGVSKPVTIGKPVGVSKPIGISKPVSVGRPMPVTKAIPVTRPVPVTKPVTVSRPMPVTKAMPVTKPITVTKSVPVTKPVPVTKPITVTKLVTVTKPVPVTKPVTVSRPIVVSKPVTVSRPIAISRHTPPCKMVLLTRSENKAPRATGRNSGKKRAADSLDTCPIPPKQARPENGEYGPSSMGQSSAFQLSADTSSGSLSPGSRPSGGMEALKAAGPASPPEEDPERTKHRRKQKTPKKFTGEQPSISGTFGLKGLVKAEDKARVHRSKKQEGPGPEDARKKVPAAPITVSKEAPAPVAHPAPGGPEEQWQRAIHERGEAVCPTCNVVTRKTLVGLKKHMEVCQKLQDALKCQHCRKQFKSKAGLNYHTMAEHSAKPSDAEASEGGEQEERERLRKVLKQMGRLRCPQEGCGAAFSSLMGYQYHQRRCGKPPCEVDSPSFPCTHCGKTYRSKAGHDYHVRSEHTAPPPEEPTDKSPEAEDPLGVERTPSGRVRRTSAQVAVFHLQEIAEDELARDWTKRRMKDDLVPETARLNYTRPGLPTLNPQLLEAWKNEVKEKGHVNCPNDCCEAIYSSVSGLKAHLASCSKGAHLAGKYRCLLCPKEFSSESGVKYHILKTHAENWFRTSADPPPKHRSQDSLVPKKEKKKNLAGGKKRGRKPKERTPEEPVAKLPPRRDDWPPGCRDKGARGSTGRKVGVSKAPEK

SEQ ID NO: 6913 - protein, 892 aa, Homo sapiens; identical to SEQ ID NO: 6912

SEQ ID NO: 6914 - protein, 892 aa, Homo sapiens; identical to SEQ ID NO: 6912

SEQ ID NO: 6915 - protein, 400 aa, Homo sapiens
MTFEDVAVEFSQWEWGQLNPAQKDLYREVMLENFRNLAILGLLVSKPYVICQLEEGGEPFMVEREISTGAHSDWKRRSKSKESMPSWGISKEELFQVVSVEKHIQDVLQFSKLKAACGCDGQLEMQQIKQERHLKQMSTIHKSATTLSRDYKWNGFGRSLGLRSVLVNQHSILMGEGSYKCDTEFRQTLGGNNSQRTHPEKKSCKCNECGKSFHFQSELRRHQRCHTGEKPYECSDCGRAFGHISSLIKHQRTHTGEKPYECSECGRAFSQSSSLVLHYRFHTGEKPYKCNECGRAFGHTSSLIKHQRTHTGEKPYECRECGRTFSQSSSLIVHYRFHTGEKPYKCNKCGRAFSQSSSLTQHYRFHTGEKPYKCNECGRAFAHTASLIKHQRSHAGKKTL

SEQ ID NO: 6916 - protein, 400 aa, Homo sapiens; identical to SEQ ID NO: 6915

SEQ ID NO: 6917 - protein, 53 aa, Homo sapiens
QSELRRHQRCHTGEKPYECSDCGRAFGHISSLIKHQLILEKSPMNAVNVGEPS

SEQ ID NO: 6918 - protein, 1163 aa, Homo sapiens
MDRNREAEMELRRGPSPTRAGRGHEVDGDKATCHTCCICGKSFPFQSSLSQHMRKHTGEKPYKCPYCDHRASQKGNLKIHIRSHRTGTLIQGHEPEAGEAPLGEMRASEGLDACASPTKSASACNRLLNGASQADGARVLNGASQADSGRVLLRSSKKGAEGSACAPGEAKAAVQCSFCKSQFERKKDLELHVHQAHKPFKCRLCSYATLREESLLSHIERDHITAQGPGSGEACVENGKPELSPGEFPCEVCGQAFSQTWFLKAHMKKHRGSFDHGCHICGRRFKEPWFLKNHMKAHGPKTGSKNRPKSELDPIATINNVVQEEVIVAGLSLYEVCAKCGNLFTNLDSLNAHNAIHRRVEASRTRAPAEEGAEGPSDTKQFFLQCLNLRPSAAGDSCPGTQAGRRVAELDPVNSYQAWQLATRGKVAEPAEYLKYGAWDEALAGDVAFDKDRREYVLVSQEKRKREQDAPAAQGPPRKRASGPGDPAPAGHLDPRSAARPNRRAAATTGQGKSSECFECGKIFRTYHQMVLHSRVHRRARRERDSDGDRAARARCGSLSEGDSASQPSSPGSACAAADSPGSGLADEAAEDSGEEGAPEPAPGGQPRRCCFSEEVTSTELSSGDQSHKMGDNASERDTGESKAGIAASVSILENSSRETSRRQEQHRFSMDLKMPAFHPKQEVPVPGDGVEFPSSTGAEGQTGHPAEKLSDLHNKEHSGGGKRALAPDLMPLDLSARSTRDDPSNKETASSLQAALVVHPCPYCSHKTYYPEVLWMHKRIWHRVSCNSVAPPWIQPNGYKSIRSNLVFLSRSGRTGPPPALGGKECQPLLLARFTRTQVPGGMPGSKSGSSPLGVVTKAASMPKNKESHSGGPCALWAPGPDGYRQTKPCHGQEPHGAATQGPLAKPRQEASSKPVPAPGGGGFSRSATPTPTVIARAGAQPSANSKPVEKFGVPPAGAGFAPTNKHSAPDSLKAKFSAQPQGPPPAKGEGGAPPLPPREPPSKAAQELRTLATCAAGSRGDAALQAQPGVAGAPPVLHSIKQEPVAEGHEKRLDILNIFKTYIPKDFATLYQGWGVSGPGLEHRGTLRTQARPGEFVCIECGKSFHQPGHLRAHMRAHSVVFESDGPRGSEVHTTSADAPKQGRDHSNTGTVQTVPLRKGT

SEQ ID NO: 6919 - protein, 75 aa, Homo sapiens
MDRNREAEMELRRGPSPTRAGRGHEVDGDKATCHTCCICGKSFPFQSSLSQHMRKHTGEKPYKCPYCDHRASQKG

SEQ ID NO: 6920 - protein, 492 aa, Homo sapiens
MAMALPMPGPQEAVVFEDVAVYFTRIEWSCLAPDQQALYRDVMLENYGNLASLGFLVAKPALISLLEQGEEPGALILQVAEQSVAKASLCTDSRMEAGIMESPLQRKLSRQAGLPGTVWGCLPWGHPVGGHPAPPHPHGGPEDGSDKPTHPRAREHSASPRVLQEDLGRPVGSSAPRYRCVCGKAFRYNSLLLRHQIIHTGAKPFQCTECGKAFKQSSILLRHQLIHTEEKPFQCGECGKAFRQSTQLAAHHRVHTRERPYACGECGKAFSRSSRLLQHQKFHTGEKPFACTECGKAFCRRFTLNEHGRIHSGERPYRCLRCGQRFIRGSSLLKHHRLHAQEGAQDGGVGQGALLGAAQRPQAGDPPHECPVCGRPFRHNSLLLLHLRLHTGEKPFECAECGKAFGRKSNLTLHQKIHTKEKPFACTECGKAFRRSYTLNEHYRLHSGERPYRCRACGRACSRLSTLIQHQKVHGREPGEDTEGRRAPCWAS

SEQ ID NO: 6921 - protein, 492 aa, Homo sapiens; identical to SEQ ID NO: 6920

SEQ ID NO: 6922 - protein, 492 aa, Homo sapiens; identical to SEQ ID NO: 6920

SEQ ID NO: 6923 - protein, 1074 aa, Homo sapiens
MKDIGQQLYTTHLNGGHNSLTMSPKQPDANGAPRPNRQEAQTLLYQGSEAEAAMMTIATCAKCKSVHKISLQDLQKGTGKDGMYVCFQCSLGAAPPNFHFVSNNSSATHVGNKTENFSSSVNSKFKVRNFKPGKYYCDKCRFSTKDPLQYKKHTLQHEEIKFICSHCSYISYTKGEFQRHLVKHTGIFPYQCEYCDYGAIRNDYIVKHTKRVHERAGAKRPVKAVAKLEPKRTGTSKQNPELLKASNPRTTFQNKWSDQLSGFSLHANKDKMHNIMLLPEPKEYQKDVVCIPNKMTLSEPNEVNLFENKNVEVEVLSPAKEPVQPGMPLTVVAPAELVVPANCLAQLIDVKVVNGTQQLVLKLFPLEENNCLEAGRDNGGNSERMVKEKGSNEQEKVLSAEKTKSLTVDGNVGKLVGIDSFQPSVQKQLKNVKWVRSYDFIMPNSSVHNNGKSFINSETIEDFQKKNNLYPHRTAFPSVALKGHSLASVFKNSVLRSLGAASNPFPYKAAVCFAESGRNLHSSSQQLLPFAASPATCSFSGEKGLLPVSENDLESTSKVNIPVKVVSSNRKQEDNQTEEHKAVSTVGQISSQHKSEYLHINITGEDRSQQPGDKPLELKNSERTNNTNDGPVISSVFSLSSGSENVPEGIKWNSSTSKIKSIELLRRKIAQLIESCGKPSSLASNSAHRRSVGQASKGTSKATSEGIQEINVSLTGLGHSTGTLQKPPNDGGITGNRQLTHQQIYPHFADGSNRKTKSRVARKAHVATPVLIPKGAVLRVLNSSENAHIIEATCEAPVSIPCSERQLIKPVPFCPVRQADSDLQPLRSERGPIDMSPNIETPLRPKLRKESAVCSTIHRKTGLLYGQQGSSELNKQGRLLSRSLSISRNKTKQVHLSRKKNKIQAEPSRCLKDPSIFQVARQLRLIAAKPDQLIKCPRRNQPVIVLNHPDVDSPEVTNVMKVINKYKGNVLKVVLSERTRCQLGIRRHHVRLTYQNAEEASQIKRQMMLKMKLKKVHKNNYQVVDSLPDDSSQCVFKCWFCGRLYEDQEEWMSHGQRHLIEATRDWDVLSSKGK

SEQ ID NO: 6924 - protein, 75 aa, Homo sapiens
MKDIGQQLYTTHLNGGHNSLTMSPKQPDANGAPRPNRQEAQTLLYQGSEAEAAMMTIATCAKCKSVHKISLQDLQ

SEQ ID NO: 6925 - protein, 540 aa, Homo sapiens
MELLTFRDVAIEFSPEEWKCLDPAQQNLYRDVMLENYRNLVSLAVYSYYNQGILPEQGIQDSFKKATLGRYGSCGLENICLWKNWESIGEGEGQKECYNLCSQYLTTSHNKHLTVKGDKEYRIFQKKPQFLSAAPTEPCIPMNKYQHKFLKSVFCNKNQINFNHDSNISKHHSTHFLENYYNCNECEKVFYQSSKLIFPENIHIQKKPYNSNECGETSDPFSKLTQHQRIYIGESSQRCNKKCIIVFSQSHLKGHKIINTGEKSVKYKERGKAFTRGLHLGHQKIHTGEKPYKCKKCDKAFNKSSHLAQHQRIHTGEKPFKCKECGKAFNRGSYLTQHQRIHTGERAFKCEECGKAFNRGSYLTQHQRIHTGEKPFRCKECGKAFNRSSYVTQHQRMHTGEKPFKCKECGKAFNRASHLTQHQRIHTGEKHFKCKECGKAFNRGSHLTRHQRIHTGEKSFKCEECGKAFIWGSHLTQHQRVHTGEKFFKCKECGKAFTRSSHLTQHQRIHTGEKPFKCKECGKAFNRRSTLTQHQIIHTR

SEQ ID NO: 6926 - protein, 540 aa, Homo sapiens; identical to SEQ ID NO: 6925

SEQ ID NO: 6927 - protein, 264 aa, Homo sapiens
MDTPSPDPLPSPLPGEEEKPLALSPPVPRGRRGRRPGGATSSNRTLKASLPRKRGRPPKSGQEPPLVQVQGVTAPVGSSGGSDLLLIDDQGVPYTVSEGSAAGPEGSGPRKAPHFCPVCLRAFPYLSDLERHSISHSELKPHQCKVCGKTFKRSSHLRRHCNIHAGLRPFRCPLCPRRFREAGELAHHHRVHSGERPYQCPICRLRFTEANTLRRHAKRKHPEAMGVPLCAPDPGSEPPWDEEGIPATAGAEEEEETEGKGEPA

SEQ ID NO: 6928 - protein, 197 aa, Homo sapiens
MSSLTYHHRLHTGEKPYKCEECDKAFRHNSALQRHRRIHTGEKPHKCNECGKTFSQKSYLACHRSIHTGKKPYECEECDKAFSFKSNLESHRITHTGEKPYKCNDCGKTFSHMSTLTCHRRLHTGEKPYKCEECDEAFRFKSSLERHRRIHNGEKLYKCNECGKTFSQELSLTCHCRLHSGEKPCKCGECDKAYSFK

SEQ ID NO: 6929 - protein, 443 aa, Homo sapiens
MLENYRNLVSLGISSKCTMKEFSSTAQGNTEVIHTGTLQRHERHHIGDFSFQEIEKDIHNFEFQWQEDERNGHEAPMTKIKKLMGSTEQYDHRHAGNKPIKYQLGSSFHSHLSELHIFQPKGKINNQVEKSINDASSVSTAQRISCRPKTHISNNYGDNFLNYSLLTQRQEVRMREKSFQCIESGKAFNYSSLLRKHQIIHLGEKQYKCDVCDKVFIRKRYLARHRRCHTGEKPYKCNECGKSFSQMSSLTYHHRLHTGEKPYKCEECDKAFRHNSALQRHRRIHTGEKPHKCNECGKTFSQKSYLACHRSIHTGKKPYECEECDKAFSFKSNLESHRITHTGEKPYKCNDCGKTFSHMSTLTCHRRLHTGEKPYKCEECDEAFRFKSSLERHRRIHNGEKLYKCNECGKTFSQELSLTCHCRLHSGEKPCKCGECDKAYSFK

SEQ ID NO: 6930 - protein, 479 aa, Homo sapiens
MALPQGLLTFRDVAIEFSQEEWKCLDPAQRTLYRDVMLENYRNLVSLGISSKCTMKEFSSTAQGNTEVIHTGTLQRHERHHIGDFSFQEIEKDIHNFEFQWQEDERNGHEAPMTKIKKLMGSTEQYDHRHAGNKPIKYQLGSSFHSHLSELHIFQPKGKINNQVEKSINDASSVSTAQRISCRPKTHISNNYGDNFLNYSLLTQRQEVRMREKSFQCIESGKAFNYSSLLRKHQIIHLGEKQYKCDVCDKVFIRKRYLARHRRCHTGEKPYKCNECGKSFSQMSSLTYHHRLHTGEKPYKCEECDKAFRHNSALQRHRRIHTGEKPHKCNECGKTFSQKSYLACHRSIHTGKKPYECEECDKAFSFKSNLESHRITHTGEKPYKCNDCGKTFSHMSTLTCHRRLHTGEKPYKCEECDEAFRFKSSLERHRRIHNGEKLYKCNECGKTFSQELSLTCHCRLHSGEKPCKCGECDKAYSFK

SEQ ID NO: 6931 - protein, 50 aa, Homo sapiens
MALPQGLLTFRDVAIEFSQEEWKCLDPAQRTLYRDVMLENYRNLVSLGFL

SEQ ID NO: 6932 - protein, 628 aa, Homo sapiens
MALTQGPLKFMDVAIEFSQEEWKCLDPAQRTLYRDVMLENYRNLVSLGICLPDLSVTSMLEQKRDPWTLQSEEKIANDPDGRECIKGVNTERSSKLGSNAGNKPCKNQLGFTFQLHLSDLQLFQAERKISGCKHFEKPVSDNSSVSPLEKISSSVKSHLLNKYRNNFDHAPLLPQEQKAHIREKAYKCNEHGQVFRASASLTNQVIHNADNPYKCSECGKVFSCSSKLVIHRRMHTGEKPYKCHECGKLFSSNSNLSQHQRIHTGEKPYKCHECDKVFRSSSKLAQHQRIHTGEKPYKCHECDKVFNQIAHLVRHQKIHTGEKPYSCNKCGKVFSRHSYLAEHQTVHTGEKPYKCEECGKAFSVRSSLITHQLIHTGRKPYKCKECDKVFGRKCFLTSHQRIHTRERPYGCSQCGKIFSQKSDLIRHRKTHTDEKPYKCNKCGTAFREFSDLTAHFLIHSGEKPYECKECGKVFRYKSSLTSHHRIHTGEKPYKCNRCGKVFSRSSNLVCHQKIHTGEKPYKCNQCGKVFNQASYLTRHQIIHTGERPYRCSKCGKAFRGCSGLTAHLAIHTEKKSHECKECGKIFTQKSSLTNHHRIHIGEKPYKCTLCSKVFSHNSDLAQHQRVHS

SEQ ID NO: 6933 - protein, 81 aa, Homo sapiens
MALTQGPLKFMDVAIEFSQEEWKCLDPAQRTLYRDVMLENYRNLVSLGICLPDLSVTSMLEQKRDPWTLQSEEKIANDPDG

SEQ ID NO: 6934 - protein, 14 aa, Homo sapiens
MALTQGPLKFMDVA

SEQ ID NO: 6935 - protein, 599 aa, Homo sapiens
MAAALRAPTQQVFVAFEDVAIYFSQEEWELLDEMQRLLYRDVMLENFAVMASLGCWCGAVDEGTPSAESVSVEELSQGRTPKADTSTDKSHPCEICTPVLRDILQMIELHASPCGQKLYLGGASRDFWMSSNLHQLQKLDNGEKLFKVDGDQASFMMNCRFHVSGKPFTFGEVGRDFSATSGLLQHQVTPTIERPHSRIRHLRVPTGRKPLKYTESRKSFREKSVFIQHQRADSGERPYKCSECGKSFSQSSGFLRHRKAHGRTRTHECSECGKSFSRKTHLTQHQRVHTGERPYDCSECGKSFRQVSVLIQHQRVHTGERPYECSECGKSFSHSTNLYRHRSAHTSTRPYECSECGKSFSHSTNLFRHWRVHTGVRPYECSECGKAFSCNIYLIHHQRFHTGERPYVCSECGKSFGQKSVLIQHQRVHTGERPYECSECGKVFSQSSGLFRHRRAHTKTKPYECSECEKSFSCKTDLIRHQTVHTGERPYECSVCGKSFIRKTHLIRHQTVHTNERPYECDECGKSYSQSSALLQHRRVHTGERPYECRECGKSFTRKNHLIQHKTVHTGERPYECSECGKSFSQSSGLLRHRRVHVQ

SEQ ID NO: 6936 - protein, 1301 aa, Homo sapiens
MTMGDMKTPDFDDLLAAFDIPDMVDPKAAIESGHDDHESHMKQNAHGEDDSHAPSSSDVGVSVIVKNVRNIDSSEGGEKDGHNPTGNGLHNGFLTASSLDSYSKDGAKSLKGDVPASEVTLKDSTFSQFSPISSAEEFDDDEKIEVDDPPDKEDMRSSFRSNVLTGSAPQQDYDKLKALGGENSSKTGLSTSGNVEKNKAVKRETEASSINLSVYEPFKVRKAEDKLKESSDKVLENRVLDGKLSSEKNDTSLPSVAPSKTKSSSKLSSCIAAIAALSAKKAASDSCKEPVANSRESSPLPKEVNDSPRAADKSPESQNLIDGTKKPSLKQPDSPRSISSENSSKGSPSSPAGSTPAIPKVRIKTIKTSSGEIKRTVTRVLPEVDLDSGKKPSEQTASVMASVTSLLSSPASAAVLSSPPRAPLQSAVVTNAVSPAELTPKQVTIKPVATAFLPVSAVKTAGSQVINLKLANNTTVKATVISAASVQSASSAIIKAANAIQQQTVVVPASSLANAKLVPKTVHLANLNLLPQGAQATSELRQVLTKPQQQIKQAIINAAASQPPKKVSRVQVVSSLQSSVVEAFNKVLSSVNPVPVYIPNLSPPANAGITLPTRGYKCLECGDSFALEKSLTQHYDRRSVRIEVTCNHCTKNLVFYNKCSLLSHARGHKEKGVVMQCSHLILKPVPADQMIVSPSSNTSTSTSTLQSPVGAGTHTVTKIQSGITGTVISAPSSTPITPAMPLDEDPSKLCRHSLKCLECNEVFQDETSLATHFQQAADTSGQKTCTICQMLLPNQCSYASHQRIHQHKSPYTCPECGAICRSVHFQTHVTKNCLHYTRRVGFRCVHCNVVYSDVAALKSHIQGSHCEVFYKCPICPMAFKSAPSTHSHAYTQHPGIKIGEPKIIYKCSMCDTVFTLQTLLYRHFDQHIENQKVSVFKCPDCSLLYAQKQLMMDHIKSMHGTLKSIEGPPNLGINLPLSIKPATQNSANQNKEDTKSMNGKEKLEKKSPSPVKKSMETKKVASPGWTCWECDCLFMQRDVYISHVRKEHGKQMKKHPCRQCDKSFSSSHSLCRHNRIKHKGIRKVYACSHCPDSRRTFTKRLMLEKHVQLMHGIKDPDLKEMTDATNEEETEIKEDTKVPSPKRKLEEPVLEFRPPRGAITQPLKKLKINVFKVHKCAVCGFTTENLLQFHEHIPQHKSDGSSYQCRECGLCYTSHVSLSRHLFIVHKLKEPQPVSKQNGAGEDNQQENKPSHEDESPDGAVSDRKCKVCAKTFETEAALNTHMRTHGMAFIKSKRMSSAEK

SEQ ID NO: 6937 - protein, 193 aa, Homo sapiens
MALTQGQLSFSDVAIEFSQEEWKCLDPGQKALYRDVMLENYRNLVSLGICLPDLSVTSMLEQKRDPWTLQSEVKIINNPDGRECIKGVNTDFSLLAWDARVFRVEAWRASGGAEEPTGPNFVGNDSPLPSPLALLPFPSVSASLGDAKRARLTAEGRGHGTLRAGPAPRPRSAAPHAPDAVQRWPPEQRLPRS

SEQ ID NO: 6938 - protein, 674 aa, Homo sapiens
MALTQGQLSFSDVAIEFSQEEWKCLDPGQKALYRDVMLENYRNLVSLGEDNVRPEACICSGICLPDLSVTSMLEQKRDPWTLQSEVKIINNPDGRECIKGVNTEKSSKLGSSAGNKSLKNQHGLTLQLHLTEWQPFQAVRNIYGCKHVEKSISDNSSVSPVQISFFSVKTHIFNNYRNDFLFSTLLPQEQKVHIREKPYGCNEHGKVFRVSSSLTNRQVIHIADKTYKCSDCGEIFSSNSNFAQHQRIHTGEKPYKYNECGKVFNQNSHLAQHQKIHTGQKPYNNKECGKVFSHHAYLAQHRKIHTGEKPYKCSECGKAFSVCSSLTAHLVIHTGEKPYDCKECGKVFRHKSSLTTHQTVHTGERPYKCNECGKGFSRIAFLARHRKVHTGEKPYKCNECGKVFIGNSRLARHRKIHTGGRRYKCNECGKAFRTCSDLTAHLLIHTGEKPYECIDCGKVFRHKSSLTYHCRIHTGEKPYKCNECGKVFSQNSNLQRHRKIHTGEKLYKCNECGKVFRQNSHLAQHRDIHTGEKPYSCNECGKVFRRNSHLVRHRNVHTGEKPYSCNECGKVFSRNSHLARHRNIHTGEKPHSCNECGKVFSRNSHLARHRKIHTGEKLYKCNECSKVFSRNSRLAQHRNIHTGVKPYSCNECGKVFSKNSILVQHCSIHTREKP

SEQ ID NO: 6939 - protein, 673 aa, Homo sapiens
VLTTGQLSFSDVAIEFSQEEWKCLDPGQKALYRDVMLENYRNLVSLGEDNVRPEACICSGICLPDLSVTSMLEQKRDPWTLQSEVKIINNPDGRECIKGVNTEKSSKLGSSAGNKSLKNQHGLTLQLHLTEWQPFQAVRNIYGCKHVEKSISDNSSVSPVQISFFSVKTHIFNNYRNDFLFSTLLPQEQKVHIREKPYGCNEHGKVFRVSSSLTNRQVIHIADKTYKCSDCGEIFSSNSNFAQHQRIHTGEKPYKYNECGKVFNQNSHLAQHQKIHTGQKPYNNKECGKVFSHHAYLAQHRKIHTGEKPYKCSECGKAFSVCSSLTAHLVIHTGEKPYDCKECGKVFRHKSSLTTHQTVHTGERPYKCNECGKGFSRIAFLARHRKVHTGEKPYKCNECGKVFIGNSRLARHRKIHTGGRRYKCNECGKAFRTCSDLTAHLLIHTGEKPYECIDCGKVFRHKSSLTYHCRIHTGEKPYKCNECGKVFSQNSNLQRHRKIHTGEKLYKCNECGKVFRQNSHLAQHRDIHTGEKPYSCNECGKVFRRNSHLVRHRNVHTGEKPYSCNECGKVFSRNSHLARHRNIHTGEKPHSCNECGKVFSRNSHLARHRKIHTGEKLYKCNECSKVFSRNSRLAQHRNIHTGVKPYSCNECGKVFSKNSILVQHCSIHTREKP

SEQ ID NO: 6940 - protein, 150 aa, Homo sapiens
MALTQGQLSFSDVAIEFSQEEWKCLDPGQKALYRDVMLENYRNLVSLDFSLLAWDARVFRVEAWRASGGAEEPTGPNFVGNDSPLPSPLALLPFPSVSASLGDAKRARLTAEGRGHGTLRAGPAPRPRSAAPHAPDAVQRWPPEQRLPRS

SEQ ID NO: 6941 - protein, 661 aa, Homo sapiens
MALTQGQLSFSDVAIEFSQEEWKCLDPGQKALYRDVMLENYRNLVSLGICLPDLSVTSMLEQKRDPWTLQSEVKIINNPDGRECIKGVNTEKSSKLGSSAGNKSLKNQHGLTLQLHLTEWQPFQAVRNIYGCKHVEKSISDNSSVSPVQISFFSVKTHIFNNYRNDFLFSTLLPQEQKVHIREKPYGCNEHGKVFRVSSSLTNRQVIHIADKTYKCSDCGEIFSSNSNFAQHQRIHTGEKPYKYNECGKVFNQNSHLAQHQKIHTGQKPYNNKECGKVFSHHAYLAQHRKIHTGEKPYKCSECGKAFSVCSSLTAHLVIHTGEKPYDCKECGKVFRHKSSLTTHQTVHTGERPYKCNECGKGFSRIAFLARHRKVHTGEKPYKCNECGKVFIGNSRLARHRKIHTGGRRYKCNECGKAFRTCSDLTAHLLIHTGEKPYECIDCGKVFRHKSSLTYHCRIHTGEKPYKCNECGKVFSQNSNLQRHRKIHTGEKLYKCNECGKVFRQNSHLAQHRDIHTGEKPYSCNECGKVFRRNSHLVRHRNVHTGEKPYSCNECGKVFSRNSHLARHRNIHTGEKPHSCNECGKVFSRNSHLARHRKIHTGEKLYKCNECSKVFSRNSRLAQHRNIHTGVKPYSCNECGKVFSKNSILVQHCSIHTREKP

SEQ ID NO: 6942 - protein, 1300 aa, Homo sapiens
MEEASLCLGVSSAEPEAEPHLSGPVLNGQYAMSQKLHQITSQLSHAFPELHPRPNPEEKPPASLEEKAHVPMSGQPMGSQMALLANQLGREVDTSLNGRVDLQQFLNGQNLGIMSQMSDIEDDARKNRKYPCPLCGKRFRFNSILSLHMRTHTGEKPFKCPYCDHRAAQKGNLKIHLRTHKLGNLGKGRGRVREENRLLHELEERAILRDKQLKGSLLQPRPDLKPPPHAQQAPLAACTLALQANHSVPDVAHPVPSPKPASVQEDAVAPAAGFRCTFCKGKFKKREELDRHIRILHKPYKCTLCDFAASQEEELISHVEKAHITAESAQGQGPNGGGEQSANEFRCEVCGQVFSQAWFLKGHMRKHKDSFEHCCQICGRRFKEPWFLKNHMKVHLNKLSVKNKSPSDPEVPVPMGGMSQEAHANLYSRYLSCLQSGFMTPDKAGLSEPSQLYGKGELPMKEKEALGKLLSPISSMAHGVPEGDKHSLLGCLNLVPPLKSSCIERLQAAAKAAEMDPVNSYQAWQLMARGMAMEHGFLSKEHPLQRNHEDTLANAGVLFDKEKREYVLVGADGSKQKMPADLVHSTKVGSQRDLPSKLDPLESSRDFLSHGLNQTLEYNLQGPGNMKEKPTECPDCGRVFRTYHQVVVHSRVHKRDRKGEEDGLHVGLDERRGSGSDQESQSVSRSTTPGSSNVTEESGVGGGLSQTGSAQEDSPHPSSPSSSDIGEEAGRSAGVQQPALLRDRSLGSAMKDCPYCGKTFRTSHHLKVHLRIHTGEKPYKCPHCDYAGTQSASLKYHLERHHRERQNGAGPLSGQPPNQDHKDEMSSKASLFIRPDILRGAFKGLPGIDFRGGPASQQWTSGVLSSGDHSGQATGMSSEVPSDALKGTDLPSKSTHFSEIGRAYQSIVSNGVNFQGSLQAFMDSFVLSSLKKEKDMKDKALADPPSMKVHGVDGGEEKPSGKSSQRKSEKSQYEPLDLSVRPDAASLPGSSVTVQDSIAWHGCLFCAFTTSSMELMALHLQANHLGKAKRKDNTIGVTVNCKDQAREASKMALLPSLQSNKDLGLSNMISSLDSASEKMAQGQLKETLGEQKSGAWTGHVDPAFCNFPSDFYKQFGVYPGMVGSGASSSCPNKEPDGKAHSEEDVPILIPETTSKNTTDDLSDIASSEDMDSSKGENNDEEDVETEPEMMTKPLSALSKDSSSDGGDSLQPTGTSQPVQGLVSPLSQAPEKQWHSQGLLQAQDPLAGLPKPERGPQSLDKPMNMLSVLRAYSSDGLAAFNGLASSTANSGCIKRPDLCGK

SEQ ID NO: 6943 - protein, 1365 aa, Homo sapiens
MDQYSLGDEGALPSEMHLPSFSESQGLNCSDTLNRDLGPNTRGFLYAGLSGLDPDPSLPTPDMSSEVLEDNLDTLSLYSGKDSDSVKLLEEYADSESQASLQDLGLGVLKAKEADEGGRATSGSARKGKRQHSSPQNPLLDCSLCGKVFSSASSLSKHYLTHSQERKHVCKICSKAFKRQDHLTGHMLTHQKTKPFVCIEQGCSKSYCDYRSLRRHYEVHHGLCILKEAPPEEEACGDSPHAHESAGQPPPSSLRSLVPPEARSPGSLLPHRDLLRRIVSSIVHQKTPSPGPAPAGASDSEGRNTACPCPASSGSSSCTPAGPHAAPAALDTELPEEPCLPQKEPATDVFTAPNSRAAENGAPDPPEPEPDTALLQARSTAECWPEGGSVPACLPLFRGQTVPASSQPSSHSFQWLRNLPGCPKSKGNNVFVVHKPSAVPSREGSESGPGPSSGSPSEESPPGPGGGLEDALPFPAALLRVPAEAPSDPRSASGEDDPCAPKKVKVDCDSFLCQNPGEPGLQEAQKAGGLPADASPLFRQLFLKSQEPLVSHEQMQVFQMITKSQRIFSHAQVAAVSSQLPAPEGKPAALRPLQGPWPQQPPPLAPAVDSLHAGPGNPEAEGSPARRRKTTPGVPREASPGSTRRDAKGGLKVAAVPTPLAAPSLDPSRNPDISSLAKQLRSSKGTLDLEDIFPSTGQRQTQLGGEEPPGASLPGKQAPAENGAASRITKGEKGPACSRGGGYRLLGNPRAPRFSGFRKEKAKMDMCCAASPSQVAMASFSSAGPPADPSKSKLTIFSRIQGGNIYRLPHPVKEENVAGRGNQQNGSPTDWTKPRSTFVCKNCSQMFYTEKGLSSHMCFHSDQWPSPRGKQEPQVFGTEFCKPLRQVLRPEGDRHSPPGTKKPLDPTAAAPLVVPQSIPVVPVTRHIGSMAMMEWCSRWLQATTCGSKLLQGQEKDGEERDSKESSQQRKRKKRPPPSTAGEPGPAGCHQSRLRSPMFLVDCLLKGLFQCSPYTPPPMLSPIREGSGVYFNTLCSTSTQASPDQLISSMLDQVDGSFGICVVKDDTKISIEPHINIGSRFQAEIPELQERSLAGTDEHVASLVWKPWGDMMISSETQDRVTELCNVACSSVMPGGGTNLELALHCLHEAQGNVQVALETLLLRGPHKPRTHLLADYRYTGSDVWTPIEKRLFKKAFYAHKKDFYLIHKMIQTKTVAQCVEYYYIWKKMIKFDCGRAPGLEKRVKREPEEVERTEEKVPCSPRERPSHHPTPKLKTKSYRRESILSSSPNAGSKRTPELLGSAESQGIFPCRECERVFDKIKSRNAHMKRHRLQDHVEPIIRVKWPVKPFQLKEEELGADIGPLQW

SEQ ID NO: 6944 - protein, 1088 aa, Homo sapiens
MDQYSLGDEGALPSEMHLPSFSESQGLNCSDTLNRDLGPNTRGFLYAGLSGLDPDPSLPTPDMSSEVLEDNLDTLSLYSGKDSDSVKLLEEYADSESQASLQDLGLGVLKAKEADEGGRATSGSARKGKRQHSSPQNPLLDCSLCGKVFSSASSLSKHYLTHSQERKHVCKICSKAFKRQDHLTGHMLTHQKTKPFVCIEQGCSKSYCDYRSLRRHYEVHHGLCILKEAPPEEEACGDSPHAHESAGQPPPSSLRSLVPPEARSPGSLLPHRDLLRRIVSSIVHQKTPSPGPAPAGASDSEGRNTACPCPASSGSSSCTPAGPHAAPAALDTELPEEPCLPQKEPATDVFTAPNSRAAENGAPDPPEPEPDTALLQARSTAECWPEGGSVPACLPLFRGQTVPASSQPSSHSFQWLRNLPGCPKSKGNNVFVVHKPSAVPSREGSESGPGPSSGSPSEESPPGPGGGLEDALPFPAALLRVPAEAPSDPRSASGEDDPCAPKKVKVDCDSFLCQNPGEPGLQEAQKAGGLPADASPLFRQLFLKSQEPLVSHEQMQVFQMITKSQRIFSHAQVAAVSSQLPAPEGKPAALRPLQGPWPQQPPPLAPAVDSLHAGPGNPEAEGSPARRRKTTPGVPREASPGSTRRDAKGGLKVAAVPTPLAAPSLDPSRNPDISSLAKQLRSSKGTLDLEDIFPSTGQRQTQLGGEEPPGASLPGKQAPAENGAASRITKGEKGPACSRGGGYRLLGNPRAPRFSGFRKEKAKMDMCCAASPSQVAMASFSSAGPPADPSKSKLTIFSRIQGGNIYRLPHPVKEENVAGRGNQQNGSPTDWTKPRSTFVCKNCSQMFYTEKGLSSHMCFHSDQWPSPRGKQEPQVFGTEFCKPLRQVLRPEGDRHSPPGTKKPLDPTAAAPLVVPQSIPVVPVTRHIGSMAMIQTKTVAQCVEYYYIWKKMIKFDCGRAPGLEKRVKREPEEVERTEEKVPCSPRERPSHHPTPKLKTKSYRRESILSSSPNAGSKRTPELLGSAESQGIFPCRECERVFDKIKSRNAHMKRHRLQDHVEPIIRVKWPVKPFQLKEEELGADIGPLQW

SEQ ID NO: 6945 - protein, 600 aa, Homo sapiens
MAASAQVSVTFEDVAVTFTQEEWGQLDAAQRTLYQEVMLETCGLLMSLGCPLFKPELIYQLDHRQELWMATKDLSQSSYPGDNTKPKTTEPTFSHLALPEEVLLQEQLTQGASKNSQLGQSKDQDGPSEMQEVHLKIGIGPQRGKLLEKMSSERDGLGSDDGVCTKITQKQVSTEGDLYECDSHGPVTDALIREEKNSYKCEECGKVFKKNALLVQHERIHTQVKPYECTECGKTFSKSTHLLQHLIIHTGEKPYKCMECGKAFNRRSHLTRHQRIHSGEKPYKCSECGKAFTHRSTFVLHHRSHTGEKPFVCKECGKAFRDRPGFIRHYIIHTGEKPYECIECGKAFNRRSYLTWHQQIHTGVKPFECNECGKAFCESADLIQHYIIHTGEKPYKCMECGKAFNRRSHLKQHQRIHTGEKPYECSECGKAFTHCSTFVLHKRTHTGEKPYECKECGKAFSDRADLIRHFSIHTGEKPYECVECGKAFNRSSHLTRHQQIHTGEKPYECIQCGKAFCRSANLIRHSIIHTGEKPYECSECGKAFNRGSSLTHHQRIHTGRNPTIVTDVGRPFMTAQTSVNIQELLLGKEFLNITTEENLW

SEQ ID NO: 6946 - protein, 715 aa, Homo sapiens
MEARSMLVPPQASVCFEDVAMAFTQEEWEQLDLAQRTLYREVTLETWEHIVSLGLFLSKSDVISQLEQEEDLCRAEQEAPRDWKATLEENRLNSEKDRAREELSHHVEVYRSGPEEPPSLVLGKVQDQSNQLREHQENSLRFMVLTSERLFAQREHCELELGGGYSLPSTLSLLPTTLPTSTGFPKPNSQVKELKQNSAFINHEKNGADGKHCESHQCARAFCQSIYLSKLGNVETGKKNPYEYIVSGDSLNYGSSLCFHGRTFSVKKSDDCKDYGNLFSHSVSLNEQKPVHFGKSQYECDECRETCSESLCLVQTERSGPGETPFRCEERCAAFPMASSFSDCNIIQTTEKPSVCNQCGKSFSCCKLIHQRTHTGEKPFECTQCGKSFSQSYDLVIHQRTHTGEKPYECDLCGKSFTQRSKLITHQRIHTGEKPYQCIECRKSFRWNSNLIVHQRIHTGEKPYECTHCGKSFSQSYELVTHKRTHTGEKPFKCTQCGKSFSQKYDLVVHQRTHTGEKPYECNLCGKSFSQSSKLITHQRIHTGEKPYQCIECGKSFRWNSNLVIHQRIHTGEKPYDCTHCGKSFSQSYQLVAHKRTHTGEKPYECNECGKAFNRSTQLIRHLQIHTGEKPYKCNQCNKAFARSSYLVMHQRTHTGEKPFECSQCGKAFSGSSNLLSHHRIHSGEKPYECSDCGKSFRQQSQLVVHRRTHTGEKP

SEQ ID NO: 6947 - protein, 106 aa, Homo sapiens
MEARSMLVPPQASVCFEDVAMAFTQEEWEQLDLAQRTLYREVTLETWEHIVSLGLFLSKSDVISQLEQEEDLCRAEQEAPRGTSGLSQVTGVVADGSFRFPVWDFT

SEQ ID NO: 6948 - protein, 687 aa, Homo sapiens
MEARSMLVPPQASVCFEDVAMAFTQEEWEQLDLAQRTLYREVTLETWEHIVSLDWKATLEENRLNSEKDRAREELSHHVEVYRSGPEEPPSLVLGKVQDQSNQLREHQENSLRFMVLTSERLFAQREHCELELGGGYSLPSTLSLLPTTLPTSTGFPKPNSQVKELKQNSAFINHEKNGADGKHCESHQCARAFCQSIYLSKLGNVETGKKNPYEYIVSGDSLNYGSSLCFHGRTFSVKKSDDCKDYGNLFSHSVSLNEQKPVHFGKSQYECDECRETCSESLCLVQTERSGPGETPFRCEERCAAFPMASSFSDCNIIQTTEKPSVCNQCGKSFSCCKLIHQRTHTGEKPFECTQCGKSFSQSYDLVIHQRTHTGEKPYECDLCGKSFTQRSKLITHQRIHTGEKPYQCIECRKSFRWNSNLIVHQRIHTGEKPYECTHCGKSFSQSYELVTHKRTHTGEKPFKCTQCGKSFSQKYDLVVHQRTHTGEKPYECNLCGKSFSQSSKLITHQRIHTGEKPYQCIECGKSFRWNSNLVIHQRIHTGEKPYDCTHCGKSFSQSYQLVAHKRTHTGEKPYECNECGKAFNRSTQLIRHLQIHTGEKPYKCNQCNKAFARSSYLVMHQRTHTGEKPFECSQCGKAFSGSSNLLSHHRIHSGEKPYECSDCGKSFRQQSQLVVHRRTHTGEKP

SEQ ID NO: 6949 - protein, 267 aa, Homo sapiens
MASSFSDCNIIQTTEKPSVCNQCGKSFSCCKLIHQRTHTGEKPFECTQCGKSFSQSYDLVIHQRTHTGEKPYECDLCGKSFTQRSKLITHQRIHTGEKPYQCIECRKSFRWNSNLIVHQRIHTGEKPYECTHCGKSFSQSYELVAHKRTHTGEKPYECNECGKAFNRSTQLIRHLQIHTGEKPYKCNQCNKAFARSSYLVMHQRTHTGEKPFECSQCGKAFSGSSNLLSHHRIHSGEKPYECSDCGKSFRQQSQLVVHRRTHTGEKP

SEQ ID NO: 6950 - protein, 836 aa, Homo sapiens
MQVDPPLHGPPNDFLIFQIIPLHSLSIMPRFLWILCFSMEETQGELTSSCGSKTMANVSLAFRDVSIDLSQEEWECLDAVQRDLYKDVMLENYSNLVSLGYTIPKPDVITLLEQEKEPWIVMREGTRNWFTDLEYKYITKNLLSEKNVCKIYLSQLQTGEKSKNTIHEDTIFRNGLQCKHEFERQERHQMGCVSQMLIQKQISHPLHPKIHAREKSYECKECRKAFRQQSYLIQHLRIHTGERPYKCMECGKAFCRVGDLRVHHTIHAGERPYECKECGKAFRLHYHLTEHQRIHSGVKPYECKECGKAFSRVRDLRVHQTIHAGERPYECKECGKAFRLHYQLTEHQRIHTGERPYECKVCGKTFRVQRHISQHQKIHTGVKPYKCNECGKAFSHGSYLVQHQKIHTGEKPYECKECGKSFSFHAELARHRRIHTGEKPYECRECGKAFRLQTELTRHHRTHTGEKPYECKECGKAFICGYQLTLHLRTHTGEIPYECKECGKTFSSRYHLTQHYRIHTGEKPYICNECGKAFRLQGELTRHHRIHTCEKPYECKECGKAFIHSNQFISHQRIHTSESTYICKECGKIFSRRYNLTQHFKIHTGEKPYICNECGKAFRFQTELTQHHRIHTGEKPYKCTECGKAFIRSTHLTQHHRIHTGEKPYECTECGKTFSRHYHLTQHHRGHTGEKPYICNECGNAFICSYRLTLHQRIHTGELPYECKECGKTFSRRYHLTQHFRLHTGEKPYSCKECGNAFRLQAELTRHHIVHTGEKPYKCKECGKAFSVNSELTRHHRIHTGEKPYQCKECGKAFIRSDQLTLHQRNHISEEVLCIM

SEQ ID NO: 6951 - protein, 447 aa, Homo sapiens
KTFRVQRHISQHQKIHTGVKPYKCNECGKAFSHGSYLVQHQKIHTGEKPYECKECGKSFSFHAELARHRRIHTGEKPYECRECGKAFRLQTELTRHHRTHTGEKPYECKECGKAFICGYQLTLHLRTHTGEIPYECKECGKTFSSRYHLTQHYRIHTGEKPYECKECGKAFIHSNQFISHQRIHTSESTYICKECGKIFSRRYNLTQHFKIHTGEKPYICNECGKAFRFQTELTQHHRIHTGEKPYKCTECGKAFIRSTHLTQHHRIHTGEKPYECTECGKTFSRHYHLTQHHRGHTGEKPYICNECGNAFICSYRLTLHQRIHTGELPYECKECGKTFSRRYHLTQHFRLHTGEKPYSCKECGNAFRLQAELTRHHIVHTGEKPYKCKECGKAFSVNSELTRHHRIHTGEKPYQCKECGKAFIRSDQLTLHQRNHISDREFVICKE

SEQ ID NO: 6952 - protein, 402 aa, Homo sapiens
MAEMNPAQGHVVFEDVAIYFSQEEWGHLDEAQRLLYRDVMLENLALLSSLGCCHGAEDEEAPLEPGVSVGVSQVMAPKPCLSTQNTQPCETCSSLLKDILRLAEHDGTHPEQGLYTCPAHLHQHQKEQIREKLSRGDGGRPTFVKNHRVHMAGKTFLCSECGKAFSHKHKLSDHQKIHTGERTYKCSKCGILFMERSTLNRHQRTHTGERPYECNECGKAFLCKSHLVRHQTIHSGERPYECSECGKLFMWSSTLITHQRVHTGKRPYGCSECGKFFKCNSNLFRHYRIHTGKRSYGCSECGKFFMERSTLSRHQRVHTGERPYECNECGKFFSLKSVLIQHQRVHTGERPYECSECGKAFLTKSHLICHQTVHTAAKQCSECGKFFRYNSTLLRHQKVHTG

SEQ ID NO: 6953 - protein, 354 aa, Homo sapiens
MAEMNPAQGHVVFEDVAIYFSQEEWGHLDEAQRLLYRDVMLENLALLSSLGCCHGAEDEEAPLEPGVSVGVSQVMAPKPCLSTQNTQPCETCSSLLKDILRLAEHDGTHPEQGLYTCPAHLHQHQKEQIREKLSRGDGGRPTFVKNHRVHMAGKTFLCSECGKAFSHKHKLSDHQKIHTGERTYKCSKCGILFMERSTLNRHQRTHTGERPYECNECGKAFLCKSHLVRHQTIHSGERPYECSECGKLFMWSSTLITHQRVHTGKRPYGCSECGKFFKCNSNLFRHYRIHTGKRSYGCSECGKFFMERSTLSRHQRVHTGERPYECNECGKFFSLKSVLIQHQRRVYTEEESFQ

SEQ ID NO: 6954 - protein, 545 aa, Homo sapiens
MNLTEGPLAMAEMDPTQGRVVFEDVAIYFSQEEWGHLDEAQRLLYRDVMLENLALLSSLGSWHGAEDEEAPSQQGFSVGVSEVTASKPCLSSQKVHPSETCGPPLKDILCLVEHNGIHPEQHIYICEAELFQHPKQQIGENLSRGDDWIPSFGKNHRVHMAEEIFTCMEGWKDLPATSCLLQHQGPQSEWKPYRDTEDREAFQTGQNDYKCSECGKTFTCSYSFVEHQKIHTGERSYECNKCGKFFKYSANFMKHQTVHTSERTYECRECGKSFMYNYRLMRHKRVHTGERPYECNTCGKFFRYSSTFVRHQRVHTGERPYECRECGKFFMDSSTLIKHQRVHTGERPYKCNDCGKFFRYISTLIRHQRIHTGERPYECSVCGELFRYNSSLVKHWRNHTGERPYKCSECGKSFRYHCRLIRHQRVHTGERPYECSECGKFFRYNSNLIKHWRNHTGERPYECRECGKAFSHKHILVEHQKIHSGERPYECSECQKAFIRKSHLVHHQKIHSEERLVCSMNVGNSLAKTPTSLNIRDFTMEKVYH

SEQ ID NO: 6955 - protein, 533 aa, Homo sapiens
MNLTEGRVVFEDVAIYFSQEEWGHLDEAQRLLYRDVMLENLALLSSLGSWHGAEDEEAPSQQGFSVGVSEVTASKPCLSSQKVHPSETCGPPLKDILCLVEHNGIHPEQHIYICEAELFQHPKQQIGENLSRGDDWIPSFGKNHRVHMAEEIFTCMEGWKDLPATSCLLQHQGPQSEWKPYRDTEDREAFQTGQNDYKCSECGKTFTCSYSFVEHQKIHTGERSYECNKCGKFFKYSANFMKHQTVHTSERTYECRECGKSFMYNYRLMRHKRVHTGERPYECNTCGKFFRYSSTFVRHQRVHTGERPYECRECGKFFMDSSTLIKHQRVHTGERPYKCNDCGKFFRYISTLIRHQRIHTGERPYECSVCGELFRYNSSLVKHWRNHTGERPYKCSECGKSFRYHCRLIRHQRVHTGERPYECSECGKFFRYNSNLIKHWRNHTGERPYECRECGKAFSHKHILVEHQKIHSGERPYECSECQKAFIRKSHLVHHQKIHSEERLVCSMNVGNSLAKTPTSLNIRDFTMEKVYH

SEQ ID NO: 6956 - protein, 627 aa, Homo sapiens
MAEAALVITPQGHVTFEDIAVYFSQEEWGLLDEAQRCLYHDVMLENFSLMASVGCLHGIEAEEAPSEQTLSAQGVSQARTPKLGPSIPNAHSCEMCILVMKDILYLSEHQGTLPWQKPYTSVASGKWFSFGSNLQQHQNQDSGEKHIRKEESSALLLNSCKIPLSDNLFPCKDVEKDFPTILGLLQHQTTHSRQEYAHRSRETFQQRRYKCEQVFNEKVHVTEHQRVHTGEKAYKRREYGKSLNSKYLFVEHQRTHNAEKPYVCNICGKSFLHKQTLVGHQQRIHTRERSYVCIECGKSLSSKYSLVEHQRTHNGEKPYVCNVCGKSFRHKQTFVGHQQRIHTGERPYVCMECGKSFIHSYDRIRHQRVHTGEGAYQCSECGKSFIYKQSLLDHHRIHTGERPYECKECGKAFIHKKRLLEHQRIHTGEKPYVCIICGKSFIRSSDYMRHQRIHTGERAYECSDCGKAFISKQTLLKHHKIHTRERPYECSECGKGFYLEVKLLQHQRIHTREQLCECNECGKVFSHQKRLLEHQKVHTGEKPCECSECGKCFRHRTSLIQHQKVHSGERPYNCTACEKAFIYKNKLVEHQRIHTGEKPYECGKCGKAFNKRYSLVRHQKVHITEEP

SEQ ID NO: 6957 - protein, 640 aa, Homo sapiens
MAEAALVITPQIPMVTEEFVKPSQGHVTFEDIAVYFSQEEWGLLDEAQRCLYHDVMLENFSLMASVGCLHGIEAEEAPSEQTLSAQGVSQARTPKLGPSIPNAHSCEMCILVMKDILYLSEHQGTLPWQKPYTSVASGKWFSFGSNLQQHQNQDSGEKHIRKEESSALLLNSCKIPLSDNLFPCKDVEKDFPTILGLLQHQTTHSRQEYAHRSRETFQQRRYKCEQVFNEKVHVTEHQRVHTGEKAYKRREYGKSLNSKYLFVEHQRTHNAEKPYVCNICGKSFLHKQTLVGHQQRIHTRERSYVCIECGKSLSSKYSLVEHQRTHNGEKPYVCNVCGKSFRHKQTFVGHQQRIHTGERPYVCMECGKSFIHSYDRIRHQRVHTGEGAYQCSECGKSFIYKQSLLDHHRIHTGERPYECKECGKAFIHKKRLLEHQRIHTGEKPYVCIICGKSFIRSSDYMRHQRIHTGERAYECSDCGKAFISKQTLLKHHKIHTRERPYECSECGKGFYLEVKLLQHQRIHTREQLCECNECGKVFSHQKRLLEHQKVHTGEKPCECSECGKCFRHRTSLIQHQKVHSGERPYNCTACEKAFIYKNKLVEHQRIHTGEKPYECGKCGKAFNKRYSLVRHQKVHITEEP

SEQ ID NO: 6958 - protein, 390 aa, Homo sapiens
MAETKDAAQMLVTFKDVAVTFTREEWRQLDLAQRTLYREVMLETCGLLVSLGDRAQVHTREPTTYPPVLSERAFLRGSLTLESSTSSDSRLGRARDEEGLLEMQKGKVTPETDLHKETHLGKVSLEGEGLGTDDGLHSRALQEWLSADVLHECDSQQPGKDALIHAGTNPYKCKQCGKGFNRKWYLVRHQRVHTGMKPYECNACGKAFSQSSTLIRHYLIHTGEKPYKCLECGKAFKRRSYLMQHHPIHTGEKPYECSQCRKAFTHRSTFIRHNRTHTGEKPFECKECEKAFSNRAHLIQHYIIHTGEKPYDCMACGKAFRCSSELIQHQRIHTGEKPYECTQCGKAFHRSTYLIQHSVIHTGEMPYKCIECGKAFKRRSHLLQHQRVHT

SEQ ID NO: 6959 - protein, 422 aa, Homo sapiens
MAETKDAAQMLVTFKDVAVTFTREEWRQLDLAQRTLYREVMLETCGLLVSLGHRVPKPELVHLLEHGQELWIVKRGLSHATCAGDRAQVHTREPTTYPPVLSERAFLRGSLTLESSTSSDSRLGRARDEEGLLEMQKGKVTPETDLHKETHLGKVSLEGEGLGTDDGLHSRALQEWLSADVLHECDSQQPGKDALIHAGTNPYKCKQCGKGFNRKWYLVRHQRVHTGMKPYECNACGKAFSQSSTLIRHYLIHTGEKPYKCLECGKAFKRRSYLMQHHPIHTGEKPYECSQCRKAFTHRSTFIRHNRTHTGEKPFECKECEKAFSNRAHLIQHYIIHTGEKPYDCMACGKAFRCSSELIQHQRIHTGEKPYECTQCGKAFHRSTYLIQHSVIHTGEMPYKCIECGKAFKRRSHLLQHQRVHT

SEQ ID NO: 6960 - protein, 381 aa, Homo sapiens
MLVTFKDVAVTFTREEWRQLDLAQRTLYREVMLETCGLLVSLGDRAQVHTREPTTYPPVLSERAFLRGSLTLESSTSSDSRLGRARDEEGLLEMQKGKVTPETDLHKETHLGKVSLEGEGLGTDDGLHSRALQEWLSADVLHECDSQQPGKDALIHAGTNPYKCKQCGKGFNRKWYLVRHQRVHTGMKPYECNACGKAFSQSSTLIRHYLIHTGEKPYKCLECGKAFKRRSYLMQHHPIHTGEKPYECSQCRKAFTHRSTFIRHNRTHTGEKPFECKECEKAFSNRAHLIQHYIIHTGEKPYDCMACGKAFRCSSELIQHQRIHTGEKPYECTQCGKAFHRSTYLIQHSVIHTGEMPYKCIECGKAFKRRSHLLQHQRVHT

SEQ ID NO: 6961 - protein, 654 aa, Homo sapiens
MAAVALRDSAQGMTFEDVAIYFSQEEWELLDESQRFLYCDVMLENFAHVTSLGYCHGMENEAIASEQSVSIQVRTSKGNTPTQKTHLSEIKMCVPVLKDILPAAEHQTTSPVQKSYLGSTSMRGFCFSADLHQHQKHYNEEEPWKRKVDEATFVTGCRFHVLNYFTCGEAFPAPTDLLQHEATPSGEEPHSSSSKHIQAFFNAKSYYKWGEYRKASSHKHTLVQHQSVCSEGGLYECSKCEKAFTCKNTLVQHQQIHTGQKMFECSECEESFSKKCHLILHKIIHTGERPYECSDREKAFIHKSEFIHHQRRHTGGVRHECGECRKTFSYKSNLIEHQRVHTGERPYECGECGKSFRQSSSLFRHQRVHSGERPYQCCECGKSFRQIFNLIRHRRVHTGEMPYQCSDCGKSFSCKSELIQHQRIHSGERPYECRECGKSFRQFSNLIRHRSIHTGDRPYECSECEKSFSRKFILIQHQRVHTGERPYECSECGKSFTRKSDLIQHRRIHTGTRPYECSECGKSFRQRSGLIQHRRLHTGERPYECSECGKSFSQSASLIQHQRVHTGERPYECSECGKSFSQSSSLIQHQRGHTGERPYECSQCGKPFTHKSDLIQHQRVHTGERPYECSECGKSFSRKSNLIRHRRVHTEERP

SEQ ID NO: 6962 - protein, 670 aa, Homo sapiens
MPAPVGRRSPPSPRSSMAAVALRDSAQGMTFEDVAIYFSQEEWELLDESQRFLYCDVMLENFAHVTSLGYCHGMENEAIASEQSVSIQVRTSKGNTPTQKTHLSEIKMCVPVLKDILPAAEHQTTSPVQKSYLGSTSMRGFCFSADLHQHQKHYNEEEPWKRKVDEATFVTGCRFHVLNYFTCGEAFPAPTDLLQHEATPSGEEPHSSSSKHIQAFFNAKSYYKWGEYRKASSHKHTLVQHQSVCSEGGLYECSKCEKAFTCKNTLVQHQQIHTGQKMFECSECEESFSKKCHLILHKIIHTGERPYECSDREKAFIHKSEFIHHQRRHTGGVRHECGECRKTFSYKSNLIEHQRVHTGERPYECGECGKSFRQSSSLFRHQRVHSGERPYQCCECGKSFRQIFNLIRHRRVHTGEMPYQCSDCGKSFSCKSELIQHQRIHSGERPYECRECGKSFRQFSNLIRHRSIHTGDRPYECSECEKSFSRKFILIQHQRVHTGERPYECSECGKSFTRKSDLIQHRRIHTGTRPYECSECGKSFRQRSGLIQHRRLHTGERPYECSECGKSFSQSASLIQHQRVHTGERPYECSECGKSFSQSSSLIQHQRGHTGERPYECSQCGKPFTHKSDLIQHQRVHTGERPYECSECGKSFSRKSNLIRHRRVHTEERP

SEQ ID NO: 6963 - protein, 422 aa, Homo sapiens
MTFEDVAIYFSQEEWELLDESQRFLYCDVMLENFAHVTSLVTSHQKHYNEEEPWKRKVDEATFVTGCRFHVLNYFTCGEAFPAPTDLLQHEATPSGEEPHSSSSKHIQAFFNAKSYYKWGEYRKASSHKHTLVQHQSRVHTGERPYECGECGKSFRQSSSLFRHQRVHSGERPYQCCECGKSFRQIFNLIRHRRVHTGEMPYQCSDCGKSFSCKSELIQHQRIHSGERPYECRECGKSFRQFSNLIRHRSIHTGDRPYECSECEKSFSRKFILIQHQRVHTGERPYECSECGKSFTRKSDLIQHRRIHTGTRPYECSECGKSFRQRSGLIQHRRLHTGERPYECSECGKSFSQSASLIQHQRVHTGERPYECSECGKSFSQSSSLIQHQRGHTGERPYECSQCGKPFTHKSDLIQHQRVHTG

SEQ ID NO: 6964 - protein, 407 aa, Homo sapiens
MAAAALRFPVQGTVTFEDVAVKFTQEEWNLLSEAQRCLYRDVTLENLALMSSLGCWCGVEDEAAPSKQSIYIQRETQVRTPMAGVSPKKAHPCEMCGPILGDILHVADHQGTHHKQKLHRCEAWGNKLYDSGNFHQHQNEHIGEKPYRGSVEEALFAKRCKLHVSGESSVFSESGKDFLLRSGLLQQEATHTGKSNSKTECVSLFHGGKSHYSCGGCMKHFSTKDILSQHERLLPTEEPSVWCECGKSSSKYDSFSNHQGVHTREKPYTCGICGKLFNSKSHLLVHQRIHTGEKPYECEVCQKFFRHKYHLIAHQRVHTGERPYECSDCGKSFTHSSTFRVHKRVHTGQKPYECSECGKSFAESSSLTKHRRVHTGEKPYGCSECEKKFRQISSLRHHQRVHKRKGL

SEQ ID NO: 6965 - protein, 538 aa, Homo sapiens
MVTCAHLGRRARLPAAQPSACPGTCFSQEERMAAGYLPRWSQELVTFEDVSMDFSQEEWELLEPAQKNLYREVMLENYRNVVSLEALKNQCTDVGIKEGPLSPAQTSQVTSLSSWTGYLLFQPVASSHLEQREALWIEEKGTPQASCSDWMTVLRNQDSTYKKVALQEEPASGINMIKLIREDGGWKQLEDSHEDPQGLLSQKASLHVVAVPQEKATAWHGFGENGNLSPALVLSQGSSKGNHLCGSELDITSLASDSVLNHHQLGYADRRPCESNECGNAIRQNSHFIQHGGKMFVYLENGQSLNHGMALTIHNKINTAEKPFECHQCGKVFNRRHSLSEHQRIHTGEKPYECQECGRAFTHSSTLTRHLRTHTGEKPYGCGECGKAFNRISSLTQHQRIHTGEKPYKCEDCGKSFCQSSYLILHKRTHTGEKPYECSECGKAFSDRSSLNQHERTHTGENPYECKQCGRAFSQRSSLVRHERTHTGEKPYRCQECGKAFSQSSSLVTHQKTHSSQKTYKIIDCGKAFYQNRHLIGY

SEQ ID NO: 6966 - protein, 628 aa, Homo sapiens
MDSVVFEDVAVDFTLEEWALLDSAQRDLYRDVMLETFQNLASVDDETQFKASGSVSQQDIYGEKIPKESKIATFTRNVSWASVLGKIWDSLSIEDQTTNQGRNLSRNHGLERLCESNDQCGEALSQIPHLNLYKKIPPGVKQYEYNTYGKVFMHRRTSLKSPITVHTGHKPYQCQECGQAYSCRSHLRMHVRTHNGERPYVCKLCGKTFPRTSSLNRHVRIHTAEKTYECKQCGKAFIDFSSLTSHLRSHTGEKPYKCKECGKAFSYSSTFRRHTITHTGEKPYKCKECAEAFSYSSTFRRHMISHTGEKPHKCKECGEAFSYSSAFRRHMITHTGEKPYECKQCGKTFIYLQSFRRHERIHTGEKPYECKQCGKTFIYPQSFRRHERTHGGEKPYECNQCGKAFSHPSSFRGHMRVHTGEKPYECKQCGKTFNWPISLRKHMRTHTREKPYECKQCGKAFSLSACFREHVRMHPEDKSYECKLCGKAFYCHISLQKHMRRHTAEKLYKCKQCGKAFSWPELLQQHVRTHTVEKPYECKECGKVFKWPSSLPIHMRLHTGEKPYQCKHCGKAFNCSSSLRRHVRIHTTEKQYKCNVGHPPANEFMCSASEKSHQERDLIKVVNMVLPL

SEQ ID NO: 6967 - protein, 543 aa, Homo sapiens
MDSVVFEDVAVDFTLEEWALLDSAQRDLYRDVMLETFQNLASVDDETQFKASGSVSQQDIYGEKIPKESKIATFTRNVSWASVLGKIWDSLSIEDQTTNQGRNLRNHGLERLCESNDQCGEALSQIPHLNLYKKIPPGVKQYEYNTYGKVFMHRRTSLKSPITVHTGHKPYQCQECGQAYSCRSHLRMHVRTHNGERPYVCKLCGKTFPRTSSLNRHVRIHTAEKTYECKQCGKAFIDFSSLTSHLRSHTGEKPYKCKECGKAFSYSSTFRRHTITHTGEKPYKCKECAEAFSYSSTFRRHMISHTGEKPHKCKECGEAFSYSSAFRRHMITHTGEKPYECKQCGKTFIYLQSFRRHERIHTGEKPYECKQCGKTFIYPQSFRRHERTHGGEKPYECNQCGKAFSHPSSFRGHMRVHTGEKPYECKQCGKTFNWPISLRKHMRTHTREKPYECKECGKVFKWPSSLPIHMRLHTGEKPYQCKHCGKAFNCSSSLRRHVRIHTTEKQYKCNVGHPPANEFMCSASEKSHQERDLIKVVNMVLPL

SEQ ID NO: 6968 - protein, 456 aa, Homo sapiens
MDTVVFEDVVVDFTLEEWALLNPAQRKLYRDVMLETFKHLASVDNEAQLKASGSISQQDTSGEKLSLKQKIEKFTRKNIWASLLGKNWEEHSVKDKHNTKERHLSRNPRVERPCKSSKGNKRGRTFRKTRNCNRHLRKNCCTSVRRYECSQCGKLFTHSSSLIRHKRAHSGQKLYKCKECGKAFSRPSYLQTHEKTHSGEKPYACQSCGKTFLRSHSLTEHVRTHTGEKPYECGQCGKGFSCPKSFRAHVMMHAGGRPYECKHCGKAFRCQKSFRVHMIMHAGGRPYECKQCGKAYCWATSFQRHVRIHNGEKPYKCGKCGKAFGWPSSLHKHARTHAKKKPVSGGSVGKSSARPRPSTDVKSQTREKVYKCETCGKTYGWSSSLHKHERKHTGEKPVNAASVGKPSGGLCSSKNVRTQIGQKPSKCEKCGKAFSCPKAFQGHVRSHTGKKSCTSK

SEQ ID NO: 6969 - protein, 430 aa, Homo sapiens
MAAVVLPPTAALSSLFPASQREGHTEGGELVNELLKSWLKGLVTFEDVAVEFTQEEWALLDPAQRTLYRDVMLENCRNLASLGNQVDKPRLISQLEQEDKVMTEERGILSGTCPDVENPFKAKGLTPKLHVFRKEQSRNMKMERNHLGATLNECNQCFKVFSTKSSLTRHRKIHTGERPYGCSECGKSYSSRSYLAVHKRIHNGEKPYECNDCGKTFSSRSYLTVHKRIHNGEKPYECSDCGKTFSNSSYLRPHLRIHTGEKPYKCNQCFREFRTQSIFTRHKRVHTGEGHYVCNQCGKAFGTRSSLSSHYSIHTGEYPYECHDCGRTFRRRSNLTQHIRTHTGEKPYTCNECGKSFTNSFSLTIHRRIHNGEKSYECSDCGKSFNVLSSVKKHMRTHTGKKPYECNYCGKSFTSNSYLSVHTRMHNRQM

SEQ ID NO: 6970 - protein, 430 aa, Homo sapiens; identical to SEQ ID NO: 6969

SEQ ID NO: 6971 - protein, 423 aa, Homo sapiens
MAAVVLPPTAASQREGHTEGGELVNELLKSWLKGLVTFEDVAVEFTQEEWALLDPAQRTLYRDVMLENCRNLASLGNQVDKPRLISQLEQEDKVMTEERGILSGTCPDVENPFKAKGLTPKLHVFRKEQSRNMKMERNHLGATLNECNQCFKVFSTKSSLTRHRKIHTGERPYGCSECGKSYSSRSYLAVHKRIHNGEKPYECNDCGKTFSSRSYLTVHKRIHNGEKPYECSDCGKTFSNSSYLRPHLRIHTGEKPYKCNQCFREFRTQSIFTRHKRVHTGEGHYVCNQCGKAFGTRSSLSSHYSIHTGEYPYECHDCGRTFRRRSNLTQHIRTHTGEKPYTCNECGKSFTNSFSLTIHRRIHNGEKSYECSDCGKSFNVLSSVKKHMRTHTGKKPYECNYCGKSFTSNSYLSVHTRMHNRQM

SEQ ID NO: 6972 - protein, 402 aa, Homo sapiens
MAAVILPSTAAPSSLFPASQQKGHTQGGELVNELLTSWLRGLVTFEDVAVEFTQEEWALLDPAQRTLYRDVMLENCRNLASLGCRVNKPSLISQLEQDKKVVTEERGILPSTCPDLETLLKAKWLTPKKNVFRKEQSKGVKTERSHRGVKLNECNQCFKVFSTKSNLTQHKRIHTGEKPYDCSQCGKSFSSRSYLTIHKRIHNGEKPYECNHCGKAFSDPSSLRLHLRIHTGEKPYECNQCFHVFRTSCNLKSHKRIHTGENHHECNQCGKAFSTRSSLTGHNSIHTGEKPYECHDCGKTFRKSSYLTQHVRTHTGEKPYECNECGKSFSSSFSLTVHKRIHTGEKPYECSDCGKAFNNLSAVKKHLRTHTGEKPYECNHCGKSFTSNSYLSVHKRIHNRWI

SEQ ID NO: 6973 - protein, 331 aa, Homo sapiens
MLENCRNLASLGCRVNKPSLISQLEQDKKVVTEERGILPSTCPDLETLLKAKWLTPKKNVFRKEQSKGVKTERSHRGVKLNECNQCFKVFSTKSNLTQHKRIHTGEKPYDCSQCGKSFSSRSYLTIHKRIHNGEKPYECNHCGKAFSDPSSLRLHLRIHTGEKPYECNQCFHVFRTSCNLKSHKRIHTGENHHECNQCGKAFSTRSSLTGHNSIHTGEKPYECHDCGKTFRKSSYLTQHVRTHTGEKPYECNECGKSFSSSFSLTVHKRIHTGEKPYECSDCGKAFNNLSAVKKHLRTHTGEKPYECNHCGKSFTSNSYLSVHKRIHNRWI

SEQ ID NO: 6974 - protein, 538 aa, Homo sapiens
MVAGWLTNYSQDSVTFEDVAVDFTQEEWTLLDQTQRNLYRDVMLENYKNLVAVDWESHINTKWSAPQQNFLQGKTSSVVEMERNHFGEELFDFNQCEKALSEHSCLKTHRRTYFRKKTCECNQCEKAFRKPSIFTLHKKTDIGEELPNCNQCETAFSQHLHLVCKKTSQNLHLVCKKTHTQEKPYKCSDCEKGLPSSSHLRECVRIYGGERPYTHKEYVETFSHSTALFVHMQTQDGEKFYECKACGKPFTESSYLTQHLRTHSRVLPIEHKKFGKAFAFSPDLAKHIRLRTRGKHYVCNECGKEFTCFSKLNIHIRVHTGEKPYECNKCGKAFTDSSGLIKHRRTHTGEKPYECKECGKAFANSSHLTVHMRTHTGEKPYQCKECGKAFINSSSFKSHMQTHPGVKPYDCQQCGKAFIRSSFLIRHLRSHSAERPFECEECGKAFRYSSHLSQHKRIHTGERPYKCQKCGQAFSISSGLTVHMRTHTGERPFECQECGKAFTRSTYLIRHLRSHSVEKPYKECGQTFSNSSCLTECV

SEQ ID NO: 6975 - protein, 538 aa, Homo sapiens; identical to SEQ ID NO: 6974

SEQ ID NO: 6976 - protein, 458 aa, Homo sapiens
MERNHFGEELFDFNQCEKALSEHSCLKTHRRTYFRKKTCECNQCEKAFRKPSIFTLHKKTDIGEELPNCNQCETAFSQHLHLVCKKTSQNLHLVCKKTHTQEKPYKCSDCEKGLPSSSHLRECVRIYGGERPYTHKEYVETFSHSTALFVHMQTQDGEKFYECKACGKPFTESSYLTQHLRTHSRVLPIEHKKFGKAFAFSPDLAKHIRLRTRGKHYVCNECGKEFTCFSKLNIHIRVHTGEKPYECNKCGKAFTDSSGLIKHRRTHTGEKPYECKECGKAFANSSHLTVHMRTHTGEKPYQCKECGKAFINSSSFKSHMQTHPGVKPYDCQQCGKAFIRSSFLIRHLRSHSAERPFECEECGKAFRYSSHLSQHKRIHTGERPYKCQKCGQAFSISSGLTVHMRTHTGERPFECQECGKAFTRSTYLIRHLRSHSVEKPYKECGQTFSNSSCLTECV

SEQ ID NO: 6977 - protein, 538 aa, Homo sapiens; identical to SEQ ID NO: 6974

SEQ ID NO: 6978 - protein, 790 aa, Homo sapiens
MAYCLTNCYQYSVTFEDTAVDFTQEEWILLDPVQRNLYRDVMLENYENVAKVGFQLFKPSVISWLEEEELRTLQQGVLQDWAIKHQTSVSALQQEFWKIQTSNGIQMDLVTFDSVAVEFTQEEWTLLDPAQRNLYSDVMLENYKNLSSVGYQLFKPSLISWLEEEEELSTLPRVLQEWKMCLKTKGPALWQDNFCLKTLNGIQLARNQNGEELYDCKQCEDVFCKHPCLKTNMSTQNRGNTSECIQYAKDLLSLYNKTSTIRKVSVFSKHGKSFRLILNVQVQRKCTQDKSFEGTDYGKAFIYQSYLEAHRKTQSGEKLNEWKQCGEAFTHSTSHAVNVETHIIKNPYECKECGKDFRYPTHLNNHMQTHIGIKPYKCKHCGKTFTVPSGFLEHVRTHTGEKPYGCKECGKAFGTSAGLIEHIRCHAREKTFKCDHCGKAFISYPSLFGHLRVHNGEKPYEHKEYGKAFGTSSGVIEDRRSNTGQKRFDCDQCGKVFVSFSSLFAHLRTHTGEKPFKCYKCGKPFTSSACLRIHMRTHTEERLYQCKKCGKAFTKCSYLTKHLRTHAGEKPYECMKCGKAFTERSYLTKHLRRHSGEKPYECKKCGKAFTERSDLTKHLRRHTGDKPYEYKDCGKAFVVSSSLVDHLRTHTGYKPYKCNACEKAYSRSCVLTQHLKTHAAEKTSECNACGNSFRNSMCFHDRLKTLTKIKPYKCKDCGKAFTCHSDLTNHVRIHTGEKPYKCKECGKAFRTSSGRIQHLRTHMGEKPFECDQCGKAFASFSARIAHLKTH

SEQ ID NO: 6979 - protein, 486 aa, Homo sapiens
MAAIYLSRGFFSREPICPFEEKTKVERMVEDYLASGYQDSVTFDDVAVDFTPEEWALLDTTEKYLYRDVMLENYMNLASVEWEIQPRTKRSSLQQGFLKNQIFSGIQMTRGYSGWKLCDCKNCGEVFREQFCLKTHMRVQNGGNTSEGNCYGKDTLSVHKEASTGQELSKFNPCGKVFTLTPGLAVHLEVLNARQPYKCKECGKGFKYFASLDNHMGIHTDEKLCEFQEYGRAVTASSHLKQCVAVHTGKKSKKTKKCGKSFTNFSQLYAPVKTHKGEKSFECKECGRSFRNSSCLNDHIQIHTGIKPHKCTYCGKAFTRSTQLTEHVRTHTGIKPYECKECGQAFAQYSGLSIHIRSHSGKKPYQCKECGKAFTTSTSLIQHTRIHTGEKPYECVECGKTFITSSRRSKHLKTHSGEKPFVCKICGKAFLYSSRLNVHLRTHTGEKPFVCKECGKAFAVSSRLSRHERIHTGEKPYECKDMSVTI

SEQ ID NO: 6980 - protein, 350 aa, Homo sapiens
MRVQNGGNTSEGNCYGKDTLSVHKEASTGQELSKFNPCGKVFTLTPGLAVHLEVLNARQPYKCKECGKGFKYFASLDNHMGIHTDEKLCEFQEYGRAVTASSHLKQCVAVHTGKKSKKTKKCGKSFTNFSQLYAPVKTHKGEKSFECKECGRSFRNSSCLNDHIQIHTGIKPHKCTYCGKAFTRSTQLTEHVRTHTGIKPYECKECGQAFAQYSGLSIHIRSHSGKKPYQCKECGKAFTTSTSLIQHTRIHTGEKPYECVECGKTFITSSRRSKHLKTHSGEKPFVCKICGKAFLYSSRLNVHLRTHTGEKPFVCKECGKAFAVSSRLSRHERIHTGEKPYECKDMSVTI

SEQ ID NO: 6981 - protein, 76 aa, Homo sapiens
MAAIYLSRGFFSREPICPFEEKTKVERMVEDYLASGYQDSVTFDDVAVDFTPEEWALLDTTEKYLYRDVMLENYMN

SEQ ID NO: 6982 - protein, 417 aa, Homo sapiens
MLENYMNLASVEWEIQPRTKRSSLQQGFLKNQIFSGIQMTRGYSGWKLCDCKNCGEVFREQFCLKTHMRVQNGGNTSEGNCYGKDTLSVHKEASTGQELSKFNPCGKVFTLTPGLAVHLEVLNARQPYKCKECGKGFKYFASLDNHMGIHTDEKLCEFQEYGRAVTASSHLKQCVAVHTGKKSKKTKKCGKSFTNFSQLYAPVKTHKGEKSFECKECGRSFRNSSCLNDHIQIHTGIKPHKCTYCGKAFTRSTQLTEHVRTHTGIKPYECKECGQAFAQYSGLSIHIRSHSGKKPYQCKECGKAFTTSTSLIQHTRIHTGEKPYECVECGKTFITSSRRSKHLKTHSGEKPFVCKICGKAFLYSSRLNVHLRTHTGEKPFVCKECGKAFAVSSRLSRHERIHTGEKPYECKDMSVTI

SEQ ID NO: 6983 - protein, 41 aa, Homo sapiens
MAAIYLSRGFFSREPICPFEEKTKVERMVEDYLASGYQDSV

SEQ ID NO: 6984 - protein, 354 aa, Homo sapiens
MSAFDMSHDFFFCLTSEWEIQPRTKRSSLQQGFLKNQIFTGIQMQTRSYSGWKLCENCGEVFSEQFCLKTHMRAQNGGNTFEGNCYGKDSISVHKEASIGQELSKFNPCGKVFTLTPGLAVHLEILNGRQPYKCKECGKGFKYFASLDNHMGIHIGEKLCEFQECERAITTSSHLKQCVAVHTGKKSEKTKNCGKSFTNFSQLSAHAKTHKGEKSFECKECGRSFRNSSSFNVHIQIHTGIKPHKCTECGKAFTRSTHLTQHVRTHTGIKPYECKECGQAFTQYTGLAIHIRNHTGEKPYQCKECGKAFNRSSTLTQHRRIHTGEKPYECVECGKTFITSSHRSKHLKTHSGER

SEQ ID NO: 6985 - protein, 426 aa, Homo sapiens
MSAFDMSHGFFPREPICPFEEKTKIGTMVEDHRSNSYQDSVTFDDVAVEFTPEEWALLDTTQKYLYRDVMLENYMNLASVDFFFCLTSEWEIQPRTKRSSLQQGFLKNQIFTGIQMQTRSYSGWKLCENCGEVFSEQFCLKTHMRAQNGGNTFEGNCYGKDSISVHKEASIGQELSKFNPCGKVFTLTPGLAVHLEILNGRQPYKCKECGKGFKYFASLDNHMGIHIGEKLCEFQECERAITTSSHLKQCVAVHTGKKSEKTKNCGKSFTNFSQLSAHAKTHKGEKSFECKECGRSFRNSSSFNVHIQIHTGIKPHKCTECGKAFTRSTHLTQHVRTHTGIKPYECKECGQAFTQYTGLAIHIRNHTGEKPYQCKECGKAFNRSSTLTQHRRIHTGEKPYECVECGKTFITSSHRSKHLKTHSGER

SEQ ID NO: 6986 - protein, 426 aa, Homo sapiens; identical to SEQ ID NO: 6985

SEQ ID NO: 6987 - protein, 357 aa, Homo sapiens
MLENYMNLASVDFFFCLTSEWEIQPRTKRSSLQQGFLKNQIFTGIQMQTRSYSGWKLCENCGEVFSEQFCLKTHMRAQNGGNTFEGNCYGKDSISVHKEASIGQELSKFNPCGKVFTLTPGLAVHLEILNGRQPYKCKECGKGFKYFASLDNHMGIHIGEKLCEFQECERAITTSSHLKQCVAVHTGKKSEKTKNCGKSFTNFSQLSAHAKTHKGEKSFECKECGRSFRNSSSFNVHIQIHTGIKPHKCTECGKAFTRSTHLTQHVRTHTGIKPYECKECGQAFTQYTGLAIHIRNHTGEKPYQCKECGKAFNRSSTLTQHRRIHTGEKPYECVECGKTFITSSHRSKHLKTHSGER

SEQ ID NO: 6988 - protein, 310 aa, Homo sapiens
MTRSYSGWKLCENCGEVFSEQFCLKTHMRAQNGGNTFEGNCYGKDSISVHKEASIGQELSKFNPCGKVFTLTPGLAVHLEILNGRQPYKCKECGKGFKYFASLDNHMGIHIGEKLCEFQECERAITTSSHLKQCVAVHTGKKSEKTKNCGKSFTNFSQLSAHAKTHKGEKSFECKECGRSFRNSSSFNVHIQIHTGIKPHKCTECGKAFTRSTHLTQHVRTHTGIKPYECKECGQAFTQYTGLAIHIRNHTGEKPYQCKECGKAFNRSSTLTQHRRIHTGEKPYECVECGKTFITSSHRSKHLKTHSGER

SEQ ID NO: 6989 - protein, 389 aa, Homo sapiens
MDSVTFDDVAVEFTPEEWALLDTTQKYLYRDVMLENYMNLASVDFFFCLTSEWEIQPRTKRSSLQQGFLKNQIFTGIQMQTRSYSGWKLCENCGEVFSEQFCLKTHMRAQNGGNTFEGNCYGKDSISVHKEASIGQELSKFNPCGKVFTLTPGLAVHLEILNGRQPYKCKECGKGFKYFASLDNHMGIHIGEKLCEFQECERAITTSSHLKQCVAVHTGKKSEKTKNCGKSFTNFSQLSAHAKTHKGEKSFECKECGRSFRNSSSFNVHIQIHTGIKPHKCTECGKAFTRSTHLTQHVRTHTGIKPYECKECGQAFTQYTGLAIHIRNHTGEKPYQCKECGKAFNRSSTLTQHRRIHTGEKPYECVECGKTFITSSHRSKHLKTHSGER

SEQ ID NO: 6990 - protein, 476 aa, Homo sapiens
MDAVAFEDVAVNFTQEEWALLGPSQKNLYRYVMQETIRNLDCIRMIWEEQNTEDQYKNPRRNLRCHMVERFSESKDSSQCGETFSLIRDSIVNNSICPGEDPCQSAECEEVIMGHLSLNSHIRVDSGHKPHEYQEYGEKPHTHKQRGKAFSYHHSFQSRGRPHTGKKRYECKECGKTFSSRRNLRRHMVVQGGNRPYKCKLCGKAFFWPSLLRMHERTHTGEKPYECKQCSKAFPFYSSYRRHERMHTGEKPYECKQCSKALPDSSSYIRHERTHTGEKPYTCKQCGKAFSVSSSLRRHETTHSAEKPYECKQCGKTFHHLGSFQIHMKRHTGDRPHKCKICGKGFDRPSLVRYHERIHTGEKPYECKQCGKTLSHSSSFRRHMIMHTGGGPHKCKICGKAFVYPSVCQRHEKSHSGEKPYECKQCGKALSHSSSFRRHMVMHTGDGPNKCKVCGKAFVYPSVCQRHEKTHWRETI

SEQ ID NO: 6991 - protein, 229 aa, Homo sapiens
MDAVAFEDVAVNFTQEEWALLGPSQKNLYRYVMQETIRNLDCIRMIWEEQNTEDQYKNPRRNLRCHMVERFSESKDSSQCGETFSLIRDSIVNNSICPGEDPCQSAECEEVIMGHLSLNSHIRVDSGHKPHEYQEYGEKPHTHKQRGKAFSYHHSFQSRGRPHTGKKRYECKECGKTFSSRRNLRRHMVVQGGNRPYKFPIEDMRECTLGRNRMNVSSVLKPCLIPVPI

SEQ ID NO: 6992 - protein, 553 aa, Homo sapiens
MDSVASEDVAVNFTLEEWALLDPSQKKLYRDVMRETFRNLACVGKKWEDQSIEDWYKNQGRILRNHMEEGLSESKEYDQCGEAFSQILNLNLNKKIPTIVRPCECSLCGKVFMHHSSLSRHIRSHLGHKPYDYQEYGEKPYKCKQCGKAFSSCQSFRRHERTHTGEKPYACPECGKAFISLPSVRRHMIKHTGDGPYKCQECGKAFDRPSLFQIHERTHTGEKPYECQECAKAFISLPSFQRHMIRHTGDGPYKCQECGKAFDRPSLFRIHERTHTGEKPHECKQCGKAFISFTNFQSHMIRHTGDGPYKCKVCGRAFIFPSYVRKHERTHTGEKPYECNKCGKTFSSSSNVRTHERTHTGEKPYECKECGKAFISLPSVRRHMIKHTGDGPYKCQVCGRAFDCPSSFQIHERTHTGEKPYECQVCGKAFISLKRIRKHMILHTGDGPYKCQVCGKAFDCPSSVRTHERTHTGEKPYECKECGKAFNYASSIRIHERTHTGEKPYECKQCGKTFSYSSSFQRHERAHNGDKPYVKNVGKLSFITQPSNTCENE

SEQ ID NO: 6993 - protein, 419 aa, Homo sapiens
MAQESVMFSDVSVDFSQEEWECLNDDQRDLYRDVMLENYSNLVSMAGHSISKPNVISYLEQGKEPWLADRELTRGQWPVLESRCETKKLFLKKEIYEIESTQWEIMEKLTRRDFQCSSFRDDWECNRQFKKELGSQGGHFNQLVFTHEDLPTLSHHPSFTLQQIINSKKKFCASKEYRKTFRHGSQFATHEIIHTIEKPYECKECGKSFRHPSRLTHHQKIHTGKKPFECKECGKTFICGSDLTRHHRIHTGEKPYECKECGKAFSSGSNFTRHQRIHTGEKPYECKECGKAFSSGSNFTQHQRIHTGEKPYECKECGNAFSQSSQLIKHQRIHTGEKPYECKECEKAFRSGSDLTRHQRIHTGEKPYECKICGKAYSQSSQLISHHRIHTSEKPYEYRECGKNFNYDPQLIQHQNLYW

SEQ ID NO: 6994 - protein, 418 aa, Homo sapiens
MAQESVMFSDVSVDFSQEEWECLNDDQRDLYRDVMLENYSNLVSMGHSISKPNVISYLEQGKEPWLADRELTRGQWPVLESRCETKKLFLKKEIYEIESTQWEIMEKLTRRDFQCSSFRDDWECNRQFKKELGSQGGHFNQLVFTHEDLPTLSHHPSFTLQQIINSKKKFCASKEYRKTFRHGSQFATHEIIHTIEKPYECKECGKSFRHPSRLTHHQKIHTGKKPFECKECGKTFICGSDLTRHHRIHTGEKPYECKECGKAFSSGSNFTRHQRIHTGEKPYECKECGKAFSSGSNFTQHQRIHTGEKPYECKECGNAFSQSSQLIKHQRIHTGEKPYECKECEKAFRSGSDLTRHQRIHTGEKPYECKICGKAYSQSSQLISHHRIHTSEKPYEYRECGKNFNYDPQLIQHQNLYW

SEQ ID NO: 6995 - protein, 158 aa, Homo sapiens
MAQESVMFSDVSVDFSQEEWECLNDDQRDLYRDVMLENYSNLVSMAGHSISKPNVISYLEQGKEPWLADRELTRGQWPVLESRCETKKLFLKKEIYEIESTQWEIMEKLTRRDFQCSSFRDDWECNRQFKKELGSQGGHFNQLVFTHEDLPTLSHHPS

SEQ ID NO: 6996 - protein, 418 aa, Homo sapiens; identical to SEQ ID NO: 6994

SEQ ID NO: 6997 - protein, 419 aa, Homo sapiens; identical to SEQ ID NO: 6993

SEQ ID NO: 6998 - protein, 644 aa, Homo sapiens
MTSQSSVISNSCVTMERLSHMMERKAWCSQESALSEEEEDTTRPLETVTFKDVAVDLTQEEWEQMKPAQRNLYRDVMLENYSNLVTVGCQVTKPDVIFKLEQEEEPWVMEEEMFGRHCPEVWEVDEQIKKQQETLVRKVTSISKKILIKEKVIECKKVAKIFPLSSDIVTSRQSFYDCDSLDKGLEHNLDLLRYEKGCVREKQSNEFGKPFYHCASYVVTPFKCNQCGQDFSHKFDLIRHERIHAGEKPYECKECGKAFSRKENLITHQKIHTGEKPYKCNECGKAFIQMSNLIRHHRIHTGEKPYACKDCWKAFSQKSNLIEHERIHTGEKPYECKECGKSFSQKQNLIEHEKIHTGEKPYACNECGRAFSRMSSVTLHMRSHTGEKPYKCNKCGKAFSQCSVFIIHMRSHTGEKPYVCSECGKAFSQSSSLTVHMRNHTAEKPYECKECGKAFSRKENLITHQKIHTGEKPYECSECGKAFIQMSNLIRHQRIHTGEKPYACTVCGKAFSQKSNLTEHEKIHTGEKPYHCNQCGKAFSQRQNLLEHEKIHTGEKPFKCNECGKAFSRISSLTLHVRSHTGEKPYECNKCGKAFSQCSLLIIHMRSHTGEKPFECNECGKAFSQRASLSIHKRGHTGERHQVY

SEQ ID NO: 6999 - protein, 580 aa, Homo sapiens
MKPAQRNLYRDVMLENYSNLVTVGCQVTKPDVIFKLEQEEEPWVMEEEMFGRHCPEVWEVDEQIKKQQETLVRKVTSISKKILIKEKVIECKKVAKIFPLSSDIVTSRQSFYDCDSLDKGLEHNLDLLRYEKGCVREKQSNEFGKPFYHCASYVVTPFKCNQCGQDFSHKFDLIRHERIHAGEKPYECKECGKAFSRKENLITHQKIHTGEKPYKCNECGKAFIQMSNLIRHHRIHTGEKPYACKDCWKAFSQKSNLIEHERIHTGEKPYECKECGKSFSQKQNLIEHEKIHTGEKPYACNECGRAFSRMSSVTLHMRSHTGEKPYKCNKCGKAFSQCSVFIIHMRSHTGEKPYVCSECGKAFSQSSSLTVHMRNHTAEKPYECKECGKAFSRKENLITHQKIHTGEKPYECSECGKAFIQMSNLIRHQRIHTGEKPYACTVCGKAFSQKSNLTEHEKIHTGEKPYHCNQCGKAFSQRQNLLEHEKIHTGEKPFKCNECGKAFSRISSLTLHVRSHTGEKPYECNKCGKAFSQCSLLIIHMRSHTGEKPFECNECGKAFSQRASLSIHKRGHTGERHQVY

SEQ ID NO: 7000 - protein, 571 aa, Homo sapiens
MKPAQRNLYRDVMLENYSNLVTVGCQVTKPDVIFKLEQEEEPWVMEEEMFGRHCPEPRRGENCCASEVMAEGLKFKDVVIYFSQKEWECLHSAQKDLYRDVMLENYGNLVLLGLSDTKPNVISLLEQKKEPWMVKRKETKEWCPDWEFGRETKNLSPKENIYEIRSPQQEKARVIREIRCQVERQQGHQEGHFRPAVIPFTSMQCTAHREYQWLHTGEKSCECRKCKNAFRYQSCPIQHEIIHNKEKEPECGECRKIFNSGSDLIKHQTLHESKKHSENNKCAFNHDSGITQPQSINTGEKPHKCKECGKAFRSSSQISQHQRMHLGEKPYKCRECGKAFPSTAQLNLHQRIHTDEKYYESKACGKAFTRPSHLFRHQRIHTGEKPHKCKECGKAFRYDTQLSLHQIIHTGERRYECRECGKVYSCASQLSLHQRIHTGEKPHECKECGKAFISDSHLIRHQSVHTGEKPCKCKECGKSFRRGSELTRHQRAHTGEKPYECKECEKAFTCSTELVRHQKVHTGERPHKCKECGKAFIRRSELTHHERSHTGEKPYECKECGKPFGGGSELS

SEQ ID NO: 7001 - protein, 583 aa, Homo sapiens
MTSQSSVISNSCVTMERLSHMMERKAWCSQESALSEEEEDTTRPLETVTFKDVAVDLTQEEWEQMKPAQRNLYRDVMLENYSNLVTVGCQVTKPDVIFKLEQEEEPWVMEEEMFGRHCPEPRRGENCCASEVMAEGLKFKDVVIYFSQKEWECLHSAQKDLYRDVMLENYGNLVLLGLSDTKPNVISLLEQKKEPWMVKRKETKEWCPDWEFGRETKNLSPKENIYEIRSPQQEKARVIREIRCQVERQQGHQEGHFRPAVIPFTSMQCTAHREYQWLHTGEKSCECRKCKNAFRYQSCPIQHEIIHNKEKEPECGECRKIFNSGSDLIKHQTLHESKKHSENNKCAFNHDSGITQPQSINTGEKPHKCKECGKAFRSSSQISQHQRMHLGEKPYKCRECGKAFPSTAQLNLHQRIHTDEKYYESKACGKAFTRPSHLFRHQRIHTGEKPHKCKECGKAFRYDTQLSLHQIIHTGERRYECRECGKVYSCASQLSLHQRIHTGEKPHECKECGKAFISDSHLIRHQSVHTGEKPCKCKECGKSFRRGSELTRHQRAHTGEKPYECKECEKAFTCSTELVRHQK

SEQ ID NO: 7002 - protein, 555 aa, Homo sapiens
MDSVVFEDVAVDFTLEEWALLDSAQRDLYRDVMLETFRNLASVDDGTQFKANGSVSLQDMYGQEKSKEQTIPNFTGNNSCAYTLEKNCEGYGTEDHHKNLRNHMVDRFCTHNEGNQYGEAIHQMPDLTLHKKVSAGEKPYECTKCRTVFTHLSSLKRHVKSHCGRKAPPGEECKQACICPSHLHSHGRTDTEEKPYKCQACGQTFQHPRYLSHHVKTHTAEKTYKCEQCRMAFNGFASFTRHVRTHTKDRPYKCQECGRAFIYPSTFQRHMTTHTGEKPYKCQHCGKAFTYPQAFQRHEKTHTGEKPYECKQCGKTFSWSETLRVHMRIHTGDKLYKCEHCGKAFTSSRSFQGHLRTHTGEKPYECKQCGKAFTWSSTFREHVRIHTQEQLYKCEQCGKAFTSSRSFRGHLRTHTGEKPYECKQCGKTFTWSSTFREHVRIHTQEQLHKCEHCGKAFTSSRAFQGHLRMHTGEKPYECKQCGKTFTWSSTLHNHVRMHTGEKPHKCKQCGMSFKWHSSFRNHLRMHTGQKSHECQSYSKAFSCQVILSKTSESTH

SEQ ID NO: 7003 - protein, 557 aa, Homo sapiens [sequence omitted]

SEQ ID NO: 7004 - protein, 536 aa, Homo sapiens
MAVGLLKAMYQELVTFRDVAVDFSQEEWDCLDSSQRHLYSNVMLENYRILVSLGLCFSKPSVILLLEQGKAPWMVKRELTKGLCSGWEPICETEELTPKQDFYEEHQSQKIIETLTSYNLEYSSLREEWKCEGYFERQPGNQKACFKEEIITHEEPLFDEREQEYKSWGSFHQNPLLCTQKIIPKEEKVHKHDTQKRSFKKNLMAIKPKSVCAEKKLLKCNDCEKVFSQSSSLTLHQRIHTGEKPYKCIECGKAFSQRSNLVQHQRIHTGEKPYECKECRKAFSQNAHLVQHLRVHTGEKPYECKVCRKAFSQFAYLAQHQRVHTGEKPYECIECGKAFSNRSSIAQHQRVHTGEKPYECNVCGKAFSLRAYLTVHQRIHTGERPYECKECGKAFSQNSHLAQHQRIHTGEKPYKCQECRKAFSQIAYLAQHQRVHTGEKPYECIECGKAFSNDSSLTQHQRVHTGEKPYECTVCGKAFSYCGSLAQHQRIHTGERPYECKECKKTFRQHAHLAHHQRIHIGESLSPPNPVNHQVL

SEQ ID NO: 7005 - protein, 333 aa, Homo sapiens
MAIKPKSVCAEKKLLKCNDCEKVFSQSSSLTLHQRIHTGEKPYKCIECGKAFSQRSNLVQHQRIHTGEKPYECKECRKAFSQNAHLVQHLRVHTGEKPYECKVCRKAFSQFAYLAQHQRVHTGEKPYECIECGKAFSNRSSIAQHQRVHTGEKPYECNVCGKAFSLRAYLTVHQRIHTGERPYECKECGKAFSQNSHLAQHQRIHTGEKPYKCQECRKAFSQIAYLAQHQRVHTGEKPYECIECGKAFSNDSSLTQHQRVHTGEKPYECTVCGKAFSYCGSLAQHQRIHTGERPYECKECKKTFRQHAHLAHHQRIHIGESLSPPNPVNHQVL

SEQ ID NO: 7006 - protein, 609 aa, Homo sapiens
MPHLLVTFRDVAIDFSQEEWECLDPAQRDLYRDVMLENYSNLISLDLESSCVTKKLSPEKEIYEMESLQWENMGKRINHHLQYNGLGDNMECKGNLEGQEASQEGLYMCVKITCEEKATESHSTSSTFHRIIPTKEKLYKCKECRQGFSYLSCLIQHEENHNIEKCSEVKKHRNTFSKKPSYIQHQRIQTGEKPYECMECGKAFGRTSDLIQHQKIHTNEKPYQCNACGKAFIRGSQLTEHQRVHTGEKPYECKKCGKAFSYCSQYTLHQRIHSGEKPYECKDCGKAFILGSQLTYHQRIHSGEKPYECKECGKAFILGSHLTYHQRVHTGEKPYICKECGKAFLCASQLNEHQRIHTGEKPYECKECGKTFFRGSQLTYHLRVHSGERPYKCKECGKAFISNSNLIQHQRIHTGEKPYKCKECGKAFICGKQLSEHQRIHTGEKPFECKECGKAFIRVAYLTQHEKIHGEKHYECKECGKTFVRATQLTYHQRIHTGEKPYKCKECDKAFIYGSQLSEHQRIHRGEKPYECKQCGKAFIRGSHLTEHLRTHTGEKPYECKECGRAFSRGSELTLHQRIHTGEKPYTCVQCGKDFRCPSQLTQHTRLHN

SEQ ID NO: 7007 - protein, 609 aa, Homo sapiens; identical to SEQ ID NO: 7006

SEQ ID NO: 7008 - protein, 609 aa, Homo sapiens; identical to SEQ ID NO: 7006

SEQ ID NO: 7009 - protein, 529 aa, Homo sapiens
MEQEKKLLVSDSNSFMERESLKSPFTGDTSMNNLETVHHNNSKADKLKEKPSEWSKRHRPQHYKHEDAKEMPLTWVQDEIWCHDSYESDGKSENWGNFIAKEEEKPNHQEWDSGEHTNACVQQNSSFVDRPYKCSECWKSFSNSSHLRTHQRTHSGEKPYKCSECAKCFCNSSHLIQHLRMHTGEKPYQCGECGKSFSNTSHLIIHERTHTGEKPYKCPECGKRFSSSSHLIQHHRSHTGEKPYECSVCGKGFSHSYVLIEHQRTHTGEKPYKCPDCGKSFSQSSSLIRHQRTHTGEKPYKCLECEKSFGCNSTLIKHQRIHTGEKPYQCPECGKNFSRSSNLITHQKMHTGEKSYESSEYEESLGQNCNVIEECRIQLGEKPYRCCECGKSFGLSSHLIRHQRTHTGEKPYRCSECWKTFSQSSTLVIHQRTHTGEKPYKCPDCGESFSQSFNLIRHRRTHIGEKPYKCTSCEKCFSRSAYLSQHRKIHVEKPFESPDVGDFPHEWTWKNCSGEMPFISSFSVSNSSS

SEQ ID NO: 7010 - protein, 607 aa, Homo sapiens
MESCSVAQAGVQWPDLSSLQPPPPRFKQFSCHSLQVAGITDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGMKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 7011 - protein, 577 aa, Homo sapiens
MILREETQFTDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGMKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 7012 - protein, 42 aa, Homo sapiens
MLENYRNLVSLGGHSISKPVVVDLLERGKEPWMILREETQFT

SEQ ID NO: 7013 - protein, 578 aa, Homo sapiens
MLENYRNLVSLDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGMKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 7014 - protein, 577 aa, Homo sapiens
FILRTSSFVSDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGMKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 7015 - protein, 577 aa, Homo sapiens; identical to SEQ ID NO: 7011

SEQ ID NO: 7016 - protein, 665 aa, Homo sapiens
MFPVLEPHQVGLIRSYNSKTMTCFQELVTFRDVAIDFSRQEWEYLDPNQRDLYRDVMLENYRNLVSLGGHSISKPVVVDLLERGKEPWMILREETQFTDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGMKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 7017 - protein, 986 aa, Homo sapiens
MPRATWANSKERSWAESERGPRDTGNGGSKAERHIQEIETGRGGDRAKAHRRQRMRLRGTERASLGPGRRLGDSRGTDMPGARAQGLAAAMTEESEETVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIHYECVDCKALFASQELWLNHRQTHLRATPTKAPAPVVLGSPVVLGPPVGQARVAVEHSYRKAEEGGEGATVPSAAATTTEVVTEVELLLYKCSECSQLFQLPADFLEHQATHFPAPVPESQEPALQQEVQASSPAEVPVSQPDPLPASDHSYELRNGEAIGRDRRGRRARRNNSGEAGGAATQELFCSACDQLFLSPHQLQQHLRSHREGVFKCPLCSRVFPSPSSLDQHLGDHSSESHFLCVDCGLAFGTEALLLAHRRAHTPNPLHSCPCGKTFVNLTKFLYHRRTHGVGGVPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDHRRLHTGERPFACEVCGKAFAISMRLAEHRRIHTGERPYSCPDCGKSYRSFSNLWKHRKTHQQQHQAAVRQQLAEAEAAVGLAVMETAVEALPLVEAIEIYPLAEAEGVQISG

SEQ ID NO: 7018 - protein, 896 aa, Homo sapiens
MTEESEETVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIHYECVDCKALFASQELWLNHRQTHLRATPTKAPAPVVLGSPVVLGPPVGQARVAVEHSYRKAEEGGEGATVPSAAATTTEVVTEVELLLYKCSECSQLFQLPADFLEHQATHFPAPVPESQEPALQQEVQASSPAEVPVSQPDPLPASDHSYELRNGEAIGRDRRGRRARRNNSGEAGGAATQELFCSACDQLFLSPHQLQQHLRSHREGVFKCPLCSRVFPSPSSLDQHLGDHSSESHFLCVDCGLAFGTEALLLAHRRAHTPNPLHSCPCGKTFVNLTKFLYHRRTHGVGGVPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDHRRLHTGERPFACEVCGKAFAISMRLAEHRRIHTGERPYSCPDCGKSYRSFSNLWKHRKTHQQQHQAAVRQQLAEAEAAVGLAVMETAVEALPLVEAIEIYPLAEAEGVQISG

SEQ ID NO: 7019 - protein, 544 aa, Homo sapiens
MSMWEDLCQPYQVPLSPAYSWGRGCPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDTGACTQVSGPLPVKCVARPLPSPCAWQNIAASTQANDPTPALTVARATAPSPTSGSTARPISSSIRQLCGSSWQRRRLPLAWPSWRLLWRRYPWWKPLRSTLWPRLRGSRSVADSARLPLWHLHSLLLKALQHPLKHLYILCPFLFPSPPPCKF

SEQ ID NO: 7020 - protein, 896 aa, Homo sapiens; identical to SEQ ID NO: 7018

SEQ ID NO: 7021 - protein, 245 aa, Homo sapiens
MLERGAESAAGATDPSPTGKEPVTKEAPHQGPPQKPSQSAPGPTASAGSPPRPRRRPPPQRPHRCPDCDKAFSYPSKLATHRLAHGGARPHPCPDCPKAFSYPSKLAAHRLTHSGARPHPCPHCPKSFGHRSKLAAHLWTHAPTRPYPCPDCPKSFCYPSKLAAHRHTHHATDARPYPCPHCPKAFSFPSKLAAHRLCHDPPTAPGSQATAWHRCSSCGQAFGQRRLLLLHQRSHHQVEHKGERD

SEQ ID NO: 7022 - protein, 344 aa, Homo sapiens
MSLVPGLTSIEQPQPQLLDQLGIPRRCFQDWVDQNGLPGLSVTQQIRGITLLRRLECSNTIIAHCRHELLGPPTLSPSAWSSPASPPPRALPLGSCASKMLERGAESAAGATDPSPTGKEPVTKEAPHQGPPQKPSQSAPGPTASAGSPPRPRRRPPPQRPHRCPDCDKAFSYPSKLATHRLAHGGARPHPCPDCPKAFSYPSKLAAHRLTHSGARPHPCPHCPKSFGHRSKLAAHLWTHAPTRPYPCPDCPKSFCYPSKLAAHRHTHHATDARPYPCPHCPKAFSFPSKLAAHRLCHDPPTAPGSQATAWHRCSSCGQAFGQRRLLLLHQRSHHQVEHKGERD

SEQ ID NO: 7023 - protein, 170 aa, Homo sapiens
MEDPNPEENMKQQDSPKERSPQSPGGNICHLGAPKCTRCLITFADSKFQERHMKREHPADFVAQKLQGVLFICFTCARSFPSSKALITHQRSHGPAAKPTLPVATTTAQPTFPCPDCGKTFGQAVSLRRHRQMHEVRAPPGTFACTECGQDFAQEAGLHQHYIRHARGEL

SEQ ID NO: 7024 - protein, 170 aa, Homo sapiens; identical to SEQ ID NO: 7023

SEQ ID NO: 7025 - protein, 170 aa, Homo sapiens; identical to SEQ ID NO: 7023

SEQ ID NO: 7026 - protein, 170 aa, Homo sapiens; identical to SEQ ID NO: 7023

SEQ ID NO: 7027 - protein, 170 aa, Homo sapiens; identical to SEQ ID NO: 7023

SEQ ID NO: 7028 - protein, 170 aa, Homo sapiens; identical to SEQ ID NO: 7023

SEQ ID NO: 7029 - protein, 485 aa, Homo sapiens
MKNATIVMSVRREQGSSSGEGSLSFEDVAVGFTREEWQFLDQSQKVLYKEVMLENYINLVSIGYRGTKPDSLFKLEQGEPPGIAEGAAHSQICPGFVIQSRRYAGKDSDAFGGYGRSCLHIKRDKTLTGVKYHRCVKPSSPKSQLNDLQKICAGGKPHECSVCGRAFSRKAQLIQHQRTERGEKPHGCGECGKTFMRKIQLTEHQRTHTGEKPHECSECGKAFSRKSQLMVHQRTHTGEKPYRCSKCGKAFSRKCRLNRHQRSHTGEKLYGCSVCGKAFSQKAYLTAHQRLHTGDKPYKCSDCGRTFYFKSDLTRHQRIHTGEKPYECSECEKAFRSKSKLIQHQRTHTGERPYSCRECGKAFAHMSVLIKHEKTHIRETAINSLTVEKPSSRSHTSLYMSELIQEQKTVNTVPIEMPSSGTPPLLNKSERLVGRNVVIVEQPFPRNQAFVVNQEFEQRISLTNEVNVAPSVINYILYLTDIVSE

SEQ ID NO: 7030 - protein, 44 aa, Homo sapiens
MKNATIVMSVRREQGSSSGEGSLSFEDVAVGFTREEWQFLDQSQ

SEQ ID NO: 7031 - protein, 58 aa, Homo sapiens
MKNATIVMSVRREQGSSSGEGSLSFEDVAVGFTREEWQFLDQSQKVLYKEVMLENYIN

SEQ ID NO: 7032 - protein, 62 aa, Homo sapiens
MKNATIVMSVRREQGSSSGEGSLSFEDVAVGFTREEWQFLDQSQKVLYKEVMLENYINLVSI

SEQ ID NO: 7033 - protein, 480 aa, Homo sapiens
MKNATIVMSVRREQGSSSGEGSLSFEDVAVGFTREEWQFLDQSQKVLYKEVMLENYINLVSIGYRGTKPDSLFKLEQGEPPGIAEGAAHSQICPGFVIQSRRYAGKDSDAFGGYGRSCLHIKRDKTLTGVKYHRCVKPSSPKSQLNDLQKICAGGKPHECSVCGRAFSRKAQLIQHQRTERGEKPHGCGECGKTFMRKIQLTEHQRTHTGEKPHECSECGKAFSRKSQLMVHQRTHTGEKPYRCSKCGKAFSRKCRLNRHQRSHTGEKLYGCSVCGKAFSQKAYLTAHQRLHTGDKPYKCSDCGRTFYFKSDLTRHQRIHTGEKPYECSECEKAFRSKSKLIQHQRTHTGERPYSCRECGKAFAHMSVLIKHEKTHIRETAINSLTVEKPSSRSHTSLYMSELIQEQKTVNTVPIEMPSSGTPPLLNKSERLVGRNVVIVEQPFPRNQAFVVNQEFEQRISLTNEVNVAPSVINYILYLT

SEQ ID NO: 7034 - protein, 562 aa, Homo sapiens
MDPQPPPPAQGSPPHRGRGRGRGRGRGRGRGRGRGGAGAPRAPLPCPTCGRLFRFPYYLSRHRLSHSGLRPHACPLCPKAFRRPAHLSRHLRGHGPQPPLRCAACPRTFPEPAQLRRHLAQEHAGGEVELAIERVAKETAEPSWGPQDEGSEPPTTAAAGATEEEAVAAWPETWPAGEPSTLAAPTSAAEPRESESEEAEAGAAELRAELALAAGRQEEKQVLLQADWTLLCLRCREAFATKGELKAHPCLRPEGEQEGEGGPPPRPKRHQCSICLKAFARPWSLSRHRLVHSTDRPFVCPDCGLAFRLASYLRQHRRVHGPLSLLAPLPAAGKKDDKASGARNSAKGPEGGEGAECGGASEGGEGQNGGDAAPARPPAGEPRFWCPECGKGFRRRAHLRQHGVTHSGARPFQCVRCQREFKRLADLARHAQVHAGGPAPHPCPRCPRRFSRAYSLLRHQRCHRAELERAAALQALQAQAPTSPPPPPPPLKAEQEEEGLPLPLANIKEEPPSPGTPPQSPPAPPVFLSASCFDSQDHSAFEMEEEEVDSKAHLRGLGGLAS

SEQ ID NO: 7035 - protein, 172 aa, Homo sapiens
MLLLPPRPPHPRSSSPEAMDPPPPKAPPFPKAEGPSSTPSSAAGPRPPRLGRHLLIDANGVPYTYTVQLEEEPRGPPQREAPPGEPGPRKGYSCPECARVFASPLRLQSHRVSHSDLKPFTCGACGKAFKRSSHLSRHRATHRARAGPPHTCPLCPRRFQDAAELAQHVRLH

SEQ ID NO: 7036 - protein, 172 aa, Homo sapiens; identical to SEQ ID NO: 7035

SEQ ID NO: 7037 - protein, 172 aa, Homo sapiens; identical to SEQ ID NO: 7035

SEQ ID NO: 7038 - protein, 197 aa, Homo sapiens
MLVLPSPCPQPLAFSSVETMEGPPRRTCRSPEPGPSSSIGSPQASSPPRPNHYLLIDTQGVPYTVLVDEESQREPGASGAPGQKKCYSCPVCSRVFEYMSYLQRHSITHSEVKPFECDICGKAFKRASHLARHHSIHLAGGGRPHGCPLCPRRFRDAGELAQHSRVHSGERPFQCPHCPRRFMEQNTLQKHTRWKHP

SEQ ID NO: 7039 - protein, 517 aa, Homo sapiens
MSLGSELFRDVAIVFSQEEWQWLAPAQRDLYRDVMLETYSNLVSLGLAVSKPDVISFLEQGKEPWMVERVVSGGLCPVLESRYDTKELFPKQHVYEVESPQWEIMESLTSYGLECSSFQDDWECRNQFDRQQGNPDRHFHQMIIRHEEMPTFDQHASLTFYQKIHTREKPFGYNKCRKDFWQKELLINHQGIYTNEKPYKCKECGKAFKYGSRLIQHENIHSGKKPYECKECGKAFNSGSNFIQHQRVHTGEKPYECKDCEKAFSRSSQLIEHQRTHTGEKPYQCKECGKAFNRISHLKVHYRIHTGEKPYACKECGKTFSHRSQLIQHQTVHTGRKLYECKECGKAFNQGSTLIRHQRIHTGEKPYECKVCGKAFRVSSQLKQHQRIHTGEKPYQCKVCGRAFKRVSHLTVHYRIHTGEKPYECKECGKAFSHCSQLIHHQVIHTEKKPYEYKECEKTLSHDSTTVQPQRMHNRETHVNIINVEKPSISSYPLLIIREFMLASNHMNGSNGESPLA

SEQ ID NO: 7040 - protein, 569 aa, Homo sapiens
MSKDLVTFGDVAVNFSQEEWEWLNPAQRNLYRKVMLENYRSLVSLGVSVSKPDVISLLEQGKEPWMVKKEGTRGPCPDWEYVFKNSEFSSKQETYEESSKVVTVGARHLSYSLDYPSLREDCQSEDWYKNQLGSQEVHLSQLIITHKEILPEVQNKEYNKSWQTFHQDTIFDIQQSFPTKEKAHKHEPQKKSYRKKSVEMKHRKVYVEKKLLKCNDCEKVFNQSSSLTLHQRIHTGEKPYACVECGKTFSQSANLAQHKRIHTGEKPYECKECRKAFSQNAHLAQHQRVHTGEKPYQCKECKKAFSQIAHLTQHQRVHTGERPFECIECGKAFSNGSFLAQHQRIHTGEKPYVCNVCGKAFSHRGYLIVHQRIHTGERPYECKECRKAFSQYAHLAQHQRVHTGEKPYECKVCRKAFSQIAYLDQHQRVHTGEKPYECIECGKAFSNSSSLAQHQRSHTGEKPYMCKECRKTFSQNAGLAQHQRIHTGEKPYECNVCGKAFSYSGSLTLHQRIHTGERPYECKDCRKSFRQRAHLAHHERIHTMESFLTLSSPSPSTSNQLPRPVGFIS

SEQ ID NO: 7041 - protein, 569 aa, Homo sapiens; identical to SEQ ID NO: 7040

SEQ ID NO: 7042 - protein, 137 aa, Homo sapiens
MSKDLVTFGDVAVNFSQEEWEWLNPAQRNLYRKVMLENYRSLVSLGVSVSKPDVISLLEQGKEPWMVKKEGTRGPCPDWEYVFKNSEFSSKQETYEESSKVVTVGARHLSYSLDYPSLREDCQSEDWYKNQLGSQEV

SEQ ID NO: 7043 - protein, 129 aa, Homo sapiens
MSKDLVTFGDVAVNFSQEEWEWLNPAQRNLYRKVMLENYRSLVSLGVSVSKPDVISLLEQGKEPWMVKKEGTRGPCPDWEYVFKNSEFSSKQETYEESSKVVTVGARHLSYSLDYPSLREDCQSEDWYK

SEQ ID NO: 7044 - protein, 421 aa, Homo sapiens
MAGEAEAQLDPSLQGLVMFEDVTVYFSREEWGLLNVTQKGLYRDVMLENFALVSSLGLAPSRSPVFTQLEDDEQSWVPSWVDVTPVSRAEARRGFGLDGLCRVEDERAHPEHLKSYRVIQHQDTHSEGKPRRHTEHGAAFPPGSSCGQQQEVHVAEKLFKCSDCGKVFLKAFALLDHLITHSEERPFRCPTGRSAFKKSAHINPRKIHTGETAHVCNECGKAFSYPSKLRKHQKVHTGIKPFKCSDCGKTFNRKDALVLHQRIHTGERPYECSKCGKTFSVLSTLIRHRKVHIGERPYECTECGKFFKYNNSFILHQRVHTGERPFECKQCGKGYVTRSGLYQHWKVHTGERPYECSLCGKTFTTRSYRNRHQQFHTEERSYECTECGKAFKHSSTLLQHKKVHTPERRQEDRAHGKVVSC

SEQ ID NO: 7045 - protein, 145 aa, Homo sapiens
MAGEAEGLVMFEDVTVYFSREEWGLLNVTQKGLYRDVMLENFALVSSLGLAPSRSPVFTQLEDDEQSWVPSWVDVTPVSRAEARRGFGLGPACSCLSGLRLLIALLCICAELSTVGDSVRVLKCAHILKQMVCVEWRMREPILSI

SEQ ID NO: 7046 - protein, 307 aa, Homo sapiens
PGSSCGQQQEVHVAEKLFKCSDCGKVFLKAFALLDHLITHSEERPFRCPTGRSAFKKSAHINPRKIHTGETAHVCNECGKAFSYPSKLRKHQKVHTGIKPFKCSDCGKTFNRKDALVLHQRIHTGERPYECSKCGKTFSVLSTLIRHRKVHIGERPYECTECGKFFKYNNSFILHQRVHTGERPFECKQCGKGYVTRSGLYQHWKVHTGERPYECSLCGKTFTTRSYRNRHQQFHTEERSYECTECGKAFKHSSTLLQHKKVHTPERPFICFNCGKNFNMSSCLAWHQKLHPGEKPFDYSKCRKVFT

SEQ ID NO: 7047 - protein, 714 aa, Homo sapiens
MLETYSHLLSVGYQVPEAEVVMLEQGKEPWALQGERPRQSCPGEKLWDHNQCRKILSYKQVSSQPQKMYPGEKAYECAKFEKIFTQKSQLKVHLKVLAGEKLYVCIECGKAFVQKPEFIIHQKTHMREKPFKCNECGKSFFQVSSLFRHQRIHTGEKLYECSQCGKGFSYNSDLSIHEKIHTGERHHECTDCGKAFTQKSTLKMHQKIHTGERSYICIECGQAFIQKTHLIAHRRIHTGEKPYECSNCGKSFISKSQLQVHQRVHTRVKPYICTEYGKVFSNNSNLVTHKKVQSREKSSICTECGKAFTYRSELIIHQRIHTGEKPYECSDCGKAFTQKSALTVHQRIHTGEKSYICMKCGLAFIQKAHLIAHQIIHTGEKPHKCGHCGKLFTSKSQLHVHKRIHTGEKPYMCNKCGKAFTNRSNLITHQKTHTGEKSYICSKCGKAFTQRSDLITHQRIHTGEKPYECNTCGKAFTQKSHLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFTDRSNLNKHQTTHTGDKPYKCGICGKGFVQKSVFSVHQSSHA

SEQ ID NO: 7048 - protein, 406 aa, Homo sapiens
MLETYSHLLSVGYQVPEAEVVMLEQGKEPWALQGERPRQSCPGEKLWDHNQCRKILSYKQVSSQPQKMYPGEKAYECAKFEKIFTQKSQLKVHLKVLAGEKLYVCIECGKAFVQKPEFIIHQKTHMREKPFKCNECGKSFFQVSSLFRHQRIHTGEKLYECSQCGKGFSYNSDLSIHEKIHTGERHHECTDCGKAFTQKSTLKMHQKIHTGERSYICIECGQAFIQKTHLIAHRRIHTGEKPYECSNCGKSFISKSQLQVHQRVHTRVKPYICTEYGKVFSNNSNLVTHKKVQSREKSSICTECGKAFTYRSDLITHHRIHTGEKPYECSDCGKSFTKKSQLQVHQRIHTGEKPYVCAECGKAFTDRSNLNKHQTTHTGDKPYKCGICGKGFVQKSVFSVHQSSHA

SEQ ID NO: 7049 - protein, 769 aa, Homo sapiens
MPANWTSPQKSSALAPEDHGSSYEGSVSFRDVAIDFSREEWRHLDPSQRNLYRDVMLETYSHLLSVGYQVPEAEVVMLEQGKEPWALQGERPRQSCPGEKLWDHNQCRKILSYKQVSSQPQKMYPGEKAYECAKFEKIFTQKSQLKVHLKVLAGEKLYVCIECGKAFVQKPEFIIHQKTHMREKPFKCNECGKSFFQVSSLFRHQRIHTGEKLYECSQCGKGFSYNSDLSIHEKIHTGERHHECTDCGKAFTQKSTLKMHQKIHTGERSYICIECGQAFIQKTHLIAHRRIHTGEKPYECSNCGKSFISKSQLQVHQRVHTRVKPYICTEYGKVFSNNSNLVTHKKVQSREKSSICTECGKAFTYRSELIIHQRIHTGEKPYECSDCGKAFTQKSALTVHQRIHTGEKSYICMKCGLAFIQKAHLIAHQIIHTGEKPHKCGHCGKLFTSKSQLHVHKRIHTGEKPYMCNKCGKAFTNRSNLITHQKTHTGEKSYICSKCGKAFTQRSDLITHQRIHTGEKPYECNTCGKAFTQKSHLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFTDRSNLNKHQTTHTGDKPYKCGICGKGFVQKSVFSVHQSSHA

SEQ ID NO: 7050 - protein, 714 aa, Homo sapiens; identical to SEQ ID NO: 7047

SEQ ID NO: 7051 - protein, 357 aa, Homo sapiens
MKCGLAFIRKAHLITHQIIHTGEKPYKCGHCGKLFTSKSQLHVHKRIHTGEKPYVCNKCGKAFTNRSNLITHQKTHTGEKSYICSKCGKAFTQRSDLITHQRIHTGEKPYECNTCGKAFTQKSNLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFSNRSNLNKHQTTHTGDKPYKCGICGKGFVQKSVFSVHQSSHA

SEQ ID NO: 7052 - protein, 714 aa, Homo sapiens
MLETYSHLLSVGYQVPKPEVVMLEQGKEPWALQGERPRHSCPGEKLWDHNQHRKIIGYKPASSQDQKIYSGEKSYECAEFGKSFTWKSQFKVHLKVPTGEKLYVCIECGRAFVQKPEFITHQKTHMREKPYKCNECGKSFFQVSSLFRHHRIHTGEKLYECSECGKGFPYNSDLSIHEKIHTGERHHECTDCGKAFTQKSTLKIHQKIHTGERSYICIECGQAFIQKTQLIAHRRIHSGEKPYECNNCGKSFISKSQLQVHQRVHTRVKPYICTEYGKVFSNNSNLITHEKIQSREKSSICTECGKAFTYRSELIIHQRIHTGEKPYECSDCGRAFTQKSALTVHQRIHTGEKSYICMKCGLAFIRKAHLITHQIIHTGEKPYKCGHCGKLFTSKSQLHVHKRIHTGEKPYVCNKCGKAFTNRSNLITHQKTHTGEKSYICSKCGKAFTQRSDLITHQRIHTGEKPYECNTCGKAFTQKSNLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFSNRSNLNKHQTTHTGDKPYKCGICGKGFVQKSVFSVHQSSHA

SEQ ID NO: 7053 - protein, 769 aa, Homo sapiens
MPASWTSPQKSSALAPEDHGSSYEGSVSFRDVAIDFSREEWRHLDLSQRNLYRDVMLETYSHLLSVGYQVPKPEVVMLEQGKEPWALQGERPRHSCPGEKLWDHNQHRKIIGYKPASSQDQKIYSGEKSYECAEFGKSFTWKSQFKVHLKVPTGEKLYVCIECGRAFVQKPEFITHQKTHMREKPYKCNECGKSFFQVSSLFRHHRIHTGEKLYECSECGKGFPYNSDLSIHEKIHTGERHHECTDCGKAFTQKSTLKIHQKIHTGERSYICIECGQAFIQKTQLIAHRRIHSGEKPYECNNCGKSFISKSQLQVHQRVHTRVKPYICTEYGKVFSNNSNLITHEKIQSREKSSICTECGKAFTYRSELIIHQRIHTGEKPYECSDCGRAFTQKSALTVHQRIHTGEKSYICMKCGLAFIRKAHLITHQIIHTGEKPYKCGHCGKLFTSKSQLHVHKRIHTGEKPYVCNKCGKAFTNRSNLITHQKTHTGEKSYICSKCGKAFTQRSDLITHQRIHTGEKPYECNTCGKAFTQKSNLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFSNRSNLNKHQTTHTGDKPYKCGICGKGFVQKSVFSVHQSSHA

SEQ ID NO: 7054 - protein, 64 aa, Homo sapiens
MAAAAALRAPAQSSVTFEDVAVNFSLEEWSLLNEAQGCLYHDVMLETLTLISSLGCWLQVEDGA

SEQ ID NO: 7055 - protein, 359 aa, Homo sapiens
MLETLTLISSLGCWHGGEDEAAPSKQSTCIHIYKDQGGHSGERPYECGEYRKLFKNKSCLTEPRRDHKHRNVRTGERPYECSKYGKLFHQKPTLHIHERFHTGQKTYECSECGKSFHQSSSLLQRQTLHTRERPYECIECGKAFAEKSSLINHRKVHSGAKRYECNECGKSFAYTSSLIKHRRIHTGERPYECSECGRSFAENSSLIKHLRVHTGERPYECVECGKSFRRSSSLLQHQRVHTRERPYECSECGKSFSLRSNLIHHQRVHTGERHECGQCGKSFSRKSSLIIHLRVHTGERPYECSDCGKSFAENSSLIKHLRVHTGERPYECIDCGKSFRHSSSFRRHQRVHTGMRPYK

SEQ ID NO: 7056 - protein, 210 aa, Homo sapiens
MAAAAALRAPAQVVGMEGKMRQHLLSRARVYIYTKTREVIVEKGLMSVGNIGNYLRTSPASLNPEEITNTGMFALEKGLMSAANMGNYFTKSLHSIFMRDFILGKRPMSAVSVENHFTKALHSCSVRHFTLEKGLMSVLNVGKPLLKSPVSLTTGKFTLEQSVMNAMNVGSPLLIHLVSLNTGGFTLERGLMSAVNVGDPLLKTPVLLNT

SEQ ID NO: 7057 - protein, 402 aa, Homo sapiens
MAAAAALRAPAQSSVTFEDVAVNFSLEEWSLLNEAQRCLYRDVMLETLTLISSLGCWHGGEDEAAPSKQSTCIHIYKDQGGHSGERPYECGEYRKLFKNKSCLTEPRRDHKHRNVRTGERPYECSKYGKLFHQKPTLHIHERFHTGQKTYECSECGKSFHQSSSLLQRQTLHTRERPYECIECGKAFAEKSSLINHRKVHSGAKRYECNECGKSFAYTSSLIKHRRIHTGERPYECSECGRSFAENSSLIKHLRVHTGERPYECVECGKSFRRSSSLLQHQRVHTRERPYECSECGKSFSLRSNLIHHQRVHTGERHECGQCGKSFSRKSSLIIHLRVHTGERPYECSDCGKSFAENSSLIKHLRVHTGERPYECIDCGKSFRHSSSFRRHQRVHTGMRPYK

SEQ ID NO: 7058 - protein, 99 aa, Homo sapiens
MAAAAALRAPAQSSVTFEDVAVNFSLEEWSLLNEAQGCLYHDVMLETLTLISSLKGCTRQQFCNRSTLNKEDRVIYNLRRSPSCRFPLPGTGPHILYVS

SEQ ID NO: 7059 - protein, 402 aa, Homo sapiens; identical to SEQ ID NO: 7057

SEQ ID NO: 7060 - protein, 165 aa, Homo sapiens
MAAAAPRRPTQGTVTFEDVAVKFTQEEWNLLSEAQRCLYRDVTLENLALMSSLGCWCGVEDEAAPSKQSIYIQRETQVRTPVTGVSPKKAHPCEMCGPILGDILHVADHQGTHHKQKLHRCEAWGNKLYDSGNFHQHQNEHIGEKPYRGSVEEALFVKRSGHCDL

SEQ ID NO: 7061 - protein, 575 aa, Homo sapiens
MAAAVPRRPTQQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGQTAYPCEECGKSFSQKGSLISHQLVHTGEGPYECRECGKSFGQKGNLIQHQQGHTGERAYHCGECGKSFRQKFCFINHQRVHTGERPYKCGECGKSFGQKGNLVHHQRGHTGERPYECKECGKSFRYRSHLTEHQRLHTGERPYNCRECGKLFNRKYHLLVHERVHTGERPYACEVCGKLFGNKHSVTIHQRIHTGERPYECSECGKSFLSSSALHVHKRVHSGQKPYKCSECGKSFSECSSLIKHRRIHTGERPYECTKCGKTFQRSSTLLHHQSSHRRKAL

SEQ ID NO: 7062 - protein, 532 aa, Homo sapiens
MLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGQTAYPCEECGKSFSQKGSLISHQLVHTGEGPYECRECGKSFGQKGNLIQHQQGHTGERAYHCGECGKSFRQKFCFINHQRVHTGERPYKCGECGKSFGQKGNLVHHQRGHTGERPYECKECGKSFRYRSHLTEHQRLHTGERPYNCRECGKLFNRKYHLLVHERVHTGERPYACEVCGKLFGNKHSVTIHQRIHTGERPYECSECGKSFLSSSALHVHKRVHSGQKPYKCSECGKSFSECSSLIKHRRIHTGERPYECTKCGKTFQRSSTLLHHQSSHRRKAL

SEQ ID NO: 7063 - protein, 402 aa, Homo sapiens
MAVVATLRLSAQGTVTFEDVAVKFTQEEWNLLSEAQRCLYRDVTLENLALMSSLGCWCGVEDEAAPSKQSIYIQRETQVRTPVTGVSPKKAHPCEMCGPILGDILHVADHQGTHHKQKLHRCEAWGNKLYDSGNFHQHQNEHIGEKPYRGSVEEALFVKRCKLHVSGESSVFSESGKDFLPRSGLLQQEASHTGEKSNSKTECVSPFQCGGAHYSHGDSMKHFSTKHILSQHQRLLPREECYVCCECGKSFSKYVSFSNHQRVHSGKRPYECGECEKSFSQKSSLIQHQQFHTGGKPYGCEECGKYFSLEGYLRRHQKVHAGKGPYECGECGKSFSSNVNLKSHQRIHTGERPYKCGECEKSFSRKPSLSYHQRFGRPRWVDHKDRKEFKTSLGNIVKSCLF

SEQ ID NO: 7064 - protein, 619 aa, Homo sapiens
MAAAVPRRPTQQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGQTAYPCEECGKSFSQKGSLISHQLVHTGEGPYECRECGKSFGQKGNLIQHQQGHTGERAYHCGECGKSFRQKFCFINHQRVHTGERPYKCGECGKSFGQKGNLVHHQRGHTGERPYECKECGKSFRYRSHLTEHQRLHTGERPYNCRECGKLFNRKYHLLVHERVHTGERPYACEVCGKLFGNKHSVTIHQRIHTGERPYECSECGKSFLSSSALHVHKRVHSGQKPYKCSECGKSFSECSSLIKHRRIHTGERPYECTKCGKTFQRSSTLLHHRVHTGERPYECSEYGKSFAEASRLVKHRRVHTGERPYECCQCGKHQNVCCPRS

SEQ ID NO: 7065 - protein, 422 aa, Homo sapiens
MIDFQMLNQLCRTIINPSVIPCLKYCGDQIGPVTFEDVAVLFTEAEWKRLSLEQRNLYKEVMLENLRNLVSLESKPEVHTCPSCPLAFGSQQFLSQDELHNHPIPGFHAGNQLHPGNPCPEDQPQSQHPSDKNHRGAEAEDQRVEGGVRPLFWSTNERGALVGFSSLFQRPPISSWGGNRILEIQLSPAQNASSEEVDRISKRAETPGFGAVTFGECALAFNQKSNLFRQKAVTAEKSSDKRQSQVCRECGRGFSRKSQLIIHQRTHTGEKPYVCGECGRGFIVESVLRNHLSTHSGEKPYVCSHCGRGFSCKPYLIRHQRTHTREKSFMCTVCGRGFREKSELIKHQQRCQVTVPLEEWSLHLTTSFCNCVLPLASMTLSCFIFFYISSLCCFLSYPTFRFYSEFSLQPYNLRDTFTRSPS

SEQ ID NO: 7066 - protein, 364 aa, Homo sapiens
MWAPREQLLGWTAEALPAKDSAWPWEEKPRYLGPVTFEDVAVLFTEAEWKRLSLEQRNLYKEVMLENLRNLVSLAESKPEVHTCPSCPLAFGSQQFLSQDELHNHPIPGFHAGNQLHPGNPCPEDQPQSQHPSDKNHRGAEAEDQRVEGGVRPLFWSTNERGALVGFSSLFQRPPISSWGGNRILEIQLSPAQNASSEEVDRISKRAETPGFGAVTFGECALAFNQKSNLFRQKAVTAEKSSDKRQSQVCRECGRGFSRKSQLIIHQRTHTGEKPYVCGECGRGFIVESVLRNHLSTHSGEKPYVCSHCGRGFSCKPYLIRHQRTHTREKSFMCTVCGRGFREKSELIKHQRIHTGDKPYVCRD

SEQ ID NO: 7067 - protein, 177 aa, Homo sapiens
MWAPREQLLGWTAEALPAKDSAWPWEEKPRYLGPVTFEDVAVLFTEAEWKRLSLEQRNLYKEVMLENLRNLVSLESKPEVHTCPSCPLAFGSQQFLSQDELHNHPIPGFHAGNQLHPGNPCPEDQPQSQHPSDKNHRGAEAEDQRVEGGVRPLFWILELGSPRSGLLPLDLNLDLWL

SEQ ID NO: 7068 - protein, 364 aa, Homo sapiens; identical to SEQ ID NO: 7066

SEQ ID NO: 7069 - protein, 156 aa, Homo sapiens
MGRSRRTGAHRAHSLARQMKAKRRRPDLDEIHRELRPQGSARPQPDPNAEFDPDLPGGGLHRCLACARYFIDSTNLKTHFRSKDHKKRYEGVRRGLMDGCSADRALTWSAPNSCFSFSQAEAAERRALQSGRGGEGSGYGILCAPQAAGSAHGSVH

SEQ ID NO: 7070 - protein, 134 aa, Homo sapiens
MGRSRRTGAHRAHSLARQMKAKRRRPDLDEIHRELRPQGSARPQPDPNAEFDPDLPGGGLHRCLACARYFIDSTNLKTHFRSKDHKKRLKQLSVEPYSQEEAERAAGMGSYVPPRRLAVPTEVSTEVPEMDTST

SEQ ID NO: 7071 - protein, 331 aa, Homo sapiens
MNVKNVGKLNQSSDLLRHHRIHSGEKPYVCNKCGESFRSSSDLIKHHRVHTGEKPHECSECGKVFSQRSHLVTHQKIHTGEKPYQCTECEKAFRRRSLLIQRRRIHSGEKPYECKECGKLFMWHTAFLKHQRLHAGEKLEEREKTFSKDEELRGEQKIHQEEKAYWCNQCGRAFQGSSDLIGHQVTHTGEKPYECKECGKTFNQSSDLLRHHRIHSGEKPYVCNKCGKSFRGSSDLIRHHRVHTGEKPYECPECWKAFSQNSHLVSHQRIHTREKPFECSNCGKAFSGWTAFLKHQKLHIGKEFEDCKSLQTGPILIGSRNLMNAVKLGKV

SEQ ID NO: 7072 - protein, 305 aa, Homo sapiens
MNVKNVGKNQSSDLLRHHRIHSGEKPCVCSKCGKSFRGSSDLIRHHRVHTGEKPYECSECGKAFSQRSHLVTHQKIHTGEKPYQCTECGKAFRRRSLLIQHRRIHSGEKPYECKECGKLFIWRTAFLKHQSLHTGEKLECEKTFSQDEELRGEQKIHQEAKAYWCNQCGRAFQGSSDLIRHQVTHTREKPYECKECGKTFNQSSDLLRHHRIHSGEKPYVCNKCGKSFRGSSDLIKHHRIHTGEKPYECSECGKAFSQRSHLATHQKIHTGEKPYQCMECGKLFMWHTAFLKHQRLHAGEKLEEC

SEQ ID NO: 7073 - protein, 807 aa, Homo sapiens
MKEWKSKMEISEEKKSARAASEKLQRQITQECELVETSNSEDRLLKHWVSPLKDAMRHLPSQESGIREMHIIPQKAIVGEIGHGCNEGEKILSAGESSHRYEVSGQNFKQKSGLTEHQKIHNINKTYECKECEKTFNRSSNLIIHQRIHTGNKPYVCNECGKDSNQSSNLIIHQRIHTGKKPYICHECGKDFNQSSNLVRHKQIHSGGNPYECKECGKAFKGSSNLVLHQRIHSRGKPYLCNKCGKAFSQSTDLIIHHRIHTGEKPYECYDCGQMFSQSSHLVPHQRIHTGEKPLKCNECEKAFRQHSHLTEHQRLHSGEKPYECHRCGKTFSGRTAFLKHQRLHAGEKIEECEKTFSKDEELREEQRIHQEEKAYWCNQCGRNFQGTSDLIRHQVTHTGEKPYECKECGKTFNQSSDLLRHHRIHSGEKPCVCSKCGKSFRGSSDLIRHHRVHTGEKPYECSECGKAFSQRSHLVTHQKIHTGEKPYQCTECGKAFRRRSLLIQHRRIHSGEKPYECKECGKLFIWRTAFLKHQSLHTGEKLECEKTFSQDEELRGEQKIHQEAKAYWCNQCGRAFQGSSDLIRHQVTHTREKPYECKECGKTFNQSSDLLRHHRIHSGEKPYVCNKCGKSFRGSSDLIKHHRIHTGEKPYECSECGKAFSQRSHLATHQKIHTGEKPYQCSECGNAFRRRSLLIQHRRLHSGEKPYECKECGKLFMWHTAFLKHQRLHAGEKLEECEKTFSKDEELRKEQRTHQEKKVYWCNQCSRTFQGSSDLIRHQVTHTREKPYECKECGKTQSELRPSETS

SEQ ID NO: 7074 - protein, 504 aa, Homo sapiens
MPSPDSMTFEDIIVDFTQEEWALLDTSQRKLFQDVMLENISHLVSIGKQLCKSVVLSQLEQVEKLSTQRISLLQGREVGIKHQEIPFIQHIYQKGTSTISTMRSHTQEDPFLCNDLGEDFTQHIALTQNVITYMRTKHFVSKKFGKIFSDWLSFNQHKEIHTKCKSYGSHLFDYAFIQNSALRPHSVTHTREITLECRVCGKTFSKNSNLRRHEMIHTGEKPHGCHLCGKAFTHCSDLRKHERTHTGEKPYGCHLCGKAFSKSSNLRRHEMIHTREKAQICHLCGKAFTHCSDLRKHERTHLGDKPYGCLLCGKAFSKCSYLRQHERTHNGEKPYECHLCGKAFSHCSHLRQHERSHNGEKPHGCHLCGKAFTESSVLKRHERIHTGEKPYECHVCGKAFTESSDLRRHERTHTGEKPYECHLCGKAFNHSSVLRRHERTHTGEKPYECNICGKAFNRSYNFRLHRRVHTGEKPYVCPLCGKAFSKFFNLRQHERTHTKKAMNM

SEQ ID NO: 7075 - protein, 434 aa, Homo sapiens
MPSPDSMTFEDIIVDFTQEEWALLDTSQRKLFQDVMLENISHLVSIGEDFTQHIALTQNVITYMRTKHFVSKKFGKIFSDWLSFNQHKEIHTKCKSYGSHLFDYAFIQNSALRPHSVTHTREITLECRVCGKTFSKNSNLRRHEMIHTGEKPHGCHLCGKAFTHCSDLRKHERTHTGEKPYGCHLCGKAFSKSSNLRRHEMIHTREKAQICHLCGKAFTHCSDLRKHERTHLGDKPYGCLLCGKAFSKCSYLRQHERTHNGEKPYECHLCGKAFSHCSHLRQHERSHNGEKPHGCHLCGKAFTESSVLKRHERIHTGEKPYECHVCGKAFTESSDLRRHERTHTGEKPYECHLCGKAFNHSSVLRRHERTHTGEKPYECNICGKAFNRSYNFRLHRRVHTGEKPYVCPLCGKAFSKFFNLRQHERTHTKKAMNM

SEQ ID NO: 7076 - protein, 504 aa, Homo sapiens; identical to SEQ ID NO: 7074

SEQ ID NO: 7077 - protein, 424 aa, Homo sapiens
MASMPPTPEAQGPILFEDLAVYFSQEECVTLHPAQRSLSKDGTKESLEDAALMGEEGKPEINQQLSLESMELDELALEKYPIAAPLVPYPEKSSEDGVGNPEAKILSGTPTYKRRVISLLVTIENHTPLVELSEYLGTNTLSEILDSPWEGAKNVYKCPECDQNFSDHSYLVLHQKIHSGEKKHKCGDCGKIFNHRANLRTHRRIHTGEKPYKCAKCSASFRQHSHLSRHMNSHVKEKPYTCSICGRGFMWLPGLAQHQKSHSAENTYESTNCDKHFNEKPNLALPEETFVSGPQYQHTKCMKSFRQSLYPALSEKSHDEDSERCSDDGDNFFSFSKFKPLQCPDCDMTFPCFSELISHQNIHTEERPHKCKTCEESFALDSELACHQKSHMLAEPFKCTVCGKTFKSNLHLITHKRTHIKNTT

SEQ ID NO: 7078 - protein, 588 aa, Homo sapiens
MAAPALALVSFEDVVVTFTGEEWGHLDLAQRTLYQEVMLETCRLLVSLGHPVPKPELIYLLEHGQELWTVKRGLSQSTCAGEKAKPKITEPTASQLAFSEESSFQELLAQRSSRDSRLGQARDEEKLIKIQEGNLRPGTNPHKEICPEKLSYKHDDLEPDDSLGLRVLQERVTPQDALHECDSQGPGKDPMTDARNNPYTCTECGKGFSKKWALVRHQQIHAGVKPYECNECGKACRYMADVIRHMRLHTGEKPYKCIECGKAFKRRFHLTEHQRIHTGDKPYECKECGKAFTHRSSFIQHNMTHTREKPFLCKECGKAFYYSSSFAQHMRIHTGKKLYECGECGKAFTHRSTFIQHNVTHTGEKPFLCKECGKTFCLNSSFTQHMRIHTGEKPYECGECGKAFTHRSTFIRHKRTHTGEKPFECKECGKAFCDSSSLIQHMRIHTGEKPYECSECGKAFTHHSVFIRHNRTHSGQKPLECKECAKAFYYSSSFTRHMRIHTGEKPYVCRECGKAFTQPANFVRHNRIHTGEKPFECKECEKAFCDNFALTQHMRTHTGEKPFECNECGKTFSHSSSFTHHRKIHTRV

SEQ ID NO: 7079 - protein, 89 aa, Homo sapiens
ALVSFEDVVVTFTGEEWGHLDLAQRTLYQEVMLETCRLLVSLGHPVPKPELIYLLEHGQELWTVKRGLSQSTCAASFSLLWKSYHPGHG

SEQ ID NO: 7080 - protein, 308 aa, Homo sapiens
YTCTECGKGFSKKWALVRHQQIHAGVKPYECNECGKACRYMADVIRHMRLHTGEKPYKCIECGKAFKRRFHLTEHQRIHTGDKPYECKECGKAFTHRSSFAQHMRIHTGKKLYECGECGKAFTHRSTFIQHNVTHTGEKPFLCKECGKTFCLNSSFTQHMRIHTGEKPYECGECGKAFTHRSTFIRHKRTHTGEKPFECKECGKAFCDSSSLIQHMRIHTGEKPYECSECGKAFTHHSVFIRHNRTHSGQKPLECKECAKAFYYSSSFTRHMRIHTGEKPYVCRECGKAFTQPANFVRHNRIHTGEKP

SEQ ID NO: 7081 - protein, 587 aa, Homo sapiens
KAPASALVSFEDVVVTFTGEEWGHLDLAQRTLYQEVMLETCRLLVSLGHPVPKPELIYLLEHGQELWTVKRGLSQSTCAGEKAKPKITEPTASQLAFSEESSFQELLAQRSSRDSRLGQARDEEKLIKIQEGNLRPGTNPHKEICPEKLSYKHDDLEPDDSLGLRVLQERVTPQDALHECDSQGPGKDPMTDARNNPYTCTECGKGFSKKWALVRHQQIHAGVKPYECNECGKACRYMADVIRHMRLHTGEKPYKCIECGKAFKRRFHLTEHQRIHTGDKPYECKECGKAFTHRSSFIQHNMTHTREKPFLCKECGKAFYYSSSFAQHMRIHTGKKLYECGECGKAFTHRSTFIQHNVTHTGEKPFLCKECGKTFCLNSSFTQHMRIHTGEKPYECGECGKAFTHRSTFIRHKRTHTGEKPFECKECGKAFCDSSSLIQHMRIHTGEKPYECSECGKAFTHHSVFIRHNRTHSGQKPLECKECAKAFYYSSSFTRHMRIHTGEKPYVCRECGKAFTQPANFVRHNRIHTGEKPFECKECEKAFCDNFALTQHMRTHTGEKPFECNECGKTFSHSSSFTHHRKIHTRV

SEQ ID NO: 7082 - protein, 722 aa, Homo sapiens
MMKEVLSTGQGNTEVIHTGTLQRYQSYHIGDFCFQEIEKEIHDIEFQCQEDERNGHEAPMTKIKKLTGSTDQHDHRHAGNKPIKDQLGSSFYSHLPELHIIQIKGKIGNQFEKSTSDAPSVSTSQRISPRPQIHISNNYGNNSPNSSLLPQKQEVYMREKSFQCNESGKAFNCSSLLRKHQIPHLGDKQYKCDVCGKLFNHKQYLTCHCRCHTGEKPYKCNECGKSFSQVSSLTCHRRLHTAVKSHKCNECGKIFGQNSALVIHKAIHTGEKPYKCNECDKAFNQQSNLARHRRIHTGEKPYKCEECDKVFSRKSTLESHKRIHTGEKPYKCKVCDTAFTWNSQLARHKRIHTGEKTYKCNECGKTFSHKSSLVCHHRLHGGEKSYKCKVCDKAFAWNSHLVRHTRIHSGGKPYKCNECGKTFGQNSDLLIHKSIHTGEQPYKYEECEKVFSCGSTLETHKIIHTGEKPYKCKVCDKAFACHSYLAKHTRIHSGEKPYKCNECSKTFRLRSYLASHRRVHSGEKPYKCNECSKTFSQRSYLHCHRRLHSGEKPYKCNECGKTFSHKPSLVHHRRLHTGEKSYKCTVCDKAFVRNSYLARHTRIHTAEKPYKCNECGKAFNQQSQLSLHHRIHAGEKLYKCETCDKVFSRKSHLKRHRRIHPGKKPYKCKVCDKTFGSDSHLKQHTGLHTGEKPYKCNECGKAFSKQSTLIHHQAVHGVGKLD

SEQ ID NO: 7083 - protein, 641 aa, Homo sapiens
MIQSQISFEDVAVDFTLEEWQLLNPTQKNLYRDVMLENYSNLVFLEVWLDNPKMWLRDNQDNLKSMERGHKYDVFGKIFNSSINIVHVGLRSHKCGTGEKSLKCPFDLLIPKNNCERKKIDELNKKLLFCIKPGRTHGGIKYCDCSTCRKSSNEEPWLTANHITHTGVYLCMECGRFFNKKSQLVIHQRTHTGEKPYQCSECGKAFSQKSLLTVHQRTHSGEKPHGCSECQKAFSRKSLLILHQRIHTGEKPYGCSECGKAFSRKSQLKRHQITHTIEKPYSCSECGKAFSQKLKLITHQRAHTGEKPYPCSHCGKAFFWKSQLITHQRTHTGKKPYGCGECQKAFSRNSLLIRHQRIHTGEKPYECNECGEAFIRKPQLIKHQITHTGEKNYRCSDCEEAFFKKSELIRHQKIHLGEKPYGCIQCGKTFFGKSQLLTHHRTHTGEKPYECSECGKAFTQKSSLISHQRTHTGEKPYECSECRKTFSEKSSLIHHQRTHTGEKPFECSECRKAFAWKPQLLRHQRIHTGEKPYECSECGKAFVQKVQLIKHQRNHTGEKTYGCSDCAKAFFEKAQLIIHQRIHTGERPYKCGECGKSFTRKSHLMRHQRIHTGDKYYGCNECGTTFNRKSQLMIHQRNHII

SEQ ID NO: 7084 - protein, 672 aa, Homo sapiens
MIQSQISFEDVAVDFTLEEWQLLNPTQKNLYRDVMLENYSNLVFLGFQILKPDAMFKLEQQDPWIIGQEILNQNFSEVWLDNPKMWLRDNQDNLKSMERGHKYDVFGKIFNSSINIVHVGLRSHKCGTGEKSLKCPFDLLIPKNNCERKKIDELNKKLLFCIKPGRTHGGIKYCDCSTCRKSSNEEPWLTANHITHTGVYLCMECGRFFNKKSQLVIHQRTHTGEKPYQCSECGKAFSQKSLLTVHQRTHSGEKPHGCSECQKAFSRKSLLILHQRIHTGEKPYGCSECGKAFSRKSQLKRHQITHTIEKPYSCSECGKAFSQKLKLITHQRAHTGEKPYPCSHCGKAFFWKSQLITHQRTHTGKKPYGCGECQKAFSRNSLLIRHQRIHTGEKPYECNECGEAFIRKPQLIKHQITHTGEKNYRCSDCEEAFFKKSELIRHQKIHLGEKPYGCIQCGKTFFGKSQLLTHHRTHTGEKPYECSECGKAFTQKSSLISHQRTHTGEKPYECSECRKTFSEKSSLIHHQRTHTGEKPFECSECRKAFAWKPQLLRHQRIHTGEKPYECSECGKAFVQKVQLIKHQRNHTGEKTYGCSDCAKAFFEKAQLIIHQRIHTGERPYKCGECGKSFTRKSHLMRHQRIHTGDKYYGCNECGTTFNRKSQLMIHQRNHII

SEQ ID NO: 7085 - protein, 696 aa, Homo sapiens
MSYGSITFGDVAIDFSHQEWEYLSLVQKTLYQEVMMENYDNLVSLAGHSVSKPDLITLLEQGKEPWMIVREETRGECTDLDSRCEIISDGKMQLYRKHSCVTLHQRIHNGQKPYECKQCQKSFSHLTELMVHQTIHTSEEPDQCEKFRKAFSHLTDLRKHQKINAREKPYECEECGKVFSYPANLAQHGKVHVEKPYECKECGEAFRTSRQLTVHHRFHYGEKPYECKECGKAFSVYGRLSRHQSIHTGEKPFECNKCGKSFRLKAGLKVHQSIHTGEKPHECKECGKAFRQFSHLVGHKRIHTGEKPYECKECGKGFTCRYQLTMHQRIYSGEKHYECKENGEAFSSGHQLTAPHTFESVEKPYKCEECGKAFSVHGRLTRHQGIHSGKKPYECNKCGKSFRLNSSLKIHQNIHTGEKPYKCKECGKAFSQRAHLAHHNRIHTGYKPFECKECGKSFRCASYLVIHERIHTGEKPYVCQECGKGFSYSHKLTIHRRVHTGEKPYECKECGKAFSVSGQLTQHLSIHSGKKPFECNKCGKSFRFISVLKAHQNIHSAEKPYECKECGKAFRHATSLIYHDRTHAGEKSYECKECGETFSHASHLIIHERIHTSDKPYECKRCGKAFHCASYLVRHESVHADGNPYMCEECGKAFNSSHELSIHHRVHTGEKPFKCNKCRRSFRLRSILEVHQRIHI

SEQ ID NO: 7086 - protein, 695 aa, Homo sapiens
MSYGSITFGDVAIDFSHQEWEYLSLVQKTLYQEVMMENYDNLVSLGHSVSKPDLITLLEQGKEPWMIVREETRGECTDLDSRCEIISDGKMQLYRKHSCVTLHQRIHNGQKPYECKQCQKSFSHLTELMVHQTIHTSEEPDQCEKFRKAFSHLTDLRKHQKINAREKPYECEECGKVFSYPANLAQHGKVHVEKPYECKECGEAFRTSRQLTVHHRFHYGEKPYECKECGKAFSVYGRLSRHQSIHTGEKPFECNKCGKSFRLKAGLKVHQSIHTGEKPHECKECGKAFRQFSHLVGHKRIHTGEKPYECKECGKGFTCRYQLTMHQRIYSGEKHYECKENGEAFSSGHQLTAPHTFESVEKPYKCEECGKAFSVHGRLTRHQGIHSGKKPYECNKCGKSFRLNSSLKIHQNIHTGEKPYKCKECGKAFSQRAHLAHHNRIHTGYKPFECKECGKSFRCASYLVIHERIHTGEKPYVCQECGKGFSYSHKLTIHRRVHTGEKPYECKECGKAFSVSGQLTQHLSIHSGKKPFECNKCGKSFRFISVLKAHQNIHSAEKPYECKECGKAFRHATSLIYHDRTHAGEKSYECKECGETFSHASHLIIHERIHTSDKPYECKRCGKAFHCASYLVRHESVHADGNPYMCEECGKAFNSSHELSIHHRVHTGEKPFKCNKCRRSFRLRSILEVHQRIHI

SEQ ID NO: 7087 - protein, 1411 aa, Homo sapiens
MSLSSGASGGKGVDANPVETYDSGDEWDIGVGNLIIDLDADLEKDQQKLEMSGSKEVGIPAPNAVATLPDNIKFVTPVPGPQGKEGKSKSKRSKSGKDTSKPTPGTSLFTPSEGAASKKEVQGRSGDGANAGGLVAAIAPKGSEKAAKASRSVAGSKKEKENSSSKSKKERSEGVGTCSEKDPGVLQPVPLGGRGGQYDGSAGVDTGAVEPLGSIAIEPGAALNPLGTKPEPEEGENECRLLKKVKSEKMESPVSTPAVLPIHLLVPVVNNDISSPCEQIMVRTRSVGVNTCDVALATEPECLGPCEPGTSVNLEGIVWQETEDGMLVVNVTWRNKTYVGTLLDCTRHDWAPPRFCDSPTSDLEMRNGRGRGKRMRPNSNTPVNETATASDSKGTSNSSKTRAGANSKGRRGSQNSSEHRPPASSTSEDVKASPSSANKRKNKPLSDMELNSSSEDSKGSKRVRTNSMGSATGPLPGTKVEPTVLDRNCPSPVLIDCPHPNCNKKYKHINGLKYHQAHAHTDDDSKPEADGDSEYGEEPILHADLGSCNGASVSQKGSLSPARSATPKVRLVEPHSPSPSSKFSTKGLCKKKLSGEGDTDLGALSNDGSDDGPSVMDETSNDAFDSLERKCMEKEKCKKPSSLKPEKIPSKSLKSARPIAPAIPPQQIYTFQTATFTAASPGSSSGLTATVAQAMPNSPQLKPIQPKPTVMGEPFTVNPALTPAKDKKKKDKKKKESSKELESPLTPGKVCRAEEGKSPFRESSGDGMKMEGLLNGSSDPHQSRLASIKAEADKIYSFTDNAPSPSIGGSSRLENTTPTQPLTPLHVVTQNGAEASSVKTNSPAYSDISDAGEDGEGKVDSVKSKDAEQLVKEGAKKTLFPPQPQSKDSPYYQGFESYYSPSYAQSSPGALNPSSQAGVESQALKTKRDEEPESIEGKVKNDICEEKKPELSSSSQQPSVIQQRPNMYMQSLYYNQYAYVPPYGYSDQSYHTHLLSTNTAYRQQYEEQQKRQSLEQQQRGVDKKAEMGLKEREAALKEEWKQKPSIPPTLTKAPSLTDLVKSGPGKAKEPGADPAKSVIIPKLDDSSKLPGQAPEGLKVKLSDASHLSKEASEAKTGAECGRQAEMDPILWYRQEAEPRMWTYVYPAKYSDIKSEDERWKEERDRKLKEERSRSKDSVPKEDGKESTSSDCKLPTSEESRLGSKEPRPSVHVPVSSPLTQHQSYIPYMHGYSYSQSYDPNHPSYRSMPAVMMQNYPGSYLPSSYSFSPYGSKVSGGEDADKARASPSVTCKSSSESKALDILQQHASHYKSKSPTISDKTSQERDRGGCGVVGGGGSCSSVGGASGGERSVDRPRTSPSQRLMSTHHHHHHLGYSLLPAQYNLPYAAGLSSTAIVASQQGSTPSLYPPPRR

SEQ ID NO: 7088 - protein, 419 aa, Homo sapiens
MLCDEEAQKRKAKESGMALPQGRLTFMDVAIEFSQEEWKSLDPGQRALYRDVMLENYRNLVFLGRSCVLGSNAENKPIKNQLGLTLEAHLSELQLFQAGRKIYRSNQVEKFTNHRSSVSPLQKISSSFTTHIFNKYRNDLIDFPLLPQEEKAYIRGKSYEYECSEDGEVFRVRASLTNHQVIHTAEKPYKCTECGKVFSRNSHLVEHWRIHTGQKPYKCSECDKVFNRNSNLARHQRIHTGEKPHKCNECGKAFRECSGLTTHLVIHTGEKPYKCNECGKNFRHKFSLTNHQRSHTAEKPYKCNECGKVFSLLSYLARHQIIHSTEKPYKCNECGRAFHKRPGLMAHLLIHTGEKPYKCNECDKVFGRKLYLTNHQRIHTGERPYKCNACGKVFNQNPHLSRHRKIHAGENSLRTLQME

SEQ ID NO: 7089 - protein, 462 aa, Homo sapiens
MLCDEEAQKRKAKESGMALPQGRLTFMDVAIEFSQEEWKSLDPGQRALYRDVMLENYRNLVFLGICLPDLSIISMLKQRREPLILQSQVKIVKNTDGRECVRSVNTGRSCVLGSNAENKPIKNQLGLTLEAHLSELQLFQAGRKIYRSNQVEKFTNHRSSVSPLQKISSSFTTHIFNKYRNDLIDFPLLPQEEKAYIRGKSYEYECSEDGEVFRVRASLTNHQVIHTAEKPYKCTECGKVFSRNSHLVEHWRIHTGQKPYKCSECDKVFNRNSNLARHQRIHTGEKPHKCNECGKAFRECSGLTTHLVIHTGEKPYKCNECGKNFRHKFSLTNHQRSHTAEKPYKCNECGKVFSLLSYLARHQIIHSTEKPYKCNECGRAFHKRPGLMAHLLIHTGEKPYKCNECDKVFGRKLYLTNHQRIHTGERPYKCNACGKVFNQNPHLSRHRKIHAGENSLRTLQME

SEQ ID NO: 7090 - protein, 462 aa, Homo sapiens; identical to SEQ ID NO: 7089

SEQ ID NO: 7091 - protein, 419 aa, Homo sapiens; identical to SEQ ID NO: 7088

SEQ ID NO: 7092 - protein, 705 aa, Homo sapiens
MLREEAAQKRKGKEPGMALPQGRLTFRDVAIEFSLAEWKCLNPSQRALYREVMLENYRNLEAVDISSKCMMKEVLSTGQGNTEVIHTGTLQRHESHHIGDFCFQEIEKEIHDIEFQCQEDERNGLEAPMTKIKKLTGSTDQHDHRHAGNKPIKDQLGSSFYSHLPELHIFQIKGEIGNQLEKSTNDAPSVSTFQRISCRPQTQISNNYGNNPLNSSLLPQKQEVHMREKSFQCNKSGKAFNCSSLLRKHQIPHLGDKQYKCDVCGKLFNHEQYLACHDRCHTVEKPYKCKECGKTFSQESSLTCHRRLHTGVKRYNCNECGKIFGQNSALLIDKAIDTGENPYKCNECDKAFNQQSQLSHHRIHTGEKPYKCEECDKVFSRKSTIETHKRIHTGEKPYRCKVCDTAFTWHSQLARHRRIHTAKKTYKCNECGKTFSHKSSLVCHHRLHGGEKSYKCKVCDKAFVWSSQLAKHTRIDCGEKPYKCNECGKTFGQNSDLLIHKSIHTGEQPYKCDECEKVFSRKSSLETHKIGHTGEKPYKCKVCDKAFACHSYLAKHTRIHSGEKPYKCNECSKTFSHRSYLVCHHRVHSGEKPYKCNECSKTFSRRSSLHCHRRLHSGEKPYKCNECGNTFRHCSSLIYHRRLHTGEKSYKCTICDKAFVRNSLLSRHTRIHTAEKPYKCNECGKAFNQQSHLSRHHRIHTGEKP

SEQ ID NO: 7093 - protein, 636 aa, Homo sapiens
MMKEVLSTGQGNTEVIHTGTLQRHESHHIGDFCFQEIEKEIHDIEFQCQEDERNGLEAPMTKIKKLTGSTDQHDHRHAGNKPIKDQLGSSFYSHLPELHIFQIKGEIGNQLEKSTNDAPSVSTFQRISCRPQTQISNNYGNNPLNSSLLPQKQEVHMREKSFQCNKSGKAFNCSSLLRKHQIPHLGDKQYKCDVCGKLFNHEQYLACHDRCHTVEKPYKCKECGKTFSQESSLTCHRRLHTGVKRYNCNECGKIFGQNSALLIDKAIDTGENPYKCNECDKAFNQQSQLSHHRIHTGEKPYKCEECDKVFSRKSTIETHKRIHTGEKPYRCKVCDTAFTWHSQLARHRRIHTAKKTYKCNECGKTFSHKSSLVCHHRLHGGEKSYKCKVCDKAFVWSSQLAKHTRIDCGEKPYKCNECGKTFGQNSDLLIHKSIHTGEQPYKCDECEKVFSRKSSLETHKIGHTGEKPYKCKVCDKAFACHSYLAKHTRIHSGEKPYKCNECSKTFSHRSYLVCHHRVHSGEKPYKCNECSKTFSRRSSLHCHRRLHSGEKPYKCNECGNTFRHCSSLIYHRRLHTGEKSYKCTICDKAFVRNSLLSRHTRIHTAEKPYKCNECGKAFNQQSHLSRHHRIHTGEKP

SEQ ID NO: 7094 - protein, 705 aa, Homo sapiens; identical to SEQ ID NO: 7092

SEQ ID NO: 7095 - protein, 705 aa, Homo sapiens; identical to SEQ ID NO: 7092

SEQ ID NO: 7096 - protein, 617 aa, Homo sapiens
MIKSQESLTLEDVAVEFTWEEWQLLGPAQKDLYRDVMLENYSNLVSVGYQASKPDALFKLEQGEPWTVENEIHSQICPEIKKVDNHLQMHSQKQRCLKRVEQCHKHNAFGNIIHQRKSDFPLRQNHDTFDLHGKILKSNLSLVNQNKRYEIKNSVGVNGDGKSFLHAKHEQFHNEMNFPEGGNSVNTNSQFIKHQRTQNIDKPHVCTECGKAFLKKSRLIYHQRVHTGEKPHGCSICGKAFSRKSGLTEHQRNHTGEKPYECTECDKAFRWKSQLNAHQKIHTGEKSYICSDCGKGFIKKSRLINHQRVHTGEKPHGCSLCGKAFSKRSRLTEHQRTHTGEKPYECTECDKAFRWKSQLNAHQKAHTGEKSYICRDCGKGFIQKGNLIVHQRIHTGEKPYICNECGKGFIQKGNLLIHRRTHTGEKPYVCNECGKGFSQKTCLISHQRFHTGKTPFVCTECGKSCSHKSGLINHQRIHTGEKPYTCSDCGKAFRDKSCLNRHRRTHTGERPYGCSDCGKAFSHLSCLVYHKGMLHAREKCVGSVKLENPCSESHSLSHTRDLIQDKDSVNMVTLQMPSVAAQTSLTNSAFQAESKVAIVSQPVARSSVSADSRICTE

SEQ ID NO: 7097 - protein, 581 aa, Homo sapiens
MLENYSNLVSVGYQASKPDALFKLEQGEPWTVENEIHSQICPEIKKVDNHLQMHSQKQRCLKRVEQCHKHNAFGNIIHQRKSDFPLRQNHDTFDLHGKILKSNLSLVNQNKRYEIKNSVGVNGDGKSFLHAKHEQFHNEMNFPEGGNSVNTNSQFIKHQRTQNIDKPHVCTECGKAFLKKSRLIYHQRVHTGEKPHGCSICGKAFSRKSGLTEHQRNHTGEKPYECTECDKAFRWKSQLNAHQKIHTGEKSYICSDCGKGFIKKSRLINHQRVHTGEKPHGCSLCGKAFSKRSRLTEHQRTHTGEKPYECTECDKAFRWKSQLNAHQKAHTGEKSYICRDCGKGFIQKGNLIVHQRIHTGEKPYICNECGKGFIQKGNLLIHRRTHTGEKPYVCNECGKGFSQKTCLISHQRFHTGKTPFVCTECGKSCSHKSGLINHQRIHTGEKPYTCSDCGKAFRDKSCLNRHRRTHTGERPYGCSDCGKAFSHLSCLVYHKGMLHAREKCVGSVKLENPCSESHSLSHTRDLIQDKDSVNMVTLQMPSVAAQTSLTNSAFQAESKVAIVSQPVARSSVSADSRICTE

SEQ ID NO: 7098 - protein, 310 aa, Homo sapiens
KRSRLTEHQRTHTGEKPYECTECDKAFRWKSQLNAHQKAHTGEKSYICRDCGKGFIQKGNLIVHQRIHTGEKPYICNECGKGFIQKGNLLIHRRTHTGEKPYVCNECGKGFSQKTCLISHQRFHTGKTPFVCTECGKSCSHKSGLINHQRIHTGEKPYTCSDCGKAFRDKSCLNRHRRTHTGERPYGCSDCGKAFSHLSCLVYHKGMLHAREKCVGSVKLENPCSESHSLSHTRDLIQDKDSVNMVTLQMPSVAAQTSLTNSAFQAESKVAIVSQPVARSSVSADSRFAQNKNHMNAVNVVVLSVINYII

SEQ ID NO: 7099 - protein, 585 aa, Homo sapiens
MIKTQESLTLEDVAVEFSWEEWQLLDTAQKNLYRDVMVENYNHLVSLGYQTSKPDVLSKLAHGQEPWTTDAKIQNKNCPGIGKVDSHLQEHSPNQRLLKSVQQCNGQNTLRNIVHLSKTHFPIVQNHDTFDLYRKNLKSSLSLINQKRRHGINNPVEFIGGEKTLLHGKHERTHTKTRFSENAKCIHTKFQVFKHQRTQKIEKPHACIECEQTFLRKSQLIYHENICIQENPGSGQCEKLSRSVLFTKHLKTNTTDKICIPNEYRKGSTVKSSLITHQQTHTEEKSYMCSECGKGFTMKRYLIAHQRTHSGEKPYVCKECGKGFTVKSNLIVHQRTHTGEKPYICSECGKGFTMKRYLVVHQRTHTGEKPYMCSECGKGFTVKSNLIVHQRSHTGEKSYICSECGKGFTVKRTLVIHQRTHTGEKSYICNECGKGFTTKRTLIIHQRTHTGEKPYECNECGKAFSQKICLIQHERCHTGKTPFVCTECGKSYSHKYGLITHQRIHTGEKPYECNECGKAFTTKSVLNVHQRTHTGERPYGCSDCEKAFSHLSNLVKHKKMHTREMGRISQVENSCNGESQLLPYK

SEQ ID NO: 7100 - protein, 198 aa, Homo sapiens
MIKTQESLTLEDVAVEFSWEEWQLLDTAQKNLYRDVMVENYNHLVSLGYQTSKPDVLSKLAHGQEPWTTDAKIQNKNCPGIGKVDSHLQEHSPNQRLLKSVQQCNGQNTLRNIVHLSKTHFPIVQNHDTFDLYRKNLKSSLSLINQKRRHGINNPVEFIGETGSLERPRQADHLRSEVQDQPGQRGETLCLLKIHTKN

SEQ ID NO: 7101 - protein, 741 aa, Homo sapiens
MTAQESLTLEDVAVDFTWEEWQFLSPAQKDLYRDVMLENYSNLVAVGYQASKPDALSKLERGEETCTTEDEIYSRICSDSGGASGGAYAEIRKIDDPLQHHLQNQSIQKSVKQCHEQNMFGNIVNQNKGHFLLKQDCDTFDLHEKPLKSNLSFENQKRSSGLKNSAEFNRDGKSLFHANHKQFYTEMKFPAIAKPINKSQFIKQQRTHNIENAHVCSECGKAFLKLSQFIDHQRVHTGEKPHVCSMCGKAFSRKSRLMDHQRTHTELKHYECTECDKTFLKKSQLNIHQKTHMGGKPYTCSQCGKAFIKKCRLIYHQRTHTGEKPHGCSVCGKAFSTKFSLTTHQKTHTGEKPYICSECGKGFIEKRRLTAHHRTHTGEKPFICNKCGKGFTLKNSLITHQQTHTGEKLYTCSECGKGFSMKHCLMVHQRTHTGEKPYKCNECGKGFALKSPLIRHQRTHTGEKPYVCTECRKGFTMKSDLIVHQRTHTAEKPYICNDCGKGFTVKSRLIVHQRTHTGEKPYVCGECGKGFPAKIRLMGHQRTHTGEKPYICNECGKGFTEKSHLNVHRRTHTGEKPYVCSECGKGLTGKSMLIAHQRTHTGEKPYICNECGKGFTMKSTLSIHQQTHTGEKPYKCNECDKTFRKKTCLIQHQRFHTGKTSFACTECGKFSLRKNDLITHQRIHTGEKPYKCSDCGKAFTTKSGLNVHQRKHTGERPYGCSDCGKAFAHLSILVKHRRIHR

SEQ ID NO: 7102 - protein, 731 aa, Homo sapiens
MMQAQESLTLEDVAVDFTWEEWQFLSPAQKDLYRDVMLENYSNLVAVGYQASKPDALSKLERGEETCTTEDEIYSRICSEIRKIDDPLQHHLQNQSIQKSVKQCHEQNMFGNIVNQNKGHFLLKQDCDTFDLHEKPLKSNLSFENQKRSSGLKNSAEFNRDGKSLFHANHKQFYTEMKFPAIAKPINKSQFIKQQRTHNIENAHVCSECGKAFLKLSQFIDHQRVHTGEKPHVCSMCGKAFSRKSRLMDHQRTHTELKHYECTECDKTFLKKSQLNIHQKTHMGGKPYTCSQCGKAFIKKCRLIYHQRTHTGEKPHGCSVCGKAFSTKFSLTTHQKTHTGEKPYICSECGKGFIEKRRLTAHHRTHTGEKPFICNKCGKGFTLKNSLITHQQTHTGEKLYTCSECGKGFSMKHCLMVHQRTHTGEKPYKCNECGKGFALKSPLIRHQRTHTGEKPYVCTECRKGFTMKSDLIVHQRTHTAEKPYICNDCGKGFTVKSRLIVHQRTHTGEKPYVCGECGKGFPAKIRLMGHQRTHTGEKPYICNECGKGFTEKSHLNVHRRTHTGEKPYVCSECGKGLTGKSMLIAHQRTHTGEKPYICNECGKGFTMKSTLSIHQQTHTGEKPYKCNECDKTFRKKTCLIQHQRFHTGKTSFACTECGKFSLRKNDLITHQRIHTGEKPYKCSDCGKAFTTKSGLNVHQRKHTGERPYGCSDCGKAFAHLSILVKHRRIHR

SEQ ID NO: 7103 - protein, 685 aa, Homo sapiens
MTAQESLTLEDVAVDFTWEEWQFLSPAQKDLYRDVMLENYSNLVAVGYQASKPDALSKLERGEETCTTEDEIYSRICSDSGGASGGAYAEIRKIDDPLQHHLQNQSIQKSVKQCHEQNMFGNIVNQNKGHFLLKQDCDTFDLHEKPLKSNLSFENQKRSSGLKNSAEFNRDGKSLFHANHKQFYTEMKFPAIAKPINKSQFIKQQRTHNIENAHVCSECGKAFLKLSQFIDHQRVHTGEKPHVCSMCGKAFSRKSRLMDHQRTHTELKHYECTECDKTFLKKSQLNIHQKTHMGGKPYTCSQCGKAFIKKCRLIYHQRTHTGEKPHGCSVCGKAFSTKFSLTTHQKTHTGEKPYICSECGKGFIEKRRLTAHHRTHTGEKPFICNKCGKGFTLKNSLITHQQTHTGEKLYTCSECGKGFSMKHCLMVHQRTHTGEKPYKCNECGKGFALKSPLIRHQRTHTGEKPYVCTECRKGFTMKSDLIVHQRTHTAEKPYICNDCGKGFTVKSRLIVHQRTHTGEKPYVCGECGKGFPAKIRLMGHQRTHTGEKPYICNECGKGFTMKSTLSIHQQTHTGEKPYKCNECDKTFRKKTCLIQHQRFHTGKTSFACTECGKFSLRKNDLITHQRIHTGEKPYKCSDCGKAFTTKSGLNVHQRKHTGERPYGCSDCGKAFAHLSILVKHRRIHR

SEQ ID NO: 7104 - protein, 736 aa, Homo sapiens
MRPEPTKFWEESLTLEDVAVDFTWEEWQFLSPAQKDLYRDVMLENYSNLVAVGYQASKPDALSKLERGEETCTTEDEIYSRICSEIRKIDDPLQHHLQNQSIQKSVKQCHEQNMFGNIVNQNKGHFLLKQDCDTFDLHEKPLKSNLSFENQKRSSGLKNSAEFNRDGKSLFHANHKQFYTEMKFPAIAKPINKSQFIKQQRTHNIENAHVCSECGKAFLKLSQFIDHQRVHTGEKPHVCSMCGKAFSRKSRLMDHQRTHTELKHYECTECDKTFLKKSQLNIHQKTHMGGKPYTCSQCGKAFIKKCRLIYHQRTHTGEKPHGCSVCGKAFSTKFSLTTHQKTHTGEKPYICSECGKGFIEKRRLTAHHRTHTGEKPFICNKCGKGFTLKNSLITHQQTHTGEKLYTCSECGKGFSMKHCLMVHQRTHTGEKPYKCNECGKGFALKSPLIRHQRTHTGEKPYVCTECRKGFTMKSDLIVHQRTHTAEKPYICNDCGKGFTVKSRLIVHQRTHTGEKPYVCGECGKGFPAKIRLMGHQRTHTGEKPYICNECGKGFTEKSHLNVHRRTHTGEKPYVCSECGKGLTGKSMLIAHQRTHTGEKPYICNECGKGFTMKSTLSIHQQTHTGEKPYKCNECDKTFRKKTCLIQHQRFHTGKTSFACTECGKFSLRKNDLITHQRIHTGEKPYKCSDCGKAFTTKSGLNVHQRKHTGERPYGCSDCGKAFAHLSILVKHRRIHR

SEQ ID NO: 7105 - protein, 742 aa, Homo sapiens
MMQAQESLTLEDVAVDFTWEEWQFLSPAQKDLYRDVMLENYSNLVAVGYQASKPDALSKLERGEETCTTEDEIYSRICSDSGGASGGAYAEIRKIDDPLQHHLQNQSIQKSVKQCHEQNMFGNIVNQNKGHFLLKQDCDTFDLHEKPLKSNLSFENQKRSSGLKNSAEFNRDGKSLFHANHKQFYTEMKFPAIAKPINKSQFIKQQRTHNIENAHVCSECGKAFLKLSQFIDHQRVHTGEKPHVCSMCGKAFSRKSRLMDHQRTHTELKHYECTECDKTFLKKSQLNIHQKTHMGGKPYTCSQCGKAFIKKCRLIYHQRTHTGEKPHGCSVCGKAFSTKFSLTTHQKTHTGEKPYICSECGKGFIEKRRLTAHHRTHTGEKPFICNKCGKGFTLKNSLITHQQTHTGEKLYTCSECGKGFSMKHCLMVHQRTHTGEKPYKCNECGKGFALKSPLIRHQRTHTGEKPYVCTECRKGFTMKSDLIVHQRTHTAEKPYICNDCGKGFTVKSRLIVHQRTHTGEKPYVCGECGKGFPAKIRLMGHQRTHTGEKPYICNECGKGFTEKSHLNVHRRTHTGEKPYVCSECGKGLTGKSMLIAHQRTHTGEKPYICNECGKGFTMKSTLSIHQQTHTGEKPYKCNECDKTFRKKTCLIQHQRFHTGKTSFACTECGKFSLRKNDLITHQRIHTGEKPYKCSDCGKAFTTKSGLNVHQRKHTGERPYGCSDCGKAFAHLSILVKHRRIHR

SEQ ID NO: 7106 - protein, 781 aa, Homo sapiens
MATQGHLTFKDVAIEFSQEEWKCLEPVQKALYKDVMLENYRNLVFLGISPKCVIKELPPTENSNTGERFQTVALERHQSYDIENLYFREIQKHLHDLEFQWKDGETNDKEVPVPHENNLTGKRDQHSQGDVENNHIENQLTSNFESRLAELQKVQTEGRLYECNETEKTGNNGCLVSPHIREKTYVCNECGKAFKASSSLINHQRIHTTEKPYKCNECGKAFHRASLLTVHKVVHTRGKSYQCDVCGKIFRKNSYFVRHQRSHTGQKPYICNECGKSFSKSSHLAVHQRIHTGEKPYKCNLCGKSFSQRVHLRLHQTVHTGERPFKCNECGKTFKRSSNLTVHQVIHAGKKPYKCDVCGKAFRHRSNLVCHRRIHSGEKQYKCNECGKVFSKRSSLAVHRRIHTVEKPCKCNECGKVFSKRSSLAVHQRIHTGQKTYKCNKCGKVYSKHSHLAVHWRIHTGEKAYKCNECGKVFSIHSRLAAHQRIHTGEKPYKCNECGKVFSQHSRLAVHRRIHTGEKPYKCKECGKVFSDRSAFARHRRIHTGEKPYKCKECGKVFSQCSRLTVHRRIHSGEKPYKCNECGKVYSQYSHLVGHRRVHTGEKPYKCHECGKAFNQGSTLNRHQRIHTGEKPYKCNQCGNSFSQRVHLRLHQTVHTGDRPYKCNECGKTFKRSSNLTAHQIIHAGKKPYKCDECGKVFRHSSHLVSHQRIHTGEKRYKCIECGKAFGRLFSLSKHQRIHSGKKPYKCNECGKSFICRSGLTKHRIRHTGESLTTKLNVTRP

SEQ ID NO: 7107 - protein, 781 aa, Homo sapiens; identical to SEQ ID NO: 7106

SEQ ID NO: 7108 - protein, 861 aa, Homo sapiens
MNQPGGAAAPQADGASAAGRKSTASRERLKRSQKSTKVEGPEPVPAEASLSAEQGTMTEVKVKTELPDDYIQEVIWQGEAKEEKKAVSKDGTSDVPAEICVVIGGVRNQQTLGSYECGICGKKYKYYNCFQTHVRAHRDTEATSGEGASQSNNFRYTCDICGKKYKYYSCFQEHRDLHAVDVFSVEGAPENRADPFDQGVVATDEVKEEPPEPFQKIGPMNNITSDIFKKKEVRQCQKRETGNYTCEFCGKQYKYYTPYQEHVALHAPIKSAFSRRVEGKAQNHFEETNSSSQNSSEPYTCGACGIQFQFYNNLLEHMQSHAADNENNIASNQSRSPPAVVEEKWKPQAQRNSANNTTTSGLTPNSMIPEKERQNIAERLLRVMCADLGALSVVSGKEFLKLAQTLVDSGARYGAFSVTEILGNFNTLALKHLPRMYNQVKVKVTCALGSNACLGIGVTCHSQSVGPDSCYILTAYQAEGNHIKSYVLGVKGADIRDSGDLVHHWVQNVLSEFVMSEIRTVYVTDCRVSTSAFSKAGMCLRCSACALNSVVQSVLSKRTLQARSMHEVIELLNVCEDLAGSTGLAKETFGSLEETSPPPCWNSVTDSLLLVHERYEQICEFYSRAKKMNLIQSLNKHLLSNLAAILTPVKQAVIELSNESQPTLQLVLPTYVRLEKLFTAKANDAGTVSKLCHLFLEALKENFKVHPAHKVAMILDPQQKLRPVPPYQHEEIIGKVCELINEVKESWAEEADFEPAAKKPRSAAVENPAAQEDDRLGKNEVYDYLQEPLFQATPDLFQYWSCVTQKHTKLAKLAFWLLAVPAVGARSGCVNMCEQALLIKRRRLLSPEDMNKLMFLKSNML

SEQ ID NO: 7109 - protein, 375 aa, Homo sapiens
MNQPGGAAAPQADGASAAGRKSTASRERLKRSQKSTKVEGPEPVPAEASLSAEQGTMTEVKVKTELPDDYIQEVIWQGEAKEEKKAVSKDGTSDVPAEICVVIGGVRNQQTLGSYECGICGKKYKYYNCFQTHVRAHRDTEATSGEGASQSNNFRYTCDICGKKYKYYSCFQEHRDLHAVDVFSVEGAPENRADPFDQGVVATDEVKEEPPEPFQKIGPMNNITSDIFKKKEVRQCQKRETGNYTCEFCGKQYKYYTPYQEHVALHAPISTAPGWEPPDDPDTGSECSHPEVSPSPRFVAAKTQTNQSGKKAPASVVRCATLLHRTPPATQTQTFRTPNSGSPASKATAESAFSRRVEGKAQNHFEETNSSSQNS

SEQ ID NO: 7110 - protein, 954 aa, Homo sapiens
MNQPGGAAAPQADGASAAGRKSTASRERLKRSQKSTKVEGPEPVPAEASLSAEQGTMTEVKVKTELPDDYIQEVIWQGEAKEEKKAVSKDGTSDVPAEICVVIGGVRNQQTLDGKAPEGSPHGGSVRSRYSGTWIFDQALRYASGSYECGICGKKYKYYNCFQTHVRAHRDTEATSGEGASQSNNFRYTCDICGKKYKYYSCFQEHRDLHAVDVFSVEGAPENRADPFDQGVVATDEVKEEPPEPFQKIGPKTGNYTCEFCGKQYKYYTPYQEHVALHAPISTAPGWEPPDDPDTGSECSHPEVSPSPRFVAAKTQTNQSGKKAPASVVRCATLLHRTPPATQTQTFRTPNSGSPASKATAAESAFSRRVEGKAQNHFEETNSSSQNSSEPYTCGACGIQFQFYNNLLEHMQSHAADNENNIASNQSRSPPAVVEEKWKPQAQRNSANNTTTSGLTPNSMIPEKERQNIAERLLRVMCADLGALSVVSGKEFLKLAQTLVDSGARYGAFSVTEILGNFNTLALKHLPRMYNQVKVKVTCALGSNACLGIGVTCHSQSVGPDSCYILTAYQAEGNHIKSYVLGVKGADIRDSGDLVHHWVQNVLSEFVMSEIRTVYVTDCRVSTSAFSKAGMCLRCSACALNSVVQSVLSKRTLQARSMHEVIELLNVCEDLAGSTGLAKETFGSLEETSPPPCWNSVTDSLLLVHERYEQICEFYSRAKKMNLIQSLNKHLLSNLAAILTPVKQAVIELSNESQPTLQLVLPTYVRLEKLFTAKANDAGTVSKLCHLFLEALKENFKVHPAHKVAMILDPQQKLRPVPPYQHEEIIGKVCELINEVKESWAEEADFEPAAKKPRSAAVENPAAQEDDRLGKNEVYDYLQEPLFQATPDLFQYWSCVTQKHTKLAKLAFWLLAVPAVGARSGCVNMCEQALLIKRRRLLSPEDMNKLMFLKSNML

SEQ ID NO: 7111 - protein, 304 aa, Homo sapiens [sequence omitted]

SEQ ID NO: 7112 - protein, 560 aa, Homo sapiens
MGQPAPYAEGPIQGGDAGELCKCDFLVSISIPQTRSDIPAGARRSSMGPRSLDTCWGRGPERHVHRLECNGVIFTHRNLCLPGGKTKTENEEKTAQLNISKESESHRLIVEGLLMDVPQHPDFKDRLEKSQLHDTGNKTKIGDCTDLTVQDHESSTTEREEIARKLEESSVSTHLITKQGFAKEQVFYKCGECGSYYNPHSDFHLHQRVHTNEKPYTCKECGKTFRYNSKLSRHQKIHTGEKPYSCEECGQAFSQNSHLLQHQKLHGGQRPYECTDCGKTFSYNSKLIRHQRIHTGEKPFKCKECGKAFSCSYDCIIHERIHNGEKPYECKECGKSLSSNSVLIQHQRIHTGEKPYECKECGKAFHRSSVFLQHQRFHTGEQLYKCNECWKTFSCSSRFIVHQRIHNGEKPYECQECGKTFSQKITLVQHQRVHTGEKPYECKECGKAFRWNASFIQHQKWHTRKKLINGTGLSAVKPYCPCAILSPLPPQHTCSALAPPGPPLSSSHAVVLPPSVPFFLLLPSSEKANPSPVQIAHFFQDLAFPGKSSLQSPNPLSHSL

SEQ ID NO: 7113 - protein, 576 aa, Homo sapiens
MLQTVWFQGLGRNLLFQEPVTFEDVAVYFTQNEWASLHPTQRALYREVMLENYANVTSLSAFPFPKPDLIFQLEQGEAAWGPDPWTLAGGEALRGMCTGGKTKTENEEKTAQLNISKESESHRLIVEGLLMDVPQHPDFKDRLEKSQLHDTGNKTKIGDCTDLTVQDHESSTTEREEIARKLEESSVSTHLITKQGFAKEQVFYKCGECGSYYNPHSDFHLHQRVHTNEKPYTCKECGKTFRYNSKLSRHQKIHTGEKPYSCEECGQAFSQNSHLLQHQKLHGGQRPYECTDCGKTFSYNSKLIRHQRIHTGEKPFKCKECGKAFSCSYDCIIHERIHNGEKPYECKECGKSLSSNSVLIQHQRIHTGEKPYECKECGKAFHRSSVFLQHQRFHTGEQLYKCNECWKTFSCSSRFIVHQRIHNGEKPYECQECGKTFSQKITLVQHQRVHTGEKPYECKECGKAFRWNASFIQHQKWHTRKKLINGTGLSAVKPYCPCAILSPLPPQHTCSALAPPGPPLSSSHAVVLPPSVPFFLLLPSSEKANPSPVQIAHFFQDLAFPGKSSLQSPNPLSHSL

SEQ ID NO: 7114 - protein, 576 aa, Homo sapiens; identical to SEQ ID NO: 7113

SEQ ID NO: 7115 - protein, 197 aa, Homo sapiens
MGQPAPYAEGPIQGGDAGELCKCNECWKTFSCSSRFIVHQRIHNGEKPYECQECGKTFSQKITLVQHQRVHTGEKPYECKECGKAFRWNASFIQHQKWHTRKKLINGTGLSAVKPYCPCAILSPLPPQHTCSALAPPGPPLSSSHAVVLPPSVPFFLLLPSSEKANPSPVQIAHFFQDLAFPGKSSLQSPNPLSHSL

SEQ ID NO: 7116 - protein, 616 aa, Homo sapiens
MLQTVWFQGLGRNLLFQEPVTFEDVAVYFTQNEWASLHPTQRALYREVMLENYANVTSLYPTAGGFPLDTERTEKVPGALSSFLPSSSSLELILALLPMSAFPFPKPDLIFQLEQGEAAWGPDPWTLAGGEALRGMCTGGKTKTENEEKTAQLNISKESESHRLIVEGLLMDVPQHPDFKDRLEKSQLHDTGNKTKIGDCTDLTVQDHESSTTEREEIARKLEESSVSTHLITKQGFAKEQVFYKCGECGSYYNPHSDFHLHQRVHTNEKPYTCKECGKTFRYNSKLSRHQKIHTGEKPYSCEECGQAFSQNSHLLQHQKLHGGQRPYECTDCGKTFSYNSKLIRHQRIHTGEKPFKCKECGKAFSCSYDCIIHERIHNGEKPYECKECGKSLSSNSVLIQHQRIHTGEKPYECKECGKAFHRSSVFLQHQRFHTGEQLYKCNECWKTFSCSSRFIVHQRIHNGEKPYECQECGKTFSQKITLVQHQRVHTGEKPYECKECGKAFRWNASFIQHQKWHTRKKLINGTGLSAVKPYCPCAILSPLPPQHTCSALAPPGPPLSSSHAVVLPPSVPFFLLLPSSEKANPSPVQIAHFFQDLAFPGKSSLQSPNPLSHSL

SEQ ID NO: 7117 - protein, 532 aa, Homo sapiens
MKPGVISHAPDSVVPAAFPFPKPDLIFQLEQGEAAWGPDPWTLAGGEALRGMCTGGKTKTENEEKTAQLNISKESESHRLIVEGLLMDVPQHPDFKDRLEKSQLHDTGNKTKIGDCTDLTVQDHESSTTEREEIARKLEESSVSTHLITKQGFAKEQVFYKCGECGSYYNPHSDFHLHQRVHTNEKPYTCKECGKTFRYNSKLSRHQKIHTGEKPYSCEECGQAFSQNSHLLQHQKLHGGQRPYECTDCGKTFSYNSKLIRHQRIHTGEKPFKCKECGKAFSCSYDCIIHERIHNGEKPYECKECGKSLSSNSVLIQHQRIHTGEKPYECKECGKAFHRSSVFLQHQRFHTGEQLYKCNECWKTFSCSSRFIVHQRIHNGEKPYECQECGKTFSQKITLVQHQRVHTGEKPYECKECGKAFRWNASFIQHQKWHTRKKLINGTGLSAVKPYCPCAILSPLPPQHTCSALAPPGPPLSSSHAVVLPPSVPFFLLLPSSEKANPSPVQIAHFFQDLAFPGKSSLQSPNPLSHSL

SEQ ID NO: 7118 - protein, 616 aa, Homo sapiens; identical to SEQ ID NO: 7116

SEQ ID NO: 7119 - protein, 567 aa, Homo sapiens
MGQPAPYAEGPIQGGDAGELCKCDFLVSISIPQTRSDIPAGARRSSMGPRSLDTCWGRGPERHVHRVSLLLPRLECNGVIFTHRNLCLPGGKTKTENEEKTAQLNISKESESHRLIVEGLLMDVPQHPDFKDRLEKSQLHDTGNKTKIGDCTDLTVQDHESSTTEREEIARKLEESSVSTHLITKQGFAKEQVFYKCGECGSYYNPHSDFHLHQRVHTNEKPYTCKECGKTFRYNSKLSRHQKIHTGEKPYSCEECGQAFSQNSHLLQHQKLHGGQRPYECTDCGKTFSYNSKLIRHQRIHTGEKPFKCKECGKAFSCSYDCIIHERIHNGEKPYECKECGKSLSSNSVLIQHQRIHTGEKPYECKECGKAFHRSSVFLQHQRFHTGEQLYKCNECWKTFSCSSRFIVHQRIHNGEKPYECQECGKTFSQKITLVQHQRVHTGEKPYECKECGKAFRWNASFIQHQKWHTRKKLINGTGLSAVKPYCPCAILSPLPPQHTCSALAPPGPPLSSSHAVVLPPSVPFFLLLPSSEKANPSPVQIAHFFQDLAFPGKSSLQSPNPLSHSL

SEQ ID NO: 7120 - protein, 157 aa, Homo sapiens
MLQTTWPQESVTFEDVAVYFTQNQWASLDPAQRALYGEVMLENYANVASLVAFPFPKPALISHLERGEAPWGPDPWDTEILRGISQGGESWIKNEGLVIKQEASEETELHRMPVGGLLRNVSQHFDFKRKALKQTFNLNPNLILRGGSVEVRSLRPA

SEQ ID NO: 7121 - protein, 439 aa, Homo sapiens
MLQTTWPQESVTFEDVAVYFTQNQWASLDPAQRALYGEVMLENYANVASLVAFPFPKPALISHLERGEAPWGPDPWDTEILRGISQGGESWIKNEGLVIKQEASEETELHRMPVGGLLRNVSQHFDFKRKALKQTFNLNPNLILRGGMKFYECKECGKIFRYNSKLIRHQMSHTGEKPFKCKECGKAFKSSYDCIVHEKNHIGEGPYECKECGKGLSSNTALTQHQRIHTGEKPYECKECGKAFRRSAAYLQHQRLHTGEKLYKCKECWKAFGCRSLFIVHQRIHTGEKPYQCKECGKAFTQKIASIQHQRVHTGEKPYECKVCGKAFKWYGSFVQHQKLHPVEKKPVKVLGPSLVSPQCSSPAIPPVLLQGSCSASAVAVPSLTFPHAVLIPTSGNFFMLLPTSGIPSSSAQIVRVFQGLTPTVKPSPVILTPSSHSS

SEQ ID NO: 7122 - protein, 439 aa, Homo sapiens; identical to SEQ ID NO: 7121

SEQ ID NO: 7123 - protein, 152 aa, Homo sapiens
MLQTTWPQESVTFEDVAVYFTQNQWASLDPAQRALYGEVMLENYANVASLVAFPFPKPALISHLERGEAPWGPDPWDTEILRGISQGGESWIKNEGLVIKQEASEETELHRMPVGGLLRNVSQHFDFKRKALKQTFNLNPNLILRGGMKFYE

SEQ ID NO: 7124 - protein, 474 aa, Homo sapiens
MELPSPESEEVHEPRLGELLGNPEGQSLGSSPSQDRGCKQVTVTHWKIQTGETAQVCTKSGRNHILNSDLLLLQRELIEGEANPCNICGKTFTFNSDLVRHRISHAGEKPYTCDQCGKGFGQSSHLMEHQRIHTGERLYVCNVCGKDFIHYSGLIEHQRVHSGEKPFKCAQCGKAFCHSSDLIRHQRVHTRERPFECKECGKGFSQSSLLIRHQRIHTGERPYECNECGKSFIRSSSLIRHYQIHTEVKQYECKECGKAFRHRSDLIEHQRIHTGERPFECNECGKAFIRSSKLIQHQRIHTGERPYVCNECGKRFSQTSNFTQHQRIHTGEKLYECNECGKAFFLSSYLIRHQKIHTGERVYECKECGKAFLQKAHLTEHQKIHSGDRPFECKDCGKAFIQSSKLLLHQIIHTGEKPYVCSYCGKALFRGQTSFNTRKFILKRSSMNVVSMGEILTQLQTLKIIKGFTKRDSP

SEQ ID NO: 7125 - protein, 496 aa, Homo sapiens [sequence omitted]

SEQ ID NO: 7126 - protein, 536 aa, Homo sapiens
MILLSFVSDSNVGTGEKKVTEAWISEDENSHRTTSDRLTVMELPSPESEEVHEPRLGELLGNPEGQSLGSSPSQDRGCKQVTVTHWKIQTGETAQVCTKSGRNHILNSDLLLLQRELIEGEANPCNICGKTFTFNSDLVRHRISHAGEKPYTCDQCGKGFGQSSHLMEHQRIHTGERLYVCNVCGKDFIHYSGLIEHQRVHSGEKPFKCAQCGKAFCHSSDLIRHQRVHTRERPFECKECGKGFSQSSLLIRHQRIHTGERPYECNECGKSFIRSSSLIRHYQIHTEVKQYECKECGKAFRHRSDLIEHQRIHTGERPFECNECGKAFIRSSKLIQHQRIHTGERPYVCNECGKRFSQTSNFTQHQRIHTGEKLYECNECGKAFFLSSYLIRHQKIHTGERVYECKECGKAFLQKAHLTEHQKIHSGDRPFECKDCGKAFIQSSKLLLHQIIHTGEKPYVCSYCGKGFIQRSNFLQHQKIHTEEKLYECSQYGRDFNSTTNVKNNQRVHQEGLSLSKAPIHLGERSVDKGEHTGNL

SEQ ID NO: 7127 - protein, 496 aa, Homo sapiens [sequence omitted]

SEQ ID NO: 7128 - protein, 536 aa, Homo sapiens; identical to SEQ ID NO: 7126

SEQ ID NO: 7129 - protein, 865 aa, Homo sapiens
MSLQDSTLSREGKPEGEIMAAVFFSVGRLSPEVTQPDEDLHLQAEETQLVKESVTFKDVAIDFTLEEWRLMDPTQRNLHKDVMLENYRNLVSLGLAVSKPDMISHLENGKGPWVTVREISRIPYPDMEPKPATKKATRTKAISEDLSQEAILEKLTENGLWDSRMEGLWKWNDRILRLQNNQENHLSQRIIPLKKTPTSQRGFRFESILIPEPGIATEELHSRCQTQEENFTENLNLITDTHLGKIICKEMKGSKAIRQTSELTLGKKSNNKEKPYKCSTCEKAFHYRSLLIQHQRTHTKEKPYECNECGKTFSQPSYLSQHKKIHTGEKPYKCNECGKAFIASSSLMVHQRIHTKEKPYQCNVCGKSFSQCARLNQHQRIQTGEKPYKCSECGKAFSDKSKLARHQETHNGEKPYKCDDCGKAFRNKSYLSVHQKTHTEEKPYQCNECGKSFKNTTIFNVHQRIHTGEKPFRCNECGKAYRSNSSLIVHIRTHTGEKPYECNECGKAFNRIANFTEHQRIHTGEKPYKCNECGKAFINYSCLTVHHRMHTGEKPYKCTECGKAFMRSSSLIIHQRIHTEEKPYLCNECGESFRIKSHLTVHQRIHTGEKPYKCTDCERAFTKMVNLKEHQKIHTGVKPYKCYDCGKSFRTKSYLIVHQRTHTGEKPYKCNECEKAFTNTSQLTVHQRRHTGEKPYKCNECGKVFTSNSGFNTHQRTHTGEKPFKCNDCGKAFSQMVHVTEHQKIHSGEKPYKCDVCGKAFRRGSYLTVHWRTHTGEKPYTCKECGKGCITLSQLTLHQRIHTGERPYKCEECGKAFRTNSDFTVHLRMHTGEKPYKCNECGKAFRSSSSLTVHQRIHQRETQLI

SEQ ID NO: 7130 - protein, 111 aa, Homo sapiens
MSLQDSTLSREGKPEGEIMAAVFFSVGRLSPEVTQPDEDLHLQAEETQLVKESVTFKDVAIDFTLEEWRLMDPTQRNLHKDVMLENYRNLVSLGLAVSKPDMISHLENGKG

SEQ ID NO: 7131 - protein, 306 aa, Homo sapiens
MGERLLESKKDHQHGEILTQVPDDMLKKKTPRVKSCGEVSVGHASLNRHHRADTGHKPYEYQEYGQKPYKCTYCKKAFSDLPYFRTHEWAHTGGKPYDCEECGKSFISRSSIRRHRIMHSGDGPYKCNFCGKALMCLSLYLIHKRTHTGEKPYECKQCGKAFSHSGSLRIHERTHTGEKPYECSECGKAFHSSTCLHAHKITHTGEKPYECKQCGKAFVSFNSVRYHERTHTGEKPYECKQCGKAFRSASHLRTHGRTHTGEKPYECKQCGKAFGCASSVKIHERTHTGEKPCSSNTSKGQGEKIA

SEQ ID NO: 7132 - protein, 372 aa, Homo sapiens
MDSVVFEDVDVNFTQEEWALLDPSQKNLYRDVMQETFRNLASVGKKWKDQKIEDEYKNPRRNLRGLMGERLLESKKDHQHGEILTQVPDDMLKKKTPRVKSCGEVSVGHASLNRHHRADTGHKPYEYQEYGQKPYKCTYCKKAFSDLPYFRTHEWAHTGGKPYDCEECGKSFISRSSIRRHRIMHSGDGPYKCNFCGKALMCLSLYLIHKRTHTGEKPYECKQCGKAFSHSGSLRIHERTHTGEKPYECSECGKAFHSSTCLHAHKITHTGEKPYECKQCGKAFVSFNSVRYHERTHTGEKPYECKQCGKAFRSASHLRTHGRTHTGEKPYECKQCGKAFGCASSVKIHERTHTGEKPCSSNTSKGQGEKIA

SEQ ID NO: 7133 - protein, 306 aa, Homo sapiens; identical to SEQ ID NO: 7131

SEQ ID NO: 7134 - protein, 92 aa, Homo sapiens
MGPLQFRDVAIEFSLEEWHCLDTAQRNLYRNVMLENYSNLVFLGITVSKPDLITCLEQGRKPLTMKRNEMIAKPSVSFLQVHSESQSPLHDI

SEQ ID NO: 7135 - protein, 540 aa, Homo sapiens
MGPLQFRDVAIEFSLEEWHCLDTAQRNLYRNVMLENYSNLVFLGITVSKPDLITCLEQGRKPLTMKRNEMIAKPSVMCSHFAQDLWPEQSMKDSFQKVVLRRYEKCEHDNLQLKKGCISVDECKVHKEGYNELNQCLTTTPRKICQCDKYVKVLHQFPNSNGQKRGHTGKKPFKYIECGKAFKQFSTLTTHKKIHTGGKPYKCEECGKAFNHSCSLTRHKKIHTGEKPYKCEECGKAFKHSSTLTTHKRNHTGEKPYKCDKCGKAFMSSSTLSKHEIIHTEKKPYKCEECGKAFNRSSTLTTHKIIHTGEKPYKCEECDKAFKYSYTLTTHKRIHTEDKPYKCEECGKAFKYSSTLTTHKRIHTGEKPYKCEECGKAFKRSSDLTTHKIIHTGEKPYKCEECGKAFKYSSNLTTHKKIHTGERPYKCEECGKAFNQSSILTTHRRIHTGEKFYKCEECGKAFKRSSHLTTHKIIHTGEKFYKCEECDKAFKHFSNLTTHKKIHTGKKPYRCEECGKAFKHSSKLTTHKRFHTGEKPYRCE

SEQ ID NO: 7136 - protein, 528 aa, Homo sapiens
MGPLQFRDVAIEFSLEEWHCLDTAQRNLYRNVMLENYSNLVFLGITVSKPDLITCLEQGRKPLTMKRNEMIAKPSVMCSHFAQDLWPEQSMKDSFQKVVLRRYEKCEHDNLQLKKGCISVDECKVHKEGYNELNQCLTTTPRKICQCDKYVKVLHQFPNSNGQKRGHTGKKPFKYIECGKAFKQFSTLTTHKKIHTGGKPYKCEECGKAFNHSCSLTRHKKIHTGEKPYKCEECGKAFKHSSTLTTHKRNHTGEKPYKCDKCGKAFMSSSTLSKHEIIHTEKKPYKCEECGKAFNRSSTLTTHKIIHTGEKPYKCEECDKAFKYSYTLTTHKRIHTEDKPYKCEECGKAFKYSSTLTTHKRIHTGEKPYKCEECGKAFKRSSDLTTHKIIHTGEKPYKCEECGKAFKYSSNLTTHKKIHTGERPYKCEECGKAFNQSSILTTHRRIHTGEKFYKCEECGKAFKCSSNLTTHKKIHTGERPYKCEECGKAFNQSSILTTHERIILERNSTNVKNVAKPSSGPHTLLHIR

SEQ ID NO: 7137 - protein, 452 aa, Homo sapiens
MCSHFAQDLWPEQSMKDSFQKVVLRRYEKCEHDNLQLKKGCISVDECKVHKEGYNELNQCLTTTPRKICQCDKYVKVLHQFPNSNGQKRGHTGKKPFKYIECGKAFKQFSTLTTHKKIHTGGKPYKCEECGKAFNHSCSLTRHKKIHTGEKPYKCEECGKAFKHSSTLTTHKRNHTGEKPYKCDKCGKAFMSSSTLSKHEIIHTEKKPYKCEECGKAFNRSSTLTTHKIIHTGEKPYKCEECDKAFKYSYTLTTHKRIHTEDKPYKCEECGKAFKYSSTLTTHKRIHTGEKPYKCEECGKAFKRSSDLTTHKIIHTGEKPYKCEECGKAFKYSSNLTTHKKIHTGERPYKCEECGKAFNQSSILTTHRRIHTGEKFYKCEECGKAFKCSSNLTTHKKIHTGERPYKCEECGKAFNQSSILTTHERIILERNSTNVKNVAKPSSGPHTLLHIR

SEQ ID NO: 7138 - protein, 528 aa, Homo sapiens; identical to SEQ ID NO: 7136

SEQ ID NO: 7139 - protein, 869 aa, Homo sapiens
MEPETALWGPDLQGPEQSPNDAHRGAESENEEESPRQESSGEEIIMGDPAQSPESKDSTEMSLERSSQDPSVPQNPPTPLGHSNPLDHQIPLDPPAPEVVPTPSDWTKACEASWQWGALTTWNSPPVVPANEPSLRELVQGRPAGAEKPYICNECGKSFSQWSKLLRHQRIHTGERPNTCSECGKSFTQSSHLVQHQRTHTGEKPYKCPDCGKCFSWSSNLVQHQRTHTGEKPYKCTECEKAFTQSTNLIKHQRSHTGEKPYKCGECRRAFYRSSDLIQHQATHTGEKPYKCPECGKRFGQNHNLLKHQKIHAGEKPYRCTECGKSFIQSSELTQHQRTHTGEKPYECLECGKSFGHSSTLIKHQRTHLREDPFKCPVCGKTFTLSATLLRHQRTHTGERPYKCPECGKSFSVSSNLINHQRIHRGERPYICADCGKSFIMSSTLIRHQRIHTGEKPYKCSDCGKSFIRSSHLIQHRRTHTGEKPYKCPECGKSFSQSSNLITHVRTHMDENLFVCSDCGKAFLEAHELEQHRVIHERGKTPARRAQGDSLLGLGDPSLLTPPPGAKPHKCLVCGKGFNDEGIFMQHQRIHIGENPYKNADGLIAHAAPKPPQLRSPRLPFRGNSYPGAAEGRAEAPGQPLKPPEGQEGFSQRRGLLSSKTYICSHCGESFLDRSVLLQHQLTHGNEKPFLFPDYRIGLGEGAGPSPFLSGKPFKCPECKQSFGLSSELLLHQKVHAGGKSSQKSPELGKSSSVLLEHLRSPLGARPYRCSDCRASFLDRVALTRHQETHTQEKPPNPEDPPPEAVTLSTDQEGEGETPTPTESSSHGEGQNPKTLVEEKPYLCPECGAGFTEVAALLLHRSCHPGVSL

SEQ ID NO: 7140 - protein, 485 aa, Homo sapiens
MNEYPKKRKRKTLHPSRYSDSSGISRIADGFNGIFSDHCYSVCSMRQPDLKYFDNKDDDSDTETSNDLPKFADGIKARNRNQNYLVPSPVLRILDHTAFSTEKSADIVICDEECDSPESVNQQTQEESPIEVHTAEDVPIAVEVHAISEDYDIETENNSSESLQDQTDEEPPAKLCKILDKSQALNVTAQQKWPLLRANSSGLYKCELCEFNSKYFSDLKQHMILKHKRTDSNVCRVCKESFSTNMLLIEHAKLHEEDPYICKYCDYKTVIFENLSQHIADTHFSDHLYWCEQCDVQFSSSSELYLHFQEHSCDEQYLCQFCEHETNDPEDLHSHVVNEHACKLIELSDKYNNGEHGQYSLLSKITFDKCKNFFVCQVCGFRSRLHTNVNRHVAIEHTKIFPHVCDDCGKGFSSMLEYCKHLNSHLSEGIYLCQYCEYSTGQIEDLKIHLDFKHSADLPHKCSDCLMRFGNERELISHLPVHETT

SEQ ID NO: 7141 - protein, 288 aa, Homo sapiens
MNEYPKKRKRKTLHPSRYSDSSGISRIADGFNGIFSDHCYSVCSMRQPDLKYFDNKDDDSDTETSNDLPKFADGIKARNRNQNYLVPSPVLRILDHTAFSTEKSADIVICDEECDSPESVNQQTQEESPIEVHTAEDVPIAVEVHAISEDYDIETENNSSESLQDQTDEEPPAKLCKILDKSQALNVTAQQKWPLLRANSSGLYKCELCEFNSKYFSDLKQHMILKHKRTDSNVCRVCKESFSTNMLLIEHAKLHEEDPYICKYCDYKTVIFENLSQHIADTHFSDHL

SEQ ID NO: 7142 - protein, 137 aa, Homo sapiens
MNEYPKKRKRKTLHPSRYSDSSGISRIADGFNGIFSDHCYSVCSMRQPDLKYFDNKDDDSDTETSNDLPKFADGIKARNRNQNYLVPSPVLRILDHTAFSTEKSADIVICDEECDSPESVNQQTQEESPIEVHTAED

SEQ ID NO: 7143 - protein, 485 aa, Homo sapiens; identical to SEQ ID NO: 7140

SEQ ID NO: 7144 - protein, 216 aa, Homo sapiens
MNEYPKKRKRKTLHPSRYSDSSGISRIADGFNGIFSDHCYSVCSMRQPDLKYFDNKDDDSDTETSNDLPKFADGIKARNRNQNYLVPSPVLRILDHTAFSTEKSADIVICDEECDSPESVNQQTQEESPIEVHTAEDVPIAVEVHAISEDYDIETENNSSESLQDQTDEEPPAKLCKILDKSQALNVTAQQKWPLLRANSSGLYKCELCEFNSKYF

SEQ ID NO: 7145 - protein, 130 aa, Homo sapiens
MNEYPKKRKRKTLHPSRYSDSSGISRIADGFNGIFSDHCYSVCSMRQPDLKYFDNKDDDSDTETSNDLPKFADGIKARNRNQNYLVPSPVLRILDHTAFSTEKSADIVICDEECDSPESVNQQTQEESPI

SEQ ID NO: 7146 - protein, 485 aa, Homo sapiens; identical to SEQ ID NO: 7140

SEQ ID NO: 7147 - protein, 681 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDAPFQCWLCSAKFKISSDLKRHMRVHSGEKPFKCEFCNVRCTMKGNLKSHIRIKHSGNNFKCPHCDFLGDSKATLRKHSRVHQSEHPEKCSECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVPQFSEGRVKIIVGHQVPQANTIVQAAAAAVNIVPPALVAQNPEELPGNSRLQILRQVSLIAPPQSSRCPSEAGAMTQPAVLLTTHEQTDGATLHQTLIPTASGGPQEGSGNQTFITSSGITCTDFEGLNALIQEGTAEVTVVSDGGQNIAVATTAPPVFSSSSQQELPKQTYSIIQGAAHPALLCPADSIPD

SEQ ID NO: 7148 - protein, 627 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDAPFQCWLCSAKFKISSDLKRHMRVHSGEKPFKCEFCNVRCTMKGNLKSHIRIKHSGNNFKCPHCDFLGDSKATLRKHSRVHQSEHPEKCSECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVPQFSEGRVKIIVGHQVPQANTIVQAAAAAVNIVPPALVAQNPEELPGNSRLQILRQVSLIAPPQSSRCPSEAGAMTQPAVLLTTHEQTDGATLHQTLIPTASGGPQEGSGNQTFITSSGITCTDFEGLNALIQEGTAEVTVVSDGGQNIAVATTAPPVFSSSSQQELPKQTYSIIQGAAHPALLCPADSIPD

SEQ ID NO: 7149 - protein, 645 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGDTPFQCWLCSAKFKISSDLKRHMIVHSGEKPFKCEFCDVRCTMKANLKSHIRIKHTFKCLHCAFQGRDRADLLEHSRLHQADHPEKCPECSYSCSSAAALRVHSRVHCKDRPFKCDFCSFDTKRPSSLAKHVDKVHRDEAKTENRAPLGKEGLREGSSQHVAKIVTQRAFRCETCGASFVRDDSLRCHKKQHSDQSENKNSDLVTFPPESGASGQLSTLVSVGQLEAPLEPSQDL

SEQ ID NO: 7150 - protein, 679 aa, Homo sapiens
MNASSEGESFAGSVQSGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDAPFQCWLCSAKFKISSDLKRHMRVHSGEKPFKCEFCNVRCTMKGNLKSHIRIKHSGNNFKCPHCDFLGDSKATLRKHSRVHQSEHPEKCSECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVPQFSEGRVKIIVGHQVPQANTIVQAAAAAVNIVPPALVAQNPEELPGNSRLQILRQVSLIAPPQSSRCPSEAGAMTQPAVLLTTHEQTDGATLHQTLIPTASGGPQEGSGNQTFITSSGITCTDFEGLNALIQEGTAEVTVVSDGGQNIAVATTAPPVFSSSSQQELPKQTYSIIQGAAHPALLCPADSIPD

SEQ ID NO: 7151 - protein, 643 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGKGSIMSYLCRGLGRYPSEIISDVQKSCKNCTKKNSPNVTILLYLLCHSLYIYKLLQCVFPKNQNILLNNHRTIIKSDFVIKCHFMSFISSNQEQLSIYLSFRLCSFGRNHKMTVCFSRSSHIFPITVVLTLVTWLRMFLPVFSMLKLSFFFLGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDAPFQCWLCSAKFKISSDLKRHMRVHSGEKPFKCEFCNVRCTMKGNLKSHIRIKHSGNNFKCPHCDFLGDSKATLRKHSRVHQSEHPEKCSECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVP

SEQ ID NO: 7152 - protein, 426 aa, Homo sapiens
MSRRKQAKPQHLNSEEPRPARRECAEVAPQVAGEPASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGDTPFQCWLCSAKFKISSDLKRHMIVHSGEKPFKCEFCDVRCTMKANLKSHIRIKHTFKCLHCAFQGRDRADLLEHSRLHQADHPEKCPECSYSCSSAAALRVHSRVHCKDRPFKCDFCSFDTKRPSSLAKHVDKVHRDEAKTENRAPLGKEGLREGSSQHVAKIVTQRAFRCETCGASFVRDDSLRCHKKQHSDQSENKNSDLVTFPPESGASGQLSTLVSVGQLEAPLEPSQDL

SEQ ID NO: 7153 - protein, 131 aa, Homo sapiens
MRGHPSLRPPWHWASAARLEGGFLPWGYVSNALSREGLTEERTFERRPEGWEGASCAASELDDDVPKANCLSTESTDTPKAPVITLPSEAREQMATLGERTFNCCYPGCHFKTVHGMKDLDRHLRIHTASC

SEQ ID NO: 7154 - protein, 221 aa, Homo sapiens
MRGHPSLRPPWHWASAARLEGGFLPWGYVSNALSREGLTEERTFERRPEGWEGASCAASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGDTPFQCWL

SEQ ID NO: 7155 - protein, 120 aa, Homo sapiens
  MOD_RES (1)..(1): Any amino acid
XERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGPGPG

SEQ ID NO: 7156 - protein, 523 aa, Homo sapiens
MKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDAPFQCWLCSAKFKISSDLKRHMRVHSGEKPFKCEFCNVRCTMKGNLKSHIRIKHSGNNFKCPHCDFLGDSKATLRKHSRVHQSEHPEKCSECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVPQFSEGRVKIIVGHQVPQANTIVQAAAAAVNIVPPALVAQNPEELPGNSRLQILRQVSLIAPPQSSRCPSEAGAMTQPAVLLTTHEQTDGATLHQTLIPTASGGPQEGSGNQTFITSSGITCTDFEGLNALIQEGTAEVTVVSDGGQNIAVATTAPPVFSSSSQQELPKQTYSIIQGAAHPALLCPADSIPD

SEQ ID NO: 7157 - protein, 526 aa, Homo sapiens
MPQQLLITLPTEASTWVKLQHPKKAVEGAPLWEDVTKMFEGEALLSQDAEDVKTQRESLEDEVTPGLPTAESQELLTFKDISIDFTQEEWGQLAPAHQNLYREVMLENYSNLVSVGYQLSKPSVISQLEKGEEPWMAEKEGPGDPSSDLKSKIETIESTAKSTISQERLYHGIMMESFMRDDIIYSTLRKVSTYDDVLERHQETCMRDVRQAILTHKKRVQETNKFGENIIVHSNVIIEQRHHKYDTPTKRNTYKLDLINHPTSYIRTKTYECNICEKIFKQPIHLTEHMRIHTGEKPFRCKECGRAFSQSASLSTHQRIHTGEKPFECEECGKAFRHRSSLNQHHRTHTGEKPYVCDKCQKAFSQNISLVQHLRTHSGEKPFTCNECGKTFRQIRHLSEHIRIHTGEKPYACTACCKTFSHRAYLTHHQRIHTGERPYKCKECGKAFRQRIHLSNHKTVHTGVKAYECNRCGKAYRHDSSFKKHQRHHTGEKPYECNECGKAFSYNSSLSRHHEIHRRNAFRNKV

SEQ ID NO: 7158 - protein, 526 aa, Homo sapiens; identical to SEQ ID NO: 7157

SEQ ID NO: 7159 - protein, 432 aa, Homo sapiens
MLENYGNLVSVGCQLSKPGVISQLEKGEEPWLMERDISGVPSSDLKSKTKTKESALQNDISWEELHCGLMMERFTKGSSMYSTLGRISKCNKLESQQENQRMGKGQIPLMCKKTFTQERGQESNRFEKRINVKSEVMPGPIGLPRKRDRKYDTPGKRSRYNIDLVNHSRSYTKMKTFECNICEKIFKQLIHLTEHMRIHTGEKPFRCKECGKAFSQSSSLIPHQRIHTGEKPYECKECGKTFRHPSSLTQHVRIHTGEKPYECRVCEKAFSQSIGLIQHLRTHVREKPFTCKDCGKAFFQIRHLRQHEIIHTGVKPYICNVCSKTFSHSTYLTQHQRTHTGERPYKCKECGKAFSQRIHLSIHQRVHTGVKPYECSHCGKAFRHDSSFAKHQRIHTGEKPYDCNECGKAFSCSSSLIRHCKTHLRNTFSNVV

SEQ ID NO: 7160 - protein, 534 aa, Homo sapiens
MLQQLLITLPTEASTWVKLRHPKAATERVALWEDVTKMFKAEALLSQDADETQGESLESRVTLGSLTAESQELLTFKDVSVDFTQEEWGQLAPAHRNLYREVMLENYGNLVSVGCQLSKPGVISQLEKGEEPWLMERDISGVPSSDLKSKTKTKESALQNDISWEELHCGLMMERFTKGSSMYSTLGRISKCNKLESQQENQRMGKGQIPLMCKKTFTQERGQESNRFEKRINVKSEVMPGPIGLPRKRDRKYDTPGKRSRYNIDLVNHSRSYTKMKTFECNICEKIFKQLIHLTEHMRIHTGEKPFRCKECGKAFSQSSSLIPHQRIHTGEKPYECKECGKTFRHPSSLTQHVRIHTGEKPYECRVCEKAFSQSIGLIQHLRTHVREKPFTCKDCGKAFFQIRHLRQHEIIHTGVKPYICNVCSKTFSHSTYLTQHQRTHTGERPYKCKECGKAFSQRIHLSIHQRVHTGVKPYECSHCGKAFRHDSSFAKHQRIHTGEKPYDCNECGKAFSCSSSLIRHCKTHLRNTFSNVV

SEQ ID NO: 7161 - protein, 465 aa, Homo sapiens
MLFSALFFLLYSAFFRRPEYQRTIFKFLGWLCDLSIYSLFFPISRMSAFQTWRDFPVGERRRPWLMERDISGVPSSDLKSKTKTKESALQNDISWEELHCGLMMERFTKGSSMYSTLGRISKCNKLESQQENQRMGKGQIPLMCKKTFTQERGQESNRFEKRINVKSEVMPGPIGLPRKRDRKYDTPGKRSRYNIDLVNHSRSYTKMKTFECNICEKIFKQLIHLTEHMRIHTGEKPFRCKECGKAFSQSSSLIPHQRIHTGEKPYECKECGKTFRHPSSLTQHVRIHTGEKPYECRVCEKAFSQSIGLIQHLRTHVREKPFTCKDCGKAFFQIRHLRQHEIIHTGVKPYICNVCSKTFSHSTYLTQHQRTHTGERPYKCKECGKAFSQRIHLSIHQRVHTGVKPYECSHCGKAFRHDSSFAKHQRIHTGEKPYDCNECGKAFSCSSSLIRHCKTHLRNTFSNVV

SEQ ID NO: 7162 - protein, 1832 aa, Homo sapiens
MEDTPPSLSCSDCQRHFPSLPELSRHRELLHPSPNQDSEEADSIPRPYRCQQCGRGYRHPGSLVNHRRTHETGLFPCTTCGKDFSNPMALKSHMRTHAPEGRRRHRPPRPKEATPHLQGETVSTDSWGQRLGSSEGWENQTKHTEETPDCESVPDPRAASGTWEDLPTRQREGLASHPGPEDGADGWGPSTNSARAPPLPIPASSLLSNLEQYLAESVVNFTGGQEPTQSPPAEEERRYKCSQCGKTYKHAGSLTNHRQSHTLGIYPCAICFKEFSNLMALKNHSRLHAQYRPYHCPHCPRVFRLPRELLEHQQSHEGERQEPRWEEKGMPTTNGHTDESSQDQLPSAQMLNGSAELSTSGELEDSGLEEYRPFRCGDCGRTYRHAGSLINHRKSHQTGVYPCSLCSKQLFNAAALKNHVRAHHRPRQGVGENGQPSVPPAPLLLAETTHKEEEDPTTTLDHRPYKCSECGRAYRHRGSLVNHRHSHRTGEYQCSLCPRKYPNLMALRNHVRVHCKAARRSADIGAEGAPSHLKVELPPDPVEAEAAPHTDQDHVCKHEEEATDITPAADKTAAHICSICGLLFEDAESLERHGLTHGAGEKENSRTETTMSPPRAFACRDCGKSYRHSGSLINHRQTHQTGDFSCGACAKHFHTMAAMKNHLRRHSRRRSRRHRKRAGGASGGREAKLLAAESWTRELEDNEGLESPQDPSGESPHGAEGNLESDGDCLQAESEGDKCGLERDETHFQGDKESGGTGEGLERKDASLLDNLDIPGEEGGGTHFCDSLTGVDEDQKPATGQPNSSSHSANAVTGWQAGAAHTCSDCGHSFPHATGLLSHRPCHPPGIYQCSLCPKEFDSLPALRSHFQNHRPGEATSAQPFLCCLCGMIFPGRAGYRLHRRQAHSSSGMTEGSEEEGEEEGVAEAAPARSPPLQLSEAELLNQLQREVEALDSAGYGHICGCCGQTYDDLGSLERHHQSQSSGTTADKAPSPLGVAGDAMEMVVDSVLEDIVNSVSGEGGDAKSQEGAGTPLGDSLCIQGGESLLEAQPRPFRCNQCGKTYRHGGSLVNHRKIHQTGDFLCPVCSRCYPNLAAYRNHLRNHPRCKGSEPQVGPIPEAAGSSELQVGPIPEGGSNKPQHMAEEGPGQAEVEKLQEELKVEPLEEVARVKEEVWEETTVKGEEIEPRLETAEKGCQTEASSERPFSCEVCGRSYKHAGSLINHRQSHQTGHFGCQACSKGFSNLMSLKNHRRIHADPRRFRCSECGKAFRLRKQLASHQRVHMERRGGGGTRKATREDRPFRCGQCGRTYRHAGSLLNHRRSHETGQYSCPTCPKTYSNRMALKDHQRLHSENRRRRAGRSRRTAVRCALCGRSFPGRGSLERHLREHEETEREPANGQGGLDGTAASEANLTGSQGLETQLGGAEPVPHLEDGVPRPGERSQSPIRAASSEAPEPLSWGAGKAGGWPVGGGLGNHSGGWVPQFLTRSEEPEDSVHRSPCHAGDCQLNGPTLSHMDSWDNRDNSSQLQPGSHSSCSQCGKTYCQSGSLLNHNTNKTDRHYCLLCSKEFLNPVATKSHSHNHIDAQTFACPDCGKAFESHQELASHLQAHARGHSQVPAQMEEARDPKAGTGEDQVVLPGQGKAQEAPSETPRGPGESVERARGGQAVTSMAAEDKERPFRCTQCGRSYRHAGSLLNHQKAHTTGLYPCSLCPKLLPNLLSLKNHSRTHTDPKRHCCSICGKAFRTAARLEGHGRVHAPREGPFTCPHCPRHFRRRISFVQHQQQHQEEWTVAGSGAPVAPVTGRGDLPLPPPPTPTTPLLDPSPQWPADLSFSL

SEQ ID NO: 7163 - protein, 1829 aa, Homo sapiens
MEDTPPSLSCSDCQRHFPSLPELSRHRELLHPSPNQDSEEADSIPRPYRCQQCGRGYRHPGSLVNHRRTHETGLFPCTTCGKDFSNPMALKSHMRTHAPEGRRRHRPPRPKEATPHLQGETVSTDSWGQRLGSSEGWENQTKHTEETPDCESVPDPRAASGTWEDLPTRQREGLASHPGPEDGADGWGPSTNSARAPPLPIPASSLLSNLEQYLAESVVNFTGGQEPTQSPPAEEERRYKCSQCGKTYKHAGSLTNHRQSHTLGIYPCAICFKEFSNLMALKNHSRLHAQYRPYHCPHCPRVFRLPRELLEHQQSHEGERQEPRWEEKGMPTTNGHTDESSQDQLPSAQMLNGSAELSTSGELEDSGLEEYRPFRCGDCGRTYRHAGSLINHRKSHQTGVYPCSLCSKQLFNAAALKNHVRAHHRPRQGVGENGQPSVPPAPLLLAETTHKEEEDPTTTLDHRPYKCSECGRAYRHRGSLVNHRHSHRTGEYQCSLCPRKYPNLMALRNHVRVHCKAARRSADIGAEGAPSHLKVELPPDPVEAEAAPHTDQDHVCKHEEEATDITPAADKTAAHICSICGLLFEDAESLERHGLTHGAGEKENSRTETTMSPPRAFACRDCGKSYRHSGSLINHRQTHQTGDFSCGACAKHFHTMAAMKNHLRRHSRRRSRRHRKRAGGASGGREAKLLAAESWTRELEDNEGLESPQDPSGESPHGAEGNLESDGDCLQAESEGDKCGLERDETHFQGDKESGGTGEGLERKDASLLDNLDIPGEEGGGTHFCDSLTGVDEDQKPATGQPNSSSHSANAVTGWQAGAAHTCSDCGHSFPHATGLLSHRPCHPPGIYQCSLCPKEFDSLPALRSHFQNHRPGEATSAQPFLCCLCGMIFPGRAGYRLHRRQAHSSSGMTEGSEEEGEEEGVAEAAPARSPPLQLSEAELLNQLQREVEALDSAGYGHICGCCGQTYDDLGSLERHHQSQSSGTTADKAPSPLGVAGDAMEMVVDSVLEDIVNSVSGEGGDAKSQEGAGTPLGDSLCIQGGESLLEAQPRPFRCNQCGKTYRHGGSLVNHRKIHQTGDFLCPVCSRCYPNLAAYRNHLRNHPRCKGSEPQVGPIPEAAGSSELQVGPIPEGGSNKPQHMAEEGPGQAEVEKLQEELKVEPLEEVARVKEEVWEETTVKGEEIEPRLETAEKGCQTEASSERPFSCEVCGRSYKHAGSLINHRQSHQTGHFGCQACSKGFSNLMSLKNHRRIHADPRRFRCSECGKAFRLRKQLASHQRVHMERRGGGGTRKATREDRPFRCGQCGRTYRHAGSLLNHRRSHETGQYSCPTCPKTYSNRMALKDHQRLHSENRRRRAGRSRRTAVRCALCGRSFPGRGSLERHLREHEETEREPANGQGGLDGTAASEANLTGSQGLETQLGGAEPVPHLEDGVPRPGERSQSPIRAASSEAPEPLSWGAGKAGGWPVGGGLGNHSGGWVPQFLTRSEEPEDSVHRSPCHAGDCQLNGPTLSHMDSWDNRDNSSQLQPGSHSSCSQCGKTYCQSGSLLNHNTNKTDRHYCLLCSKEFLNPVATKSHSHNHIDAQTFACPDCGKAFESHQELASHLQAHARGHSQVPAQMEEARDPKAGTGEDQVVLPGQGKAQEAPSETPRGPGESVERARGGQAVTSMAAEDKERPFRCTQCGRSYRHAGSLLNHQKAHTTGLYPCSLCPKLLPNLLSLKNHSRTHTDPKRHCCSICGKAFRTAARLEGHGRVHAPREGPFTCPHCPRHFRRRISFVQHQQQHQEEWTVAGSGRGHEGSQEEVGTQWRGKSSPKVGGGARSERREPRGF

SEQ ID NO: 7164 - protein, 240 aa, Homo sapiens
MEDTPPSLSCSDCQRHFPSLPELSRHRELLHPSPNQDSEEADSIPRPYRCQQCGRGYRHPGSLVNHRRTHETGLFPCTTCGKDFSNPMALKSHMRTHAPEGRRRHRPPRPKEATPHLQGETVSTDSWGQRLGSSEGWENQTKHTEETPDCESVPDPRAASGTWEDLPTRQREGLASHPGPEDGADGWGPSTNSARAPPLPIPASSLLSNLEQYLAESVVNFTGGQEPTQSPPAEEERRYK

SEQ ID NO: 7165 - protein, 193 aa, Homo sapiens
ERRYKCSQCGKTYKHAGSLTNHRQSHTLGIYPCAICFKEFSNLMALKNHSRLHAQYRPYHCPHCPRVFRLPRELLEHQQSHEAARPFSCEVCGRSYKHAGSLINHRQSHQTGHFGCQACSKGFSNLMSLKNHRRIHADPRRFRCSECGKAFRLRKQLASHQRVHMERHRPFRCGQCGRTYRHAGSLLNHRRSH

SEQ ID NO: 7166 - protein, 568 aa, Homo sapiens
MAQVDSQDRWGEASPLSSLTEEAHDTQMLSMNLESDDEDGGEAEKEGTADPVACPRGSSPVTHENPDLPWPHPLGKEEEKFSDSSSAGGMGQKPVEMSGKASWSRDVTKINETQGSPGASRALGSLPSGLAHKLLGQMQPLGDRLPAGDDGYSGANQDAVLDVPPSFPSNGKYLCAHKSVDTSAGNSSLLCFPRPGSNWDLPTQETHTPAQASATPASLAAAVLAKARNSRKVQNQAGRREGGEAEARPYRCLRGGRAFQKPSKPLSPAETRGGAAKRYACELCGKAYSHRGTLQQHRRLHTGERPYQCSFCDKAYTWSSDHRKHIRTHTGEKPYPCPDCGKAFVRSSDLRKHQRNMHSNNKPFPCSECGLTFNKPLSLLRHQRTHLGAKPFRCPACDREFAVASRMVEHQRVHSGERPFPCPTCGKCFTKSSNLSEHQTLHTGQRPFKCADCGVAFAQPSRLVRHQRIHTGERPFPCTQCGQAFARSSTLKRHQQIHSGEKGFLCAECGRAFRIASELAQHIRMHNGERPYQCEDCGQAFTRSNHLQRHRAKHGTCKKEPIPSSSDE

SEQ ID NO: 7167 - protein, 606 aa, Homo sapiens
MSHTASSCQELVENCAVHVAGMAQEDSRRGQVPSSFYHGANQELDLSTKVYKRESGSPYSVLVDTKMSKPHLHETEEQPYFRETRAVSDVHAVKEDRENSDDTEEEEEEVSYKREQIIVEVNLNNQTLNVSKGEKGVSSQSKETPVLKTSSEEEEEESEEEATDDSNDYGENEKQKKKEKIVEKVSVTQRRTRRAASVAAATTSPTPRTTRGRRKSVEPPKRKKRATKEPKAPVQKAKCEEKETLTCEKCPRVFNTRWYLEKHMNVTHRRMQICDKCGKKFVLESELSLHQQTDCEKNIQCVSCNKSFKKLWSLHEHIKIVHGYAEKKFSCEICEKKFYTMAHVRKHMVAHTKDMPFTCETCGKSFKRSMSLKVHSLQHSGEKPFRCENCDERFQYKYQLRSHMSIHIGHKQFMCQWCGKDFNMKQYFDEHMKTHTGEKPFICEICGKSFTSRPNMKRHRRTHTGEKPYPCDVCGQRFRFSNMLKAHKEKCFRVTSPVNVPPAVQIPLTTSPATPVPSVVNTATTPTPPINMNPVSTLPPRPIPHPFSHLHIHPHPHHPHHLPIPPVPHLPPPPALFKSEPLNHRGQSEDNFLRHLAEKNSSAQHH

SEQ ID NO: 7168 - protein, 606 aa, Homo sapiens; identical to SEQ ID NO: 7167

SEQ ID NO: 7169 - protein, 426 aa, Homo sapiens
MSHTASSCQELVENCAVHVAGMAQEDSRRGQVPSSFYHGANQELDLSTKVYKRESGSPYSVLVDTKMSKPHLHETEEQPYFRETRAVSDVHAVKEDRENSDDTEEEEEEVSYKREQIIVECVSCNKSFKKLWSLHEHIKIVHGYAEKKFSCEICEKKFYTMAHVRKHMVAHTKDMPFTCETCGKSFKRSMSLKVHSLQHSGEKPFRCENCDERFQYKYQLRSHMSIHIGHKQFMCQWCGKDFNMKQYFDEHMKTHTGEKPFICEICGKSFTSRPNMKRHRRTHTGEKPYPCDVCGQRFRFSNMLKAHKEKCFRVTSPVNVPPAVQIPLTTSPATPVPSVVNTATTPTPPINMNPVSTLPPRPIPHPFSHLHIHPHPHHPHHLPIPPVPHLPPPPALFKSEPLNHRGQSEDNFLRHLAEKNSSAQHH

SEQ ID NO: 7170 - protein, 615 aa, Homo sapiens
MAERALEPEAEAEAEAGAGGEAAAEEGAAGRKARGRPRLTESDRARRRLESRKKYDVRRVYLGEAHGPWVDLRRRSGWSDAKLAAYLISLERGQRSGRHGKPWEQVPKKPKRKKRRRRNVNCLKNVVIWYEDHKHRCPYEPHLAELDPTFGLYTTAVWQCEAGHRYFQDLHSPLKPLSDSDPDSDKVGNGLVAGSSDSSSSGSASDSEESPEGQPVKAAAAAAAATPTSPVGSSGLITQEGVHIPFDVHHVESLAEQGTPLCSNPAGNGPEALETVVCVPVPVQVGAGPSALFENVPQEALGEVVASCPMPGMVPGSQVIIIAGPGYDALTAEGIHLNMAAGSGVPGSGLGEEVPCAMMEGVAAYTQTEPEGSQPSTMDATAVAGIETKKEKEDLCLLKKEEKEEPVAPELATTVPESAEPEAEADGEELDGSDMSAIIYEIPKEPEKRRRSKRSRVMDADGLLEMFHCPYEGCSQVYVALSSFQNHVNLVHRKGKTKVCPHPGCGKKFYLSNHLRRHMIIHSGVREFTCETCGKSFKRKNHLEVHRRTHTGETPLQCEICGYQCRQRASLNWHMKKHTAEVQYNFTCDRCGKRFEKLDSVKFHTLKSHPDHKPT

SEQ ID NO: 7171 - protein, 581 aa, Homo sapiens
MLCNKEFLGGHIVRHAQAHQKKGSFACVICGRKFRNRGLMQKHLKNHVKKIQRQQIAAAQQDDQEVTALEEINCSSSSISFENGNSDSKDLEVETLTASSEGNKEVIPEHVAEFIEIPISVPEDVIENVIENGSPNNSLNNVFKPLTECGDDYEEEEDEEGDYEEDDYDLNQETSVIHKINGTVCHPKDIYATDQEGNFKCPALGCVRIFKRIGFLNKHAMTVHPTDLNVRQTVMKWSKGKCKFCQRQFEDSQHFIDHLNRHSYPNVYFCLHFNCNESFKLPFQLAQHTKSHRIFQAQCSFPECHELFEDLPLLYEHEAQHYLSKTPESSAQPSETILWDVQTDSNPNQEKDSSSNEKQTISLPVSTSKSRKESTEPKTCIESMEKKTDSLVQNGNERSDDTVSNISLIDQKMPDIEPNSENNCSSSDIVNGHSEIEQTPLVSSDPALKIDTNRIRTENGSILPSVVPQEHNTLPVSQAPSKPNLTSEHTSYGLILTKPYVRPLPPSYLDERYLSMPKRRKFLTDRVDACSDQDNVYKKSVKRLRCGKCLTTYCNAEALEAHLAQKKCQTLFGFDSDDESA

SEQ ID NO: 7172 - protein, 1059 aa, Homo sapiens
MNMSQASVSFQDVTVEFTREEWQHLGPVERTLYRDVMLENYSHLISVGYCITKPKVISKLEKGEEPWSLEDEFLNQRYPGYFKVDHIKGIREKQEKPLWQEIFISDADKTLSKEGQKVLEKPFNLEIAPELSEKISCKCDSHRMNLPVASQLIISERKYSRKKTEYMNVCEKLQLDIKHEKAHAEEKSYEHGENAKAFSYKKDQHWKFQTLEESFECDGSGQGLYDKTICITPQSFLTGEKSCKDDEFRKNFDKITLFNHMRTDTRGKCSDLNEYGTSCDKTTAVEYNKVHMAMTHYECNERGINFSRKSPLTQSQRTITGWSAFESNKCEENFSQSSAHIVHQKTQAGDKFGEHNECTDALYQKLDFTAHQRIHTEDKFYLSDEHGKCRKSFYRKAHLIQHQRPHSGEKTYQYEECAKSFCSSSHPIQHPGTYVGFKLYECNECGKAFCQNSNLSKHLRIHTKEKPCDNNGCGRSYKSPLIGHQKTDAEMELCGGSEYGKTSHLKGHQRILMGEKPYECIECGKTFSKTSHLRAHQRIHTGEKPYECVECEKTFSHKTHLSVHQRVHTGEKPYECNDCGKSFTYNSALRAHQRIHTGEKPYECSDCEKTFAHNSALRAHHRIHTGEKPYECNECGRSFAHISVLKAHQRIHTGEKPYECNECGRSFTYNSALRAHQRIHTGRKPYECSDCEKTFAHNSALKIHQRIHTGEKPYECNECEKTFAHNSALRAHQNIHTGEKLYECSECGKTFFQKTRLSTHRRIHTGEKPYECSKCGKTFSQKSYLSGHERIHTGEKPYECNVCGKTFVYKAALIVHQRIHTGEKPYECNQCGKTFSQRTHLCAHQRIHTGEKPYECNECGKTFADNSALRAHHRIHTGEKPYECNDCGKTFSKTSHLRAHLRTRSGEKPYECSECGKTFSEKSYVSAHQRVHTGEKPYECNVCGKPFAHNSTLRVHQRIHTGEKSYECNDCGKTFSQKSHLSAHQRIHTGEKPYECNECGKAFAQNSTLRVHQRIHTGEKPYECDECGKTFVRKAALRVHHTRMHTREKTLACNGFGKS

SEQ ID NO: 7173 - protein, 615 aa, Homo sapiens
MSQASVSFQDVTVEFTREEWQHLGPVERTLYRDVMLENYSHLISVGYCITKPKVISKLEKGEEPWSLEDEFLNQRYPGYFKVDHIKGIREKQEKPLWQEIFISDADKTLSKEGQKVLEKPFNLEIAPELSEKISCKCDSHRMNLPVASQLIISERKYSRKKTEYMNVCEKLQLDIKHEKAHAEEKSYEHGENAKAFSYKKDQHWKFQTLEESFECDGSGQGLYDKTICITPQSFLTGEKSCKDDEFRKNFDKITLFNHMRTDTRGKCSDLNEYGTSCDKTTAVEYNKVHMAMTHYECNERGINFSRKSPLTQSQRTITGWSAFESNKCEENFSQSSAHIVHQKTQAGDKFGEHNECTDALYQKLDFTAHQRIHTEDKFYLSDEHGKCRKSFYRKAHLIQHQRPHSGEKTYQYEECAKSFCSSSHPIQHPGTYVGFKLYECNECGKAFCQNSNLSKHLRIHTKEKPCDNNGCGRSYKSPLIGHQKTDAEMELCGGSEYGKTSHLKGHQRILMGEKPYECIECGKTFSKTSHLRAHQRIHTGEKPYECVECEKTFSHKTHLSVHQRVHTGEKPYECNDCGKSFTYNSALRAHQRIHTGLAVCHVGILMATKSLFHQS

SEQ ID NO: 7174 - protein, 331 aa, Homo sapiens
MRRKTRNFKHKTVKDNKVLTEGSDQESEKDNSQCCDPATNERVQAEKRQYVCTECGKAFSQSANLTVHERIHTGEKPYKCKECGKAFSHSSNLVVHRRIHTGLKPYTCSECGKSFSGKSHLIRHQGIHSGEKTYECKECGKAFSRSSGLISHHRVHTGEKPYSCIECGKAFSRSSNLTQHQRMHRGKKVYKCKECGKTCGSNTKIMDHQRIHTGEKPYECDECGKTFILRKTLNEHQRLHRREKPYKCNECGKAFTSNRNLVDHQRVHTGEKPYKCNECGKTFRQTSQVILHLRTHTKEKPYKCSECGKAYRYSSQLIQHQRKHNEEKETS

SEQ ID NO: 7175 - protein, 39 aa, Homo sapiens
MRRKTRNFKHKTVKDNKVLTEGSDQESEKDNSQCCDPAT

SEQ ID NO: 7176 - protein, 34 aa, Homo sapiens
MRRKTRNFKHKTVKDNKVLTEGSDQESEKDNSQC

SEQ ID NO: 7177 - protein, 452 aa, Homo sapiens
MAAVALASGTRLGLVLELLPGQPALPRARRESVTFEDVAVYFSENEWIGLGPAQRALYRDVMLENYGAVASLAFPFPKPALISQLERGETPWCSVPRGALDGEAPRGISSEGVLKRKKEDFILKEEIIEEAQDLMVLSSGPQWCGSQELWFGKTCEEKSRLGRWPGYLNGGRMESSTNDIIEVIVKDEMISVEESSGNTDVNNLLGIHHKILNEQIFYICEECGKCFDQNEDFDQHQKTHNGEKVYGCKECGKAFSFRSHCIAHQRIHSGVKPYECQECAKAFVWKSNLIRHQRIHTGEKPFECKECGKGFSQNTSLTQHQRIHTGEKPYTCKECGKSFTRNPALLRHQRMHTGEKPYECKDCGKGFMWNSDLSQHQRVHTGDKPHECTDCGKSFFCKAHLIRHQRIHTGERPYKCNDCGKAFSQNSVLIKHQRRHARDKPYNCQISHLLEH

SEQ ID NO: 7178 - protein, 426 aa, Homo sapiens
MLENYGAVASLAAFPFPKPALISQLERGETPWCSVPRGALDGEAPRGISSGYPFLKPAGISHPEQVEEPLNLKLQGEGPSLICPEGVLKRKKEDFILKEEIIEEAQDLMVLSSGPQWCGSQELWFGKTCEEKSRLGRWPGYLNGGRMESSTNDIIEVIVKDEMISVEESSGNTDVNNLLGIHHKILNEQIFYICEECGKCFDQNEDFDQHQKTHNGEKVYGCKECGKAFSFRSHCIAHQRIHSGVKPYECQECAKAFVWKSNLIRHQRIHTGEKPFECKECGKGFSQNTSLTQHQRIHTGEKPYTCKECGKSFTRNPALLRHQRMHTGEKPYECKDCGKGFMWNSDLSQHQRVHTGDKPHECTDCGKSFFCKAHLIRHQRIHTGERPYKCNDCGKAFSQNSVLIKHQRRHARDKPYNCQISHLLEH

SEQ ID NO: 7179 - protein, 426 aa, Homo sapiens; identical to SEQ ID NO: 7178

SEQ ID NO: 7180 - protein, 261 aa, Homo sapiens
MIYKCPMCREFFSERADLFMHQKIHTAEKPHKCDKCDKGFFHISELHIHWRDHTGEKVYKCDDCGKDFSTTTKLNRHKKIHTVEKPYKCYECGKAFNWSSHLQIHMRVHTGEKPYVCSECGRGFSNSSNLCMHQRVHTGEKPFKCEECGKAFRHTSSLCMHQRVHTGEKPYKCYECGKAFSQSSSLCIHQRVHTGEKPYRCCGCGKAFSQSSSLCIHQRVHTGEKPFKCDECGKAFSQSTSLCIHQRVHTKERNHLKISVI

SEQ ID NO: 7181 - protein, 261 aa, Homo sapiens; identical to SEQ ID NO: 7180

SEQ ID NO: 7182 - protein, 199 aa, Homo sapiens
MIVVRILALQQNLIDIRKSTQWRSPINVTSGKAFNWSSHLQIHMRVHTGEKPYVCSECGRGFSNSSNLCMHQRVHTGEKPFKCEECGKAFRHTSSLCMHQRVHTGEKPYKCYECGKAFSQSSSLCIHQRVHTGEKPYRCCGCGKAFSQSSSLCIHQRVHTGEKPFKCDECGKAFSQSTSLCIHQRVHTKERNHLKISVI

SEQ ID NO: 7183 - protein, 261 aa, Homo sapiens; identical to SEQ ID NO: 7180

SEQ ID NO: 7184 - protein, 261 aa, Homo sapiens; identical to SEQ ID NO: 7180

SEQ ID NO: 7185 - protein, 678 aa, Homo sapiens
MALPQGQLTFKDVAIEFSQEEWTCLDPAQKTLYRDVMLENYRNLVSLDISCKCVNTDLPPKGKNNMGEAFYTVKLERLESCDTVGLSFQEVQKNTYDFECQWKDDEGNYKTVLMLQKENLPGRRAQRDRRAAGNRHIENQLGVSFQSHLPELQQFQHEGKIYEYNQVEKSPNNRGKHYKCDECGKVFSQNSRLTSHKRIHTGEKPYQCNKCGKAFTVRSNLTIHQVIHTGEKPYKCNECGKVFSQPSNLAGHQRIHTGEKPYKCNECGKAFRAHSKLTTHQVIHTGEKPYKCKECGKCFTQNSHLASHRRIHTGEKPYKCNECGKAFSVRSSLTTHQTIHTGEKPYKCNECGKVFRHNSYLAKHRRIHTGEKPYKCNECGKAFSMHSNLTKHQIIHTGEKPFKCNECVKVFTQYSHLANHRRIHTGEKPYRCDECGKAFSVRSSLTTHQAIHTGEKPYKCNDCGKVFTQNSHLASHRGIHSGEKPYKCDECGKAFSQTSQLARHWRVHTGEKPYKCNECGKAFSVHSSLTIHQTIHTGQKPYKCNDCGKVFRHNSYLAIHQRIHTGEKPYKCNECGKAFSVHSNLATHQVIHTGEKPYKCNECGKVFTQNSHLANHRRIHTGEKPYRCNECGKAFSVRSTLTTHMAVHTGDKPYKCNQCGKVFTQNSNLAKHRRIHSG

SEQ ID NO: 7186 - protein, 619 aa, Homo sapiens [sequence omitted]

SEQ ID NO: 7187 - protein, 619 aa, Homo sapiens [sequence omitted]

SEQ ID NO: 7188 - protein, 108 aa, Homo sapiens
MEVEAAEARSPAPGYKRSGRRYKCVSCTKTFPNAPRAARHAATHGPADCSEEVAEVPHRRAPLPLLRVREELLPLILAHVPPAHPRGTEALPLPGLRQGLHAAQFLPE

SEQ ID NO: 7189 - protein, 92 aa, Homo sapiens
MEVEAAEARSPAPGYKRSGRRYKCVSCTKTFPNAPRAARHAATHGPADCSEEVAEVKPKPETEAKAEEASGEKVSGSAAKPRPYACPLCPKA

SEQ ID NO: 7190 - protein, 76 aa, Homo sapiens
MEVEAAEARSPAPGYKRSGRRYKCVSCTKTFPNAPRAARHAATHGPADCSEEVAEVKPKPETEAKAEEASGEKVSG

SEQ ID NO: 7191 - protein, 103 aa, Homo sapiens
MEVEAAEARSPAPGYKRSGRRYKCVSCTKTFPNAPRAARHAATHGPADCSEEVAEVKPKPETEAKAEEASGEKVSGSAAKPRPYACPLCPKAYKTAPELRSHG

SEQ ID NO: 7192 - protein, 619 aa, Homo sapiens [sequence omitted]

SEQ ID NO: 7193 - protein, 619 aa, Homo sapiens [sequence omitted]

SEQ ID NO: 7194 - protein, 642 aa, Homo sapiens
MSEPGMLGRKDVWVPRETPFTKAMEVEAAEARSPAPGYKRSGRRYKCVSCTKTFPNAPRAARHAATHGPADCSEEVAEVKPKPETEAKAEEASGEKVSGSAAKPRPYACPLCPKAYKTAPELRSHGRSHTGEKPFPCPECGRRFMQPVCLRVHLASHAGELPFRCAHCPKAYGALSKLKIHQRGHTGERPYACADCGKSFADPSVFRKHRRTHAGLRPYSCERCGKAYAELKDLRNHERSHTGERPFLCSECGKSFSRSSSLTCHQRIHAAQKPYRCPACGKGFTQLSSYQSHERTHSGEKPFLCPRCGRMFSDPSSFRRHQRAHEGVKPYHCEKCGKDFRQPADLAMHRRVHTGDRPFKCLQCDKTFVASWDLKRHALVHSGQRPFRCEECGRAFAERASLTKHSRVHSGERPFHCNACGKSFVVSSSLRKHERTHRSSEAAGVPPAQELVVGLALPVGVAGESSAAPAAGAGLGDPPAGLLGLPPESGGVMATQWQVVGMTVEHVECQDAGVREAPGPLEGAGEAGGEEADEKPPQFVCRECKETFSTMTLLRRHERSHPELRPFPCTQCGKSFSDRAGLRKHSRTHSSVRPYTCPHCPKAFLSASDLRKHERTHPVPMGTPTPLEPLVALLGMPEEGPA

SEQ ID NO: 7195 - protein, 464 aa, Homo sapiens
MVSGLRLASRSGEEGWLKPAVARLGPPRHRLRNLRTESPWRSRGSVLFCSGPGRAGRAAEPLHPVCTCGRHFRRPEPCREPLASPIQDSVAFEDVAVNFTQEEWALLDSSQKNLYREVMQETCRNLASVGSQWKDQNIEDHFEKPGKDIRNHIVQRLCESKEDGQYGEVVSQIPNLDLNENISTGLKPCECSICGKVFVRHSLLNRHILAHSGYKPYGEKQYKCEQCGKFFVSVPGVRRHMIMHSGNPAYKCTICGKAFYFLNSVERHQRTHTGEKPYKCKQCGKAFTVSGSCLIHERTHTGEKPYECKECGKTFRFSCSFKTHERTHTGERPYKCTKCDKAFSCSTSLRYHGSIHTGERPYECKQCGKAFSRLSSLCNHRSTHTGEKPYECKQCDQAFSRLSSLHLHERIHTGEKPYECKKCGKAYTRSSHLTRHERSHDIEAGCSDSAYNPSTLGGQGVWIA

SEQ ID NO: 7196 - protein, 157 aa, Homo sapiens
MVSGLRLASRSGEEGWLKPAVARLGPPRHRLRNLRTESPWRSRGSVLFCSGPGRAGRAAEPLHPVCTCGRHFRRPEPCREPLASPIQDSVAFEDVAVNFTQEEWALLDSSQKNLYREVMQETCRNLASVEIISYRDCVKVKKMVSMEKLSAKFQILI

SEQ ID NO: 7197 - protein, 71 aa, Homo sapiens
MDSVAFEDVAVNFTQEEWALLDSSQKNLYREVMQETCRNLASVEIISYRDCVKVKKMVSMEKLSAKFQILI

SEQ ID NO: 7198 - protein, 61 aa, Homo sapiens
MDSVAFEDVAVNFTQEEWALLDSSQKNLYREVMQETCRNLASEANGKTRILKITSKNLGKI

SEQ ID NO: 7199 - protein, 378 aa, Homo sapiens
MDSVAFEDVAVNFTQEEWALLDSSQKNLYREVMQETCRNLASVGSQWKDQNIEDHFEKPGKDIRNHIVQRLCESKEDGQYGEVVSQIPNLDLNENISTGLKPCECSICGKVFVRHSLLNRHILAHSGYKPYGEKQYKCEQCGKFFVSVPGVRRHMIMHSGNPAYKCTICGKAFYFLNSVERHQRTHTGEKPYKCKQCGKAFTVSGSCLIHERTHTGEKPYECKECGKTFRFSCSFKTHERTHTGERPYKCTKCDKAFSCSTSLRYHGSIHTGERPYECKQCGKAFSRLSSLCNHRSTHTGEKPYECKQCDQAFSRLSSLHLHERIHTGEKPYECKKCGKAYTRSSHLTRHERSHDIEAGCSDSAYNPSTLGGQGVWIA

SEQ ID NO: 7200 - protein, 378 aa, Homo sapiens; identical to SEQ ID NO: 7199

SEQ ID NO: 7201 - protein, 389 aa, Homo sapiens
MDSVSFEDVAVAFTQEEWALLDPSQKNLYRDVMQEIFRNLASVGNKSEDQNIQDDFKNPGRNLSSHVVERLFEIKEGSQYGETFSQDSNLNLNKKVSTGVKPCECSVCGKVFICHSALHRHILSHIGNKLFECEECPEKLYHCKQCGKAFISLTSVDRHMVTHTSNGPYKGPVYEKPFDFPSVFQMPQSTYTGEKTYKCKHCDKAFNYSSYLREHERTHTGEKPYACKKCGKSFTFSSSLRQHERSHTGEKPYECKECGKAFSRSTYLGIHERTHTGEKPYECIKCGKAFRCSRVLRVHERTHSGEKPYECKQCGKAFKYSSNLCEHERTHTGVKPYGCKECGKSFTSSSALRSHERTHTGEKPYECKKCGKAFSCSSSLRKHERAYMW

SEQ ID NO: 7202 - protein, 118 aa, Homo sapiens
MGLLAFRDVALEFSPEEWECLDPAQRSLYRDVMLENYRNLISLGLAMSKPELIICLEARKEPWNVNTEKTARHSVETRFRHVGQAGLKLLTSGDPPALASQSAGITGTGHHCQPICVF

SEQ ID NO: 7203 - protein, 534 aa, Homo sapiens
MLSPVSRDASDALQGRKCLRPRSRRLPLPAAVRAHGPMAELTDSARGCVVFEDVFVYFSREEWELLDDAQRLLYHDVMLENFALLASLGIAFSRSRAVMKLERGEEPWVYDQVDMTSATEREAQRGLRPGCWHGVEDEEVSSEQSIFVAGVSEVRTLMAELESHPCDICGPILKDTLHLAKYHGGKARQKPYLCGACGKQFWFSTDFDQHQNQPNGGKLFPRKEGRDSVKSCRVHVPEKTLTCGKGRRDFSATSGLLQHQASLSSMKPHKSTKLVSGFLMGQRYHRCGECGKAFTRKDTLARHQRIHTGERPYECNECGKFFSQSYDLFKHQTVHTGERPYECSECGKFFRQISGLIEHRRVHTGERLYQCGKCGKFFSSKSNLIRHQEVHTGARPYVCSECGKEFSRKHTLVLHQRTHTGERPYECSECGKAFSQSSHLNVHWRIHSSDYECSRCGKAFSCISKLIQHQKVHSGEKPYECSKCGKAFTQRPNLIRHWKVHTGERPYVCSECGREFIRKQTLVLHQRVHAGEKL

SEQ ID NO: 7204 - protein, 436 aa, Homo sapiens
MKLERGEEPWVYDQVDMTSATEREAQRGLRPGCWHGVEDEEVSSEQSIFVAGVSEVRTLMAELESHPCDICGPILKDTLHLAKYHGGKARQKPYLCGACGKQFWFSTDFDQHQNQPNGGKLFPRKEGRDSVKSCRVHVPEKTLTCGKGRRDFSATSGLLQHQASLSSMKPHKSTKLVSGFLMGQRYHRCGECGKAFTRKDTLARHQRIHTGERPYECNECGKFFSQSYDLFKHQTVHTGERPYECSECGKFFRQISGLIEHRRVHTGERLYQCGKCGKFFSSKSNLIRHQEVHTGARPYVCSECGKEFSRKHTLVLHQRTHTGERPYECSECGKAFSQSSHLNVHWRIHSSDYECSRCGKAFSCISKLIQHQKVHSGEKPYECSKCGKAFTQRPNLIRHWKVHTGERPYVCSECGREFIRKQTLVLHQRVHAGEKL

SEQ ID NO: 7205 - protein, 452 aa, Homo sapiens
MFATSGAVAAGKPYSCSECGKSFCYSSVLLRHERAHGGDGRFRCLECGERCARAADLRAHRRTHAGQTLYICSECGQSFRHSGRLDLHLGAHRQRCRTCPCRTCGRRFPHLPALLLHRRRQHLPERPRRCPLCARTFRQSALLFHQARAHPLGTTSDPAAPPHRCAQCPRAFRSGAGLRSHARIHVSRSPTRPRVSDAHQCGVCGKCFGKSSTLTRHLQTHSGEKPFKCPECGKGFLESATLVRHQRTHTGEKPYACGDCGRCFSESSTLLRHRRSHQGERPHACATCGKGFGQRSDLVVHQRIHTGEKPFACPECGRRFSDRSDLTKHRRTHTGEKPYRCELCGKRFTCVSNLNVHRRNHAGHKPHKCPECSKAFSVASKLALHRKTHLGERPAECAECGKCFSHSRSLSQHQRAHTRARTAAAVAIQSAVGTALVFEGPAEQEKPGFSVS

SEQ ID NO: 7206 - protein, 223 aa, Homo sapiens
MFATSGAVAAGKPYSCSECGKSFCYSSVLLRHERAHGGDGRFRCLECGERCARAADLRAHRRTHAGQTLYICSECGQSFRHSGRLDLHLGAHRQRCRTCPCRTCGRRFPHLPALLLHRRRQHLPERPLLPCCPRITRILSSGVGAGSQGTLRLPCVQEPRCWCVPLMLLCSLVFLIFLPLFCLLLSYLIPAHIFSFPDYFCCPASSGNGHRFGCRHVTSPVAS

SEQ ID NO: 7207 - protein, 37 aa, Homo sapiens
MFATSGAVAAGKPYSCSECGKSFCYSSVLLRHERAHG

SEQ ID NO: 7208 - protein, 69 aa, Homo sapiens
MFATSGAVAAGKPYSCSECGKSFCYSSVLLRHERAHGGDGRFRCLECGERCARAADLRAHRRTHAGQTL

SEQ ID NO: 7209 - protein, 4 aa, Homo sapiens
MFAT

SEQ ID NO: 7210 - protein, 588 aa, Homo sapiens
MLENYRNLVFLGIAAFKPDLIIFLEQGKEPWNMKRHEMVEEPPVICSHFSQEFWPEQGIEDSFQKMILRRYDKCGHENLHLKISCTNVDECNVHKEGYNKLNQSLTTTQSKVFQCGKYANVFHKCSNSNRHKIRHTGEKGLKCKEYVRSFCMLSHLSQHERIYTRENSYKCEENGKAFNWSSTLTYYKSIHTGEKPYKCEECGKAFSKFSILTKHKVIHTGEKPYKCEECGKAFNRSSILTKHKIIHTGEKPYKCEECGKGFSSVSTLNTHKAIHAEEKPYKCEECGKASNSSSKLMEHKRIHTGEKPYKCEECGKAFSWSSSLTEHKRIHAGEKPYKCEECGKAFNRSSILTKHKIIHTGEKPYKCEGCGKAFSKVSTLNTHKAIHAEEKPYKCEECGKASNSSSKLMEHKRIHTGEKPYKCEECGKAFSWSSSLTEHKRIHAGEKPYKCEECGKAFTWSSSFTKHKRIHAAEKPYKCEECGKGFSTFSILTKHKIIHTGEKRYKCEECGKAFSWSSILTEHKIIHTGEKPYKCEECGKAFSRSSSLTRHKRIHTGEKPYKCEECGKAFKSSSTVSYHKKIHTGENP

SEQ ID NO: 7211 - protein, 584 aa, Homo sapiens
MALSQGLFTFKDVAIEFSQEEWECLDPAQRALYRDVMLENYRNLLSLDEDNIPPEDDISVGFTSKGLSPKENNKEELYHLVILERKESHGINNFDLKEVWENMPKFDSLWDYDVKNYKGMPLTCNKNLTHRKDQQHNKSSIHFSLKQSVSIRDSAHQYFIHDKPFIRNLLKLKNNIRYAGNKYVKCFENKIGLSLQAQLAELQRFQTGEKMYECNPVEKSINSSSVSPLPPCVKNICNKYRKILKYPLLHTQYGRTHIREKSYKCNDCGKAFSKSSNLTNHQRIHSGQRPYKCNECGKAFNQCSNLTRHQRVHTGEKPYQCNICGKVCSQNSNLASHQRMHTGEKPYKCNECGKAFIQRSHLWGHERIHTGEKPYKCNECDKAFAERSSLTQHKRIHTGEKPYICNECGKAFKQCSHLTRHQNIHPGEKPHKCNVCGRAFIQSSSLVEHQRIHTGEKPYKCNKCDKAFIKRSHLWGHQRTHTGEKPYKCTECGKAFTERSNLTQHKKIHTGEKPYKCTECGKAFTQFANLTRHQKIHIEKKHCKHNIHGNALFQSSNLGDHQKSYNREKHIKYNETKIKYSSCT

SEQ ID NO: 7212 - protein, 179 aa, Homo sapiens
MALSQGLFTFKDVAIEFSQEEWECLDPAQRALYRDVMLENYRNLLSLDEDNIPPEDDISVGFTSKGLSPKENNKEELYHLVILERKESHGINNFDLKEVWENMPKFDSLWDYDVKNYKGMPLTCNKNLTHRKDQQHNKSSIHFSLKKKKKKKKKQNKTKPKATKEKRRKNKGKNKTNTK

SEQ ID NO: 7213 - protein, 525 aa, Homo sapiens
MGTISLCIGVCAFEGANTSTSFYKLVYTAILSYSIQDLLPEQDMKDLCQKVTLTRHRSWGLDNLHLVKDWRTVNEGKGQKEYCNRLTQCSSTKSKIFQCIECGRNFSWRSILTEHKRIHTGEKPYKCEECGKVFNRCSNLTKHKRIHTGEKPYKCDECGKVFNWWSQLTNHKKIHTGEKPYKCDECDKVFNWWSQLTSHKKIHSGEKPYPCEECGKAFTQFSNLTQHKRIHTGEKPYKCKECCKAFNKFSNLTQHKRIHTGEKPYKCEECGNVFNECSHLTRHRRIHTGEKPYKCEECGKAFTQFASLTRHKRIHTGEKPYQCEECGKTFNRCSHLSSHKRIHTGEKPYKCEECGRTFTQFSNLTQHKRIHTGEKPYKCKECGKAFNKFSSLTQHRRIHTGVKPYKCEECGKVFKQCSHLTSHKRIHTGEKPYKCKECGKAFYQSSILSKHKRIHTEEKPYKCEECGKAFNQFSSLTRHKRIHTGEKRYKCKECGKGFYQSSIHSKYKRIYTGEEPDKCKKCGSL

SEQ ID NO: 7214 - protein, 580 aa, Homo sapiens
MPGHPESRKTRRILTMLPRLVLNSFPQVILLPNPPKVLRLQGLLAFSDVVIEFSPEEWACLDPAQRNLYRDVMFENYRNLVSLAILSYSIQDLLPEQDMKDLCQKVTLTRHRSWGLDNLHLVKDWRTVNEGKGQKEYCNRLTQCSSTKSKIFQCIECGRNFSWRSILTEHKRIHTGEKPYKCEECGKVFNRCSNLTKHKRIHTGEKPYKCDECGKVFNWWSQLTNHKKIHTGEKPYKCDECDKVFNWWSQLTSHKKIHSGEKPYPCEECGKAFTQFSNLTQHKRIHTGEKPYKCKECCKAFNKFSNLTQHKRIHTGEKPYKCEECGNVFNECSHLTRHRRIHTGEKPYKCEECGKAFTQFASLTRHKRIHTGEKPYQCEECGKTFNRCSHLSSHKRIHTGEKPYKCEECGRTFTQFSNLTQHKRIHTGEKPYKCKECGKAFNKFSSLTQHRRIHTGVKPYKCEECGKVFKQCSHLTSHKRIHTGEKPYKCKECGKAFYQSSILSKHKRIHTEEKPYKCEECGKAFNQFSSLTRHKRIHTGEKRYKCKECGKGFYQSSIHSKYKRIYTGEEPDKCKKCGSL

SEQ ID NO: 7215 - protein, 227 aa, Homo sapiens
MPGHPESRKTRRILTMLPRLVLNSFPQVILLPNPPKVLRLQGLLAFSDVVIEFSPEEWACLDPAQRNLYRDVMFENYRNLVSLAILSYSIQDLLPEQDMKDLCQKVTLTRHRSWGLDNLHLVKDWRTVNEGKGQKEYCNRLTQCSSTKSKIFQCIECGRNFSWRSILTEHKRIHTGEKPYKCEECGKVFNRCSNLTKHKRIHTGEKPYKCDECGKVFNWWSQLTNHK

SEQ ID NO: 7216 - protein, 411 aa, Homo sapiens
MAKRPGSPGSREMGLLTFRDVVIEFSLEEWQCLDHAQQNLYRDVMLENYRNLVSLGIAVSKPDLITCLEQNKEPWNIKRNEMVTKHPVMCSHFTQDLPPELGIKDSLQKVIPRRYGKSGHDNLQVKTCKSMGECEVQKGGCNEVNQCLSTTQNKIFQTHKCVKVFGKFSNSNRHKTRHTGKKHFKCKKYGKSFCMVSQLHQHQIIHTRENSYQCEECGKPFNCSSTLSKHKRIHTGEKPYRCEECGKAFTWSSTLTKHRRIHTGEKPYTCEECGQAFSRSSTLANHKRIHTGEKPYTCEECGKAFSLSSSLTYHKRIHTGEKPYTCEECGKAFNCSSTLKKHKIIHTGEKPYKCKECGKAFAFSSTLNTHKRIHTGEEPYKCEECDKAFKWSSSLANHKSMHTGEKPYKCE

SEQ ID NO: 7217 - protein, 411 aa, Homo sapiens; identical to SEQ ID NO: 7216

SEQ ID NO: 7218 - protein, 530 aa, Homo sapiens
MPGPPGSLEMGPLTFRDVAIEFSLEEWQCLDTAQRNLYRKVMFENYRNLVFLGIAVSKPHLITCLEQGKEPWNRKRQEMVAKPPVIYSHFTEDLWPEHSIKDSFQKVILRGYGKCGHENLQLRISCKSVDESKVFKEGYNELNQCLRTTQSKIFQCDKYVKVFHKFSNSNSHKKRNTGKKVFKCKECGKSFCMLSHLTQHIRIHTRENSYKCEECGKVLNWFSELIKHKGIHMGEKPYKCEECGKAFNQSSTLIKHKKIHIEEKPFKCEECGKAFSLFSILSKHKIIHTGDKPYKCDECHKAFNWFATLTNHKRIHTGEKPFKCEECGKDFNQFSNLTKHKKIHTGEKPYKCEECGKAFNQFANLTRHKKIHTGEKSYKCEECGKAFIQSSNLTEHMRIHTGEKPYKCEECGKAFNGCSSLTRHKRIHTRENTYKCEECGKGFTLFSTLTNHKVIHTGEKSYKCDECGNVFNWPATLANHKRIHAREKPYKCEECGKAFNRSSHLTRHKKIHTGEKLYKPEKCDNNFDNT

SEQ ID NO: 7219 - protein, 123 aa, Homo sapiens
MPGPPGSLEMGPLTFRDVAIEFSLEEWQCLDTAQRNLYRKVMFENYRNLVFLGIAVSKPHLITCLEQGKEPWNRKRQEMVAKPPESYCVAQADLELLVSSYLTALASLKMWDYRNNPLCQATM

SEQ ID NO: 7220 - protein, 576 aa, Homo sapiens
MVAEPPVICSHFAQDFSPEQNIKDSFQKVTPRRYGKCEHENLQLSKSVDECKVQKGGYNGLNQCLPTTQSKIFQCDKYMKIFHKFSNLNGHKVRHTRKKPFKYKEFGKSFCIFSNLTQHKIICTRVNFYKCEDCGKAFNGSSIFTKHKRIHIGEKSYICEECGKACNQFTNLTTHKIIYTRDKLYKREECSKAFNLSSHITTHTIIHTGENPYKREECDKAFNQSLTLTTHKIIHTREKLNEYKECGKAFNQSSHLTRHKIIHTGEKPYKCEECGKAFNQSSHLTRHKIIHTGEKPYRCEECGKAFRQSSHLTTHKIIHTGEKPYKCEECGKAFNKSSHLTRHKSIHTGEKPYQCEKCGKASNQSSNLTEHKNIHTEEKPYKCEECGKAFNQFSNLTTHKRIHTGEKPYKCEECGKAFNQSSILTTHKRIHTGEKSYKCEECGKAFYRSSKLTEHKKIHTGEKPYTCEECGKAFNHSSHLATHKVIHTGEKPYQCEECGKAFNQSSHLTRHKRIHTGEKPYQCEKCGKAFNQSSNLTGHKKIHTGEKLYKPKRCNSDFENTSKFSKHKRNYAGEKS

SEQ ID NO: 7221 - protein, 645 aa, Homo sapiens
MEPLKFRDVAIEFSLEEWQCLDTIQQNLYRNVMLENYRNLVFLGIVVSKPDLITCLEQEKEPWTRKRHRMVAEPPVICSHFAQDFSPEQNIKDSFQKVTPRRYGKCEHENLQLSKSVDECKVQKGGYNGLNQCLPTTQSKIFQCDKYMKIFHKFSNLNGHKVRHTRKKPFKYKEFGKSFCIFSNLTQHKIICTRVNFYKCEDCGKAFNGSSIFTKHKRIHIGEKSYICEECGKACNQFTNLTTHKIIYTRDKLYKREECSKAFNLSSHITTHTIIHTGENPYKREECDKAFNQSLTLTTHKIIHTREKLNEYKECGKAFNQSSHLTRHKIIHTGEKPYKCEECGKAFNQSSHLTRHKIIHTGEKPYRCEECGKAFRQSSHLTTHKIIHTGEKPYKCEECGKAFNKSSHLTRHKSIHTGEKPYQCEKCGKASNQSSNLTEHKNIHTEEKPYKCEECGKAFNQFSNLTTHKRIHTGEKPYKCEECGKAFNQSSILTTHKRIHTGEKSYKCEECGKAFYRSSKLTEHKKIHTGEKPYTCEECGKAFNHSSHLATHKVIHTGEKPYQCEECGKAFNQSSHLTRHKRIHTGEKPYQCEKCGKAFNQSSNLTGHKKIHTGEKLYKPKRCNSDFENTSKFSKHKRNYAGEKS

SEQ ID NO: 7222 - protein, 167 aa, Homo sapiens
MRTHTGEKPYKCEECGKAFNSSSILTEHKVIHSGEKPYKCEKCDKVFKRFSYLTKHKRIHTGEKPYKCEECGKAFNWSSILTEHKRIHTGEKPYNCEECGKAFNRCSHLTRHKKIHTAVKRYKCEECGKAFKRCSHLNEHKRVQRGEKSCKYKKCGEAFNHCSNLTT

SEQ ID NO: 7223 - protein, 466 aa, Homo sapiens
MLENYRNLVSLGLTVSKPELISRLEQRQEPWNVKRHETIAKPPAMSSHYTEDLLPEQCMQDSFQKVILRRYGSCGLEDLHLRKDGENVGECKDQKEIYNGLNQCLSTLPSKIFPYNKCVKVFSKSSNLNRENIRHTTEKLFKCMQCGKVFKSHSGLSYHKIIHTEEKLCICEECGKTFKWFSYLTKHKRIHTGEKPYKCEECGKAFNWCSSLTKHKRIHTGEKPYKCEECGKAFHWCSPFVRHKKIHTGEKPYTCEDCGRAFNRHSHLTKHKTIHTGKKPYKCKECGKAFNHCSLLTIHERTHTGEKPYKCEECGKAFNSSSILTEHKVIHSGEKPYKCEKCDKVFKRFSYLTKHKRIHTGEKPYKCEECGKAFNWSSILTEHKRIHTGEKPYNCEECGKAFNRCSHLTRHKKIHTAVKRYKCEECGKAFKRCSHLNEHKRVQRGEKSCKYKKCGEAFNHCSNLTT

SEQ ID NO: 7224 - protein, 466 aa, Homo sapiens; identical to SEQ ID NO: 7223

SEQ ID NO: 7225 - protein, 498 aa, Homo sapiens
MELLTFRDVTIEFSLEEWEFLNPAQQSLYRKVMLENYRNLVSLGLTVSKPELISRLEQRQEPWNVKRHETIAKPPAMSSHYTEDLLPEQCMQDSFQKVILRRYGSCGLEDLHLRKDGENVGECKDQKEIYNGLNQCLSTLPSKIFPYNKCVKVFSKSSNLNRENIRHTTEKLFKCMQCGKVFKSHSGLSYHKIIHTEEKLCICEECGKTFKWFSYLTKHKRIHTGEKPYKCEECGKAFNWCSSLTKHKRIHTGEKPYKCEECGKAFHWCSPFVRHKKIHTGEKPYTCEDCGRAFNRHSHLTKHKTIHTGKKPYKCKECGKAFNHCSLLTIHERTHTGEKPYKCEECGKAFNSSSILTEHKVIHSGEKPYKCEKCDKVFKRFSYLTKHKRIHTGEKPYKCEECGKAFNWSSILTEHKRIHTGEKPYNCEECGKAFNRCSHLTRHKKIHTAVKRYKCEECGKAFKRCSHLNEHKRVQRGEKSCKYKKCGEAFNHCSNLTT

SEQ ID NO: 7226 - protein, 504 aa, Homo sapiens
MKEESAAQLGCCHRPMALGGTGGSLSPSLDFQLFRGDQVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPPHLFTYGALPSDQCPHLLMLPQDPSYPTMAMPSLLMMVNELGHPSARWETLLPYPGAFQASGQALPSQARNPGAGAAPTDSPGLERGGMASPAKRVPLSSQTGTAALPYPLKKKNGKILYECNICGKSFGQLSNLKVHLRVHSGERPFQCALCQKSFTQLAHLQKHHLVHTGERPHKCSVCHKRFSSSSNLKTHLRLHSGARPFQCSVCRSRFTQHIHLKLHHRLHAPQPCGLVHTQLPLASLACLAQWHQGALDLMAVASEKHMGYDIDEVKVSSTSQGKARAVSLSSAGTPLVMGQDQNN

SEQ ID NO: 7227 - protein, 168 aa, Homo sapiens
MKEESAAQLGCCHRPMALGGTGGSLSPSLDFQLFRGDQSTSHQGCRPAPPMTRNSQSSTHRTRTSWENSQKELARGPPAQPSPLITALPHHRCRTERAPAPWLSAPVPLSTPSPRSSHFSSTPSTLDTHFSCLHPTCSPMGPYLLTNVPTSSCCPKTPPTPPWLCLAC

SEQ ID NO: 7228 - protein, 504 aa, Homo sapiens; identical to SEQ ID NO: 7226

SEQ ID NO: 7229 - protein, 524 aa, Homo sapiens
MKEESAAQLGCCHRPMALGGTGGSLSPSLDFQLFRGDQVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPPHLFTYGALPSDQCPHLLMLPQDPSYPTMAMPSLLMMVNELGHPSARWETLLPYPGAFQASGQALPSQARNPGAGAAPTDSPGLERGGMASPAKRVPLSSQTGTAALPYPLKKKNGKILYECNICGKSFGQLSNLKVHLRVHSGERPFQCALCQKSFTQLAHLQKHHLVHTGERPHKCSIPWVPGRNHWKSFQAWREREVCHKRFSSSSNLKTHLRLHSGARPFQCSVCRSRFTQHIHLKLHHRLHAPQPCGLVHTQLPLASLACLAQWHQGALDLMAVASEKHMGYDIDEVKVSSTSQGKARAVSLSSAGTPLVMGQDQNN

SEQ ID NO: 7230 - protein, 189 aa, Homo sapiens
MKEESAAQLGCCHRPMALGGTGGSLSPSLDFQLFRGDQVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLL

SEQ ID NO: 7231 - protein, 524 aa, Homo sapiens; identical to SEQ ID NO: 7229

SEQ ID NO: 7232 - protein, 269 aa, Homo sapiens
MKEESAAQLGCCHRPMALGGTGGSLSPSLDFQLFRGDQVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPPHLFTYGALPSDQCPHLLMLPQDPSYPTMAMPSLLMMVNELGHPSARWETLLPYPGAFQASGQALPS

SEQ ID NO: 7233 - protein, 92 aa, Homo sapiens
MISFQESVTFQDVAVDFTAEEWQLLDCAERTLYWDVMLENYRNLISVGCPITKTKVILKVEQGQEPWMVEGANPHESSPGWSAVAQSQLGFK

SEQ ID NO: 7234 - protein, 119 aa, Homo sapiens
MISFQESVTFQDVAVDFTAEEWQLLDCAERTLYWDVMLENYRNLISVGCPITKTKVILKVEQGQEPWMVEGANPHESSPESRSVARLECSGAISARVQVILLPQPPEELELQAPATMPG

SEQ ID NO: 7235 - protein, 378 aa, Homo sapiens
MISFQESVTFQDVAVDFTAEEWQLLDCAERTLYWDVMLENYRNLISVGCPITKTKVILKVEQGQEPWMVEGANPHESSPESDYPLVDEPGKHRESKDNFLKSVLLTFNKILTMERIHHYNMSTSLNPMRKKSYKSFEKCLPPNLDLLKYNRSYTVENAYECSECGKAFKKKFHFIRHEKNHTRKKPFECNDCGKAYSRKAHLATHQKIHNGERPFVCNDCGKAFMHKAQLVVHQRLHTGEKPYECSQCGKTFTWNSSFNQHVKSHTLEKSFECKECGKTFRYSSSLYKHSRFHTGEKPYQCIICGKAFGNTSVLVTHQRIHTGEKPYSCIECGKAFIKKSHLLRHQITHTGEKPYECNRCGKAFSQKSNLIVHQKIHT

SEQ ID NO: 7236 - protein, 276 aa, Homo sapiens
MAPPPAPLLAPRPGETRPGCRKPGTVSFADVAVYFSPEEWGCLRPAQRALYRDVMQETYGHLGALGFPGPKPALISWMEQESEAWSPAAQDPEKGERLGGARRGDVPNRKEEEPEEVPRAKGPRKAPVKESPEVLVERNPDPAISVAPARAQPPKNAAWDPTTGAQPPAPIPSMDAQAGQRRHVCTDCGRRFTYPSLLVSHRRMHSGERPFPCPECGMRFKRKFAVEAHQWIHRSCSGGRRGRRPGIRAVPRAPVRGDRDPPVLFRHYPDIFEECG

SEQ ID NO: 7237 - protein, 262 aa, Homo sapiens
MPRSPLRSSLSTEASGPRGPFKCPASPRPITAQLLPGSSPIIGRCVLRVQRGFPGPKPALISWMEQESEAWSPAAQDPEKGERLGGARRGDVPNRKEEEPEEVPRAKGPRKAPVKESPEVLVERNPDPAISVAPARAQPPKNAAWDPTTGAQPPAPIPSMDAQAGQRRHVCTDCGRRFTYPSLLVSHRRMHSGERPFPCPECGMRFKRKFAVEAHQWIHRSCSGGRRGRRPGIRAVPRAPVRGDRDPPVLFRHYPDIFEECG

SEQ ID NO: 7238 - protein, 500 aa, Homo sapiens
MAPPSAPLPAQGPGKARPSRKRGRRPRALKFVDVAVYFSPEEWGCLRPAQRALYRDVMRETYGHLGALGCAGPKPALISWLERNTDDWEPAALDPQEYPRGLTVQRKSRTRKKNGEKEVFPPKEAPRKGKRGRRPSKPRLIPRQTSGGPICPDCGCTFPDHQALESHKCAQNLKKPYPCPDCGRRFSYPSLLVSHRRAHSGECPYVCDQCGKRFSQRKNLSQHQVIHTGEKPYHCPDCGRCFRRSRSLANHRTTHTGEKPHQCPSCGRRFAYPSLLAIHQRTHTGEKPYTCLECNRRFRQRTALVIHQRIHTGEKPYPCPDCERRFSSSSRLVSHRRVHSGERPYACEHCEARFSQRSTLLQHQLLHTGEKPYPCPDCGRAFRRSGSLAIHRSTHTEEKLHACDDCGRRFAYPSLLASHRRVHSGERPYACDLCSKRFAQWSHLAQHQLLHTGEKPFPCLECGRCFRQRWSLAVHKCSPKAPNCSPRSAIGGSSQRGNAH

SEQ ID NO: 7239 - protein, 498 aa, Homo sapiens
MAPPSAPLPAQGPGKARPSRKRGRRPRALKFVDVAVYFSPEEWGCLRPAQRALYRDVMRETYGHLGALGCAGPKPALISWLERNTDDWEPAALDPQEYPRGLTVQRKSRTRKKNGEKEVFPPKEAPRKGKRGRRPSKPRLIPRQTSGGPICPDCGCTFPDHQALESHKCAQNLKKPYPCPDCGRRFSYPSLLVSHRRAHSGECPYVCDQCGKRFSQRKNLSQHQVIHTGEKPYHCPDCGRCFRRSRSLANHRTTHTGEKPHQCPSCGRRFAYPSLLAIHQRTHTGEKPYTCLECNRRFRQRTALVIHQRIHTGEKPYPCPDCERRFSSSSRLVSHRRVHSGERPYACEHCEARFSQRSTLLQHQLLHTGEKPYPCPDCGRAFRRSGSLAIHRSTHTEEKLHACDDCGRRFAYPSLLASHRRVHSGERPYACDLCSKRFAQWSHLAQHQLLHTGEKPFPCLEPVLPPEVVSAVHKCSPKAPNCSPRSAIGGSSQRGNAH

SEQ ID NO: 7240 - protein, 306 aa, Homo sapiens
MAQISSGGGGQSRCLLFALGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 7241 - protein, 312 aa, Homo sapiens
MSLCSPTHSAEMSLFLQGPEEMLPLSSEGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLKPFIPLWRMVLYSL

SEQ ID NO: 7242 - protein, 306 aa, Homo sapiens; identical to SEQ ID NO: 7240

SEQ ID NO: 7243 - protein, 284 aa, Homo sapiens
MGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 7244 - protein, 284 aa, Homo sapiens; identical to SEQ ID NO: 7243

SEQ ID NO: 7245 - protein, 284 aa, Homo sapiens; identical to SEQ ID NO: 7243

SEQ ID NO: 7246 - protein, 133 aa, Homo sapiens
MAQISSGGGGQSRCLLFALVLAICVHSQGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTH

SEQ ID NO: 7247 - protein, 315 aa, Homo sapiens
MSLCSPTHSAEMSLFLQGPEEMLPLSSEGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 7248 - protein, 519 aa, Homo sapiens
MASSPAVDVSCRRREKRRQLDARRSKCRIRLGGHMEQWCLLKERLGFSLHSQLAKFLLDRYTSSGCVLCAGPEPLPPKGLQYLVLLSHAHSRECSLVPGLRGPGGQDGGLVWECSAGHTFSWGPSLSPTPSEAPKPASLPHTTRRSWCSEATSGQELADLESEHDERTQEARLPRRVGPPPETFPPPGEEEGEEEEDNDEDEEEMLSDASLWTYSSSPDDSEPDAPRLLPSPVTCTPKEGETPPAPAALSSPLAVPALSASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 7249 - protein, 347 aa, Homo sapiens
MASSPAVDVSCRRREKRRQLDARRSKCRIRLGGHMEQWCLLKERLGFSLHSQLAKFLLDRYTSSGCVLCAGPEPLPPKGLQYLVLLSPSSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 7250 - protein, 474 aa, Homo sapiens
MASSPAVDVSCRRREKRRQLDARRSKCRIRLGGHMEQWCLLKERLGFSLHSQLAKFLLDRYTSSGCVLCAGPEPLPPKGLQYLVLLSHAHSRECSLVPGLRGPGGQDGGLVWECSAGHTFSWGPSLSPTPSEAPKPASLPHTTRRSWCSEATSGQELADLESEHDERTQEARLPSSEPDAPRLLPSPVTCTPKEGETPPAPAALSSPLAVPALSASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 7251 - protein, 96 aa, Homo sapiens
MASSPAVDVSCRRREKRRQLDARRSKCRIRLGGHMEQWCLLKERLGFSLHSQLAKFLLDRACPAALFHPQVSHFTRTACVTCGLRGSCSPPHGLSE

SEQ ID NO: 7252 - protein, 474 aa, Homo sapiens; identical to SEQ ID NO: 7250

SEQ ID NO: 7253 - protein, 524 aa, Homo sapiens
MPLVHMASSPAVDVSCRRREKRRQLDARRSKCRIRLGGHMEQWCLLKERLGFSLHSQLAKFLLDRYTSSGCVLCAGPEPLPPKGLQYLVLLSHAHSRECSLVPGLRGPGGQDGGLVWECSAGHTFSWGPSLSPTPSEAPKPASLPHTTRRSWCSEATSGQELADLESEHDERTQEARLPRRVGPPPETFPPPGEEEGEEEEDNDEDEEEMLSDASLWTYSSSPDDSEPDAPRLLPSPVTCTPKEGETPPAPAALSSPLAVPALSASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 7254 - protein, 132 aa, Homo sapiens
MASSPAVDVSCRRREKRRQLDARRSKCRIRLGGHMEQWCLLKERLGFSLHSQLAKFLLDRYTSSGCVLCAGPEPLPPKGLQYLVLLSHAHSRECSLVPGLRGPGGQDGGLVWECSAGHTFSWGPSLSPTPSE

SEQ ID NO: 7255 - protein, 515 aa, Homo sapiens
MGLLAFRDVALEFSPEEWECLDPAQRSLYRDVMLENYRNLISLGEDSFNMQFLFHSLAMSKPELIICLEARKEPWNVNTEKTARHSVLSSYLTEDILPEQGLQVSFQKVMLRRYERCCLEKLRLRNDWEIVGEWKGQKASYNGLDLCSATTHSKNFQCNKCVKGFSKFANLNKCKISHTGEKPFKCKECGNVSCMSLIMTQQQRIHIGENPYQCKKCGKAFNECSCFTDCKRIHVGEKHCKCEECNNIFKSCSSLAVVEKNHTEKKTYRCEECGKAFNLCSVLTKHKKIHTGEKPYKCEECGKSFKLFPYLTQHKRIHSREKPYKCEECGKVFKLLSYLTQHRRIHTGEKTFRCEECGKAFNQSSHLTEHRRIHTGEKPYKCEECGKAFTWFSYLIQHKRIHTGQKPYKCEECGKAFTWFSYLTQHKRIHTGEKPYKCDECGKAFNWFSYLTNHKRIHTGEKPYKCEECGKAFGQSSHLSKHKTIHTREKPYKCEECGKAFNHSAQLAVHEKTHT

SEQ ID NO: 7256 - protein, 172 aa, Homo sapiens
MGLLAFRDVALEFSPEEWECLDPAQRSLYRDVMLENYRNLISLGEDSFNMQFLFHSLAMSKPELIICLEARKEPWNVNTEKTARHSVLSSYLTEDILPEQGLQVSFQKVMLRRYERCCLEKLRLRNDWEIPCEDVLASPLPSAMILSFLRPPQKQKHVKPTEPIQSKTLQWL

SEQ ID NO: 7257 - protein, 172 aa, Homo sapiens
MGLLAFRDVALEFSPEEWECLDPAQRSLYRDVMLENYRNLISLGEDSFNMQFLFHSLAMSKPELIICLEARKEPWNVNTEKTARHSVLSSYLTEDILPEQGLQVSFQKVMLRRYERCCLEKLRLRNDWEIPCEDVLASPLPSAMILSFLRPPQKQKHVKPTEPVQSSTIELL

SEQ ID NO: 7258 - protein, 374 aa, Homo sapiens
MEPGGEPTGAKESSTLMESLAAVKAAFLAQAPSGSRSAEVQAAQSTEPAAEAGAPEGEGHRGGPPRALGSLGLCENQEARERPGGSPRGPVTSEKTGGQSGLESDVPPNAGPGAEGGGSWKGRPFPCGACGRSFKCSSDAAKHRSIHSGEKPYECSDCGKAFIHSSHVVRHQRAHSGERPYACAECGKAFGQSFNLLRHQRVHTGEKPYACADCGKAFGQRSDAAKHRRTHTGERLYACGECGKRFLHSSNVVRHRRTHHGENPYECRECGQAFSQSSNLLQHQRVHTGERPFACQDCGRAFSRSSFLREHRRIHTGEKPHQCGHCGRAFRALSGFFRHQRLHTGEKPFRCTECGRAFRLSFHLIQHRRVHGAE

SEQ ID NO: 7259 - protein, 107 aa, Homo sapiens
MEPGGEPTGAKESSTLMESLAAVKAAFLAQAPSGSRSAEVQAAQSTEPAAEAGAPEGEGHRGGPPRALGSLGLCENQEARERPGGSPRGPVTSEKTGGQSGLESDVP

SEQ ID NO: 7260 - protein, 204 aa, Homo sapiens
MEPGGEPTGAKESSTLMESLAAVKAAFLAQAPSGSRSAEVQAAQSTEPAAEAGAPEGEGHRGGPPRALGSLGLCENQEARERPGGSPRGPVTSEKTGGQSGLESDVPPNAGPGAEGGGSWKGRPFPCGACGRSFKCSSDAAKHRSIHSGEKPYECSDCGKAFIHSSHVVRHQRAHSGERPYACAECGKAFGQSFNLLRHQRVHT

SEQ ID NO: 7261 - protein, 545 aa, Homo sapiens
MKQEDNQGVCAHQDSEDKGMGSDFEDSEDREGDPEEREMGSNPHDTNKREGHPEPEMGSNPQDSRHREAVPDICTEGQLSEEEGVSVRGEEDDQSGVADMAMFPGLSESDSISRSLREDDDESAGENRLEEEEEQPAPPVLPWRRHLSLGSRHRGDKPAHRRFHRLHHPMAVDLGELDSLVASIMDAPTICPDCGESFSPGAAFLQHQRIHRLAEAAAAASLEPFGLAGECDAMVGMMGVGVAGGFGAGPPLARPPREKPFRCGECGKGFSRNTYLTNHLRLHTGERPNLCADCGKSFSWRADLLKHRRLHTGEKPYPCPECGEAFSLSSHLLSHRRAHAAASGAGAAALRPFACGECGKGFVRRSHLANHQRIHTGEKPHGCGECGKRFSWRSDLVKHQRVHTGEKPYMCSECGETFSVSSHLFTHKRTHSGERPYVCRECGKGFGRNSHLVNHLRVHTGEKPFRCGQCEKRFSDFSTLTQHQRTHTGEKPYTCIECGKSFIQSSHLIRHRRIHTGNKPHKCAGCGKGFRYKTHLAQHQKLHLC

SEQ ID NO: 7262 - protein, 642 aa, Homo sapiens
MEEERKTAELQKNRIQDSVVFEDVAVDFTQEEWALLDLAQRNLYRDVMLENFQNLASLGYPLHTPHLISQWEQEEDLQTVKRELIQGIFMGEHREGFETQLKTNESVASQDICGEKISNEQKIVRFKRNDSWFSSLHENQESCGIDYQNKSHERHLRNHMVENIYECYEENQDGQTFSQVPNLDSLKRNTEVKSCECHECGKAFVDHSSLKSHIRSHTGSKPYQCKECGKAFHFLACFKKHMKTPTEEKPYECKECTKAFSCSSFFRAHMKIHIGKTNYECKECGKGFSCSSSLTEHKRIHSGDKPYECKECGKAFSCSSSLSKHKRIHSGDKPYECKECGKAFSSSSHLIIHIRIHTGEKPYECKECGKAFSESSKLTVHGRTHTGEKPYKCKECGKAYNCPSSLSIHMRKHTGEKPYECLECGKAFYLPTSLNTHVKNQSREKPYECKECGKAFSCPSSFRAHVRDHTGKIQYECKECGKTFSRSSSLTEHLRTHSGEKPYECKECGKAFISSSHLTVHIRTHTGEKPYECKKCGKAFIYPSALRIHMRTHTGEKPYECKECGKAFRHSSYLTVHARMHTGEKPFECLECGKAFSCPSSFRRHVRSHTGEKPYECKECGKAFVCPAYFRRHVKTHTRENI

SEQ ID NO: 7263 - protein, 742 aa, Homo sapiens
MPCCSHRSCREDPGTSESREMDPVAFEDVAVNFTQEEWTLLDISQKNLFREVMLETFRNLTSIGKKWSDQNIEYEYQNPRRSFRSLIEEKVNEIKEDSHCGETFTQVPDDRLNFQEKKASPEVKSCDSFVCAEVGIGNSSFNMSIRGDTGHKAYEYQEYGPKPYKCQQPKNKKAFRYRPSIRTQERDHTGEKPYACKVCGKTFIFHSSIRRHMVMHSGDGTYKCKFCGKAFHSFSLYLIHERTHTGEKPYECKQCGKSFTYSATLQIHERTHTGEKPYECSKCDKAFHSSSSYHRHERSHMGEKPYQCKECGKAFAYTSSLRRHERTHSGKKPYECKQYGEGLSYLISFQTHIRMNSGERPYKCKICGKGFYSAKSFQTHEKTHTGEKRYKCKQCGKAFNLSSSFRYHERIHTGEKPYECKQCGKAFRSASQLRVHGGTHTGEKPYECKECGKAFRSTSHLRVHGRTHTGEKPYECKECGKAFRYVKHLQIHERTEKHIRMPSGERPYKCSICEKGFYSAKSFQTHEKTHTGEKPYECNQCGKAFRCCNSLRYHERTHTGEKPYECKQCGKAFRSASHLRMHERTHTGEKPYECKQCGKAFSCASNLRKHGRTHTGEKPYECKQCGKAFRSASNLQMHERTHTGEKPYECKECEKAFCKFSSFQIHERKHRGEKPYECKHCGNGFTSAKILQIHARTHIGEKHYECKECGKAFNYFSSLHIHARTHMGEKPYECKDCGKAFS

SEQ ID NO: 7264 - protein, 531 aa, Homo sapiens
MGFLHVGQDGLELPTSGDPPASASQSAGITGVSHRTQPPCFEGLTSKDLVREEKTRKRKRKAKESGMALLQGLLTFRDVAIEFSQEEWKCLDPAQRTLYRDVMLENYRNLVSLDTSSKCMMKMFSSTGQGNTEVVHTGTLQIHASHHIGDTCFQEIEKDIHDFVFQWQENETNGHEALMTKTKKLMSSTERHDQRHAGNKPIKNELGSSFHSHLPEVHIFHPEGKIGNQVEKAINDAFSVSASQRISCRPKTRISNKYRNNFLQSSLLTQKREVHTREKSFQRNESGKAFNGSSLLKKHQIIHLGDKQYKCDVCGKDFHQKRYLACHRCHTGENPYTCNECGKTFSHNSALLVHKAIHTGEKPYKCNECGKVFNQQSNLARHHRVHTGEKPYKCEECDKVFSRKSHLERHRRIHTGEKPYKCKVCDKAFRRDSHLAQHTVIHTGEKPYKCNECGKTFVQNSSLVMHKVIHTGEKRYKCNECGKVFNHKSNLACHRRLHTGEKPYKCNECGKVFNRKSNLERHHRLHTGKKS

SEQ ID NO: 7265 - protein, 465 aa, Homo sapiens
MALLQGLLTFRDVAIEFSQEEWKCLDPAQRTLYRDVMLENYRNLVSLDTSSKCMMKMFSSTGQGNTEVVHTGTLQIHASHHIGDTCFQEIEKDIHDFVFQWQENETNGHEALMTKTKKLMSSTERHDQRHAGNKPIKNELGSSFHSHLPEVHIFHPEGKIGNQVEKAINDAFSVSASQRISCRPKTRISNKYRNNFLQSSLLTQKREVHTREKSFQRNESGKAFNGSSLLKKHQIIHLGDKQYKCDVCGKDFHQKRYLACHRCHTGENPYTCNECGKTFSHNSALLVHKAIHTGEKPYKCNECGKVFNQQSNLARHHRVHTGEKPYKCEECDKVFSRKSHLERHRRIHTGEKPYKCKVCDKAFRRDSHLAQHTVIHTGEKPYKCNECGKTFVQNSSLVMHKVIHTGEKRYKCNECGKVFNHKSNLACHRRLHTGEKPYKCNECGKVFNRKSNLERHHRLHTGKKS

SEQ ID NO: 7266 - protein, 531 aa, Homo sapiens; identical to SEQ ID NO: 7264

SEQ ID NO: 7267 - protein, 300 aa, Homo sapiens
MHSLKKVTFEDVAIDFTQEEWAMMDTSKRKLYRDVMLENISHLVSLGYQISKSYIILQLEQGKELWREGREFLQDQNPDRESALKKKHMISMHPITRKDASTSMTMENSLILEDPFECNDSGEDCTHSSTITQRLLTHSGKKPYVSKQCGKSLRNLFSPKPHKQIHTKGKSYQCNLCEKAYTNCFRLRRHKMTHTGERPYACHLCGKAFTQCSHLRRHEKTHTGERPYKCHQCGKAFIQSFNLRRHERTHLGKKCYECDKSGKAFSQSSGFRGNKIIHTGEKPHACLLCGKAFSLSSDLR

SEQ ID NO: 7268 - protein, 207 aa, Homo sapiens
MHSLKKVTFEDVAIDFTQEEWAMMDTSKRKLYRDVMLENISHLVSLGYQISKSYIILQLEQGKELWREGREFLQDQNPDRESALKKKHMISMHPITRKDASTSMTMENSLILEDPFECNDSGEDCTHSSTITQRLLTHSGKKPYVSKQCGKSLRNLFSPKPHKQIHTKGKSYQCNLCEKAYTNCFRLRRHKMTHTGERPYACHLCGK

SEQ ID NO: 7269 - protein, 77 aa, Homo sapiens
MHSLKKVTFEDVAIDFTQEEWAMMDTSKRKLYRDVMLENISHLVSLGYQISKSYIILQLEQGKELWREGREFLQDQN

SEQ ID NO: 7270 - protein, 300 aa, Homo sapiens
MHSLEKVTFEDVAIDFTQEEWDMMDTSKRKLYRDVMLENISHLVSLGYQISKSYIILQLEQGKELWREGRVFLQDQNPDRESALKKKHMISMHPIIRKDASTSMTMENSLILEDPFEYNDSGEDCTHSSTITQCLLTHSGKKPCVSKQCGKSLRNLLSPKPRKQIHTKGKSYQCNLCEKAYTNCFYLRRHKMTHTGERPYACHLCGKAFTQCSHLRRHEKTHTGERPYKCHQCGKAFIQSFNLRRHERTHLGQKCYECDKSGKAFSQSSGFRGNKIIHIGEKPHACLLCGKAFSLSSDLR

SEQ ID NO: 7271 - protein, 371 aa, Homo sapiens
MDMAQEPVTFRDVAIYFSREEWACLEPSQRALYRDVMLDNFSSVAALGFCSPRPDLVSRLEQWEEPWVEDRERPEFQAVQRGPRPGARKSADPKRPCDHPAWAHKKTHVRRERAREGSSFRKGFRLDTDDGQLPRAAPERTDAKPTAFPCQVLTQRCGRRPGRRERRKQRAVELSFICGTCGKALSCHSRLLAHQTVHTGTKAFECPECGQTFRWASNLQRHQKNHTREKPFCCEACGQAFSLKDRLAQHRKVHTEHRPYSCGDCGKAFKQKSNLLRHQLVHTGERPFYCADCGKAFRTKENLSHHQRVHSGEKPYTCAECGKSFRWPKGFSIHRRLHLTKRFYECGHCGKGFRHLGFFTRHQRTHRHGEV

SEQ ID NO: 7272 - protein, 371 aa, Homo sapiens; identical to SEQ ID NO: 7271

SEQ ID NO: 7273 - protein, 371 aa, Homo sapiens; identical to SEQ ID NO: 7271

SEQ ID NO: 7274 - protein, 47 aa, Homo sapiens
MDMAQEPVTFRDVAIYFSREEWACLEPSQRALYRDVMLDNFSSVAAL

SEQ ID NO: 7275 - protein, 79 aa, Homo sapiens
MDMAQEPVTFRDVAIYFSREEWACLEPSQRALYRDVMLDNFSSVAALGFCSPRPDLVSRLEQWEEPWVEDRERPEFQAV

SEQ ID NO: 7276 - protein, 371 aa, Homo sapiens; identical to SEQ ID NO: 7271

SEQ ID NO: 7277 - protein, 371 aa, Homo sapiens; identical to SEQ ID NO: 7271

SEQ ID NO: 7278 - protein, 141 aa, Homo sapiens
MDMAQEPVTFRDVAIYFSREEWACLEPSQRALYRDVMLDNFSSVAALGFCSPRPDLVSRLEQWEEPWVEDRERPEFQAVQRGPRPGARKSADPKRPCDHPAWAHKKTHVRRERAREGSSFRKGFRLDTDDGQLPRAAPERT

SEQ ID NO: 7279 - protein, 563 aa, Homo sapiens
MGPLTFMDVAIEFSLEEWQCLDTAQQNLYRNVMLENYRNLVFLGIAVSNLDLITCLEQGKEPWNMKRHEMAAKPPAMCSHFAKDLRPEQYIKNSFQQVILRRYGKCGYQKGCKSVDEHKLHKGGHKGLNRCVTTTQSKIVQCDKYVKVFHKYSNAKRHKIRHTGKNPFKCKECGKSFCMLSQLTQHEIIHTGEKPYKCEECGKAFKKSSNLTNHKIIHTGEKPYKCEECGKAFNQSSTLTRHKIIHTGEKLYKCEECGKAFNRSSNLTKHKIVHTGEKPYKCEECGKAFKQSSNLTNHKKIHTGEKPYKCGECGKAFTLSSHLTTHKRIHTGEKPYKCEECGKAFSVFSTLTKHKIIHTEEKPYKCEECGKAFNRSSHLTNHKVIHTGEKPYKCEECGKAFTKSSTLTYHKVIHTGKKPYKCEECGKAFSIFSILTKHKVIHTEDKPYKCEECGKTFNYSSNFTNHKKIHTGEKPYKCEECGKSFILSSHLTTHKIIHTGEKPYKCKECGKAFNQSSTLMKHKIIHTGEKPYKCEECGKAFNQSPNLTKHKRIHTKEKPYKCK

SEQ ID NO: 7280 - protein, 641 aa, Homo sapiens
MDSVVFEDVAVNFTQEEWALLGPSQKKLYRDVMQETFVNLASIGENWEEKNIEDHKNQGRKLRSHMVERLCERKEGSQFGETISQTPNPKPNKKTFTRVKPYECSVCGKDYMCHSSLNRHMRSHTEHRSYEYHKYGEKSYECKECGKRFSFRSSFRIHERTHTGEKPYKCKQCGKAFSWPSSFQIHERTHTGEKPYECKECGKAFIYHTTFRGHMRMHTGEKPYKCKECGKTFSHPSSFRNHERTHSGEKPYECKQCGKAFRYYQTFQIHERTHTGEKPYQCKQCGKALSCPTSFRSHERIHTGEKPYKCKKCGKAFSFPSSFRKHERIHTGEKPYDCKECGKAFISLPSYRRHMIMHTGNGPYKCKECGKAFDCPSSFQIHERTHTGEKPYECKQCGKAFSCSSSFRMHERTHTGEKPHECKQCGKAFSCSSSVRIHERTHTGEKPYECKQCGKAFSCSSSFRMHERIHTGEKPYECKQCGKAFSFSSSFRMHERTHTGEKPYECKQCGKAFSCSSSFRMHERTHTGEKPYECKQCGKAFSCSSSIRIHERTHTGEKPYECKQCGKAFSCSSSVRMHERTHTGVKPYECKQCDKAFSCSRSFRIHERTHTGEKPYACQQCGKAFKCSRSFRIHERVHSGE

SEQ ID NO: 7281 - protein, 641 aa, Homo sapiens; identical to SEQ ID NO: 7280

SEQ ID NO: 7282 - protein, 664 aa, Homo sapiens
MEGFMDSGTQTDAVVVLSLAQAAVLGLVSENELFGATISAEAFYPDLGPELSGAAMGEPEPPGPDVYQLACNGRALEEPAEEEVLEVEAACEKHTRRKTRPPVRLVPKVKFEKVEEEEQEVYEVSVPGDDKDAGPAEAPAEAASGGCDALVQSSAVKMIDLSAFSRKPRTLRHLPRTPRPELNVAPYDPHFPAPARDGFPEPSMALPGPEALPTECGFEPPHLAPLSDPEAPSMESPEPVKPEQGFVWQEASEFEADTAGSTVERHKKAQLDRLDINVQIDDSYLVEAGDRQKRWQCRMCEKSYTSKYNLVTHILGHNGIKPHSCPHCSKLFKQPSHLQTHLLTHQGTRPHKCQVCHKAFTQTSHLKRHMLLHSEVKPYSCHFCGRGFAYPSELKAHEVKHESGRCHVCVECGLDFSTLTQLKRHLASHQGPTLYQCLECDKSFHYRSQLQNHMLKHQNVRPFVCTECGMEFSQIHHLKQHSLTHKGVKEFKCEVCGREFTLQANMKRHMLIHTSVRPYQCHICFKTFVQKQTLKTHMIVHSPVKPFKCKVCGKSFNRMYNLLGHMHLHAGSKPFKCPYCSSKFNLKGNLSRHMKVKHGVMDIGLDSQDPMMELTGTDPSELDGQQEMEDFEENAYSYASVDSSAEASVLTEQAMKEMAYYNVL

SEQ ID NO: 7283 - protein, 79 aa, Homo sapiens
MEGFMDSGTQTDAVVVLSLAQAAVLGLVSENELFGATISAEAFYPDLGPELSGAAMGEPEPPGPDVYQLACNGRALEEP

SEQ ID NO: 7284 - protein, 430 aa, Homo sapiens
MEEEEMNDGSQMVRSQESLTFQDVAVDFTREEWDQLYPAQKNLYRDVMLENYRNLVALGYQLCKPEVIAQLELEEEWVIERDSLLDTHPDGENRPEIKKSTTSQNISDENQTHEMIMERLAGDSFWYSILGGLWDFDYHPEFNQENHKRYLGQVTLTHKKITQERSLECNKFAENCNLNSNLMQQRIPSIKIPLNSDTQGNSIKHNSDLIYYQGNYVRETPYEYSECGKIFNQHILLTDHIHTAEKPSECGKAFSHTSSLSQPQMLLTGEKPYKCDECGKRFSQRIHLIQHQRIHTGEKPFICNGCGKAFRQHSSFTQHLRIHTGEKPYKCNQCGKAFSRITSLTEHHRLHTGEKPYECGFCGKAFSQRTHLNQHERTHTGEKPYKCNECGKAFSQSAHLNQHRKIHTREKLCEYKCEQTVRHSPSFSST

SEQ ID NO: 7285 - protein, 911 aa, Homo sapiens
MCSHFTQDFLPVQGIEDSFHKLILRRYEKCGHDNLQLRKGCKSMNVCKVQKGVYNGINKCLSNTQSKIFQCNARVKVFSKFANSNKDKTRHTGEKHFKCNECGKSFQKFSDLTQHKGIHAGEKPYTCEERGKDFGWYTDLNQHKKIHTGEKPYKCEECGKAFNRSTNLTAHKRIHNREKAYTGEDRDRAFGWSTNLNEYKKIHTGDKPYKCKECGKAFMHSSHLNKHEKIHTGEKPYKCKECGKVISSSSSFAKHKRIHTGEKPFKCLECGKAFNISTTLTKHRRIHTGEKPYTCEVCGKAFRQSANLYVHRRIHTGEKPYTCGECGKTFRQSANLYVHRRIHTGEKPYKCEDCGKAFGRYTALNQHKKIHTGEKPYKCEECGKAFNSSTNLTAHKRIHTREKPYTCEDRGRAFGLSTNLNEYKKIHTGDKPYKCKECGKAFIHSLHLNKHEKIHTGKKPYKCKQCGKVITSSSSFAKHKRIHTGEKPFECLECGKAFTSSTTLTKHRRIHTGEKPYTCEVCGKAFRQSAILYVHRRIHTGEKPYTCEECGKTFRQSANLYVHRRIHTGEKPYKCEECGKAFGRYTDLNQHKKIHTGEKLYKCEECGKDFVWYTDLNQQKKIYTGEKPYKCEECGKAFAPSTDLNQHTKILTGEQSYKCEECGKAFGWSIALNQHKKIHTGEKPYKCEECGKAFSRSRNLTTHRRVHTREKPYKCEDRGRSFGWSTNLNEYKKIHTGDKLYKCKECGKVFKQSSHLNRHEKIHTGKKPYKCKECGKVITSSSSFAKHKRIHTGEKPFKCLECGKAFTSSTTLTKHRRIHTGEKPYTCEECGKAFRQSAILYVHRRIHTGEKPYTCGECGKTFRQSANLYAHKKIHTGEKPYTCGDCGKTFRQSANLYAHKKIHTGDKTIQV

SEQ ID NO: 7286 - protein, 132 aa, Homo sapiens
MEPLTFRDVAIEFSPEEWKCLDPAQQNLYRDVMLENYRNLVSLAMCSHFTQDFLPVQGIEDSFHKLILRRYEKFSSLISSCRVISHGLSRGRNRATEKNDLLTTEEPVVKHRFDLQYPEEMWRNTVVQKGRK

SEQ ID NO: 7287 - protein, 923 aa, Homo sapiens
MLENYRNLVSLAMCSHFTQDFLPVQGIEDSFHKLILRRYEKCGHDNLQLRKGCKSMNVCKVQKGVYNGINKCLSNTQSKIFQCNARVKVFSKFANSNKDKTRHTGEKHFKCNECGKSFQKFSDLTQHKGIHAGEKPYTCEERGKDFGWYTDLNQHKKIHTGEKPYKCEECGKAFNRSTNLTAHKRIHNREKAYTGEDRDRAFGWSTNLNEYKKIHTGDKPYKCKECGKAFMHSSHLNKHEKIHTGEKPYKCKECGKVISSSSSFAKHKRIHTGEKPFKCLECGKAFNISTTLTKHRRIHTGEKPYTCEVCGKAFRQSANLYVHRRIHTGEKPYTCGECGKTFRQSANLYVHRRIHTGEKPYKCEDCGKAFGRYTALNQHKKIHTGEKPYKCEECGKAFNSSTNLTAHKRIHTREKPYTCEDRGRAFGLSTNLNEYKKIHTGDKPYKCKECGKAFIHSLHLNKHEKIHTGKKPYKCKQCGKVITSSSSFAKHKRIHTGEKPFECLECGKAFTSSTTLTKHRRIHTGEKPYTCEVCGKAFRQSAILYVHRRIHTGEKPYTCEECGKTFRQSANLYVHRRIHTGEKPYKCEECGKAFGRYTDLNQHKKIHTGEKLYKCEECGKDFVWYTDLNQQKKIYTGEKPYKCEECGKAFAPSTDLNQHTKILTGEQSYKCEECGKAFGWSIALNQHKKIHTGEKPYKCEECGKAFSRSRNLTTHRRVHTREKPYKCEDRGRSFGWSTNLNEYKKIHTGDKLYKCKECGKVFKQSSHLNRHEKIHTGKKPYKCKECGKVITSSSSFAKHKRIHTGEKPFKCLECGKAFTSSTTLTKHRRIHTGEKPYTCEECGKAFRQSAILYVHRRIHTGEKPYTCGECGKTFRQSANLYAHKKIHTGEKPYTCGDCGKTFRQSANLYAHKKIHTGDKTIQV

SEQ ID NO: 7288 - protein, 738 aa, Homo sapiens [sequence omitted]

SEQ ID NO: 7289 - protein, 108 aa, Homo sapiens
MGLLTFRDVAIEFSLEEWQCLDTAQKNLYRNVMLENYRNLAFLGIAVSKPDLIICLEKEKEPWNMKRDEMVDEPPGLAVSNPDLISCLEQIKEPWNVKRHETVVKYSG

SEQ ID NO: 7290 - protein, 89 aa, Homo sapiens
MGLLTFRDVAIEFSLEEWQCLDTAQKNLYRNVMLENYRNLAFLGIAVSKPDLIICLEKEKEPWNMKRDEMVDEPPDGVSLCHPGWSAVA

SEQ ID NO: 7291 - protein, 77 aa, Homo sapiens
MGLLTFRDVAIEFSLEEWQCLDTAQKNLYRNVMLENYRNLAFLGIAVSKPDLIICLEKEKEPWNMKRDEMVDEPPGR

SEQ ID NO: 7292 - protein, 616 aa, Homo sapiens
MGLLTFRDVAIEFSLEEWQCLDTAQKNLYRNVMLENYRNLAFLGIAVSKPDLIICLEKEKEPWNMKRDEMVDEPPGICPHFAQDIWPEQGVEDSFQKVILRRFEKCGHENLQLRKGCKSVDECKVHKEGYNGLNQCFTTTQGKASQCGKYLKVFYKFINLNRYKIRHTRKKPFKCKNCVKSFCMFSHKTQHKSIYTTEKSYKCKECGKTFNWSSTLTNHKKTHTEEKPYKCEEYGKAFNQSSNYTTHKVTHTGEKPYKCEECGKAFSQSSTLTIHKRIHTGEKPCKCEECGKAFSQPSALTIHKRMHIGEKPYKCEECGKAFVWSSTLTRHKRLHSGEKPYKCEECAKAFSQFGHLTTHRIIHTGEKPYKCEECGKAFIWPSTLTKHKRIHTGEKPYKCEECGKAFHRSSNLTKHKIIHTGEKPYKCEECGKAFIWSSNLTEHKKIHTREKPYKCEECSKAFSRSSALTTHKRMHTGEKPYKCEECGKAFSQSSTLTAHKIIHTGEKPYKCEECGKAFILSSTLSKHKRIHTGEKPYKCEECGKTFNQSSNLSTHKIIHTGEKPYKCEECGKAFNRSSNLSTHKIIHTGEKPYKCDECGKSFIWSSTLFKHKRIHT

SEQ ID NO: 7293 - protein, 1252 aa, Homo sapiens
MPGAPGSLEMGPLTFRDVTIEFSLEEWQCLDTVQQNLYRDVMLENYRNLVFLGMAVFKPDLITCLKQGKEPWNMKRHEMVTKPPVMRSHFTQDLWPDQSTKDSFQEVILRTYARCGHKNLRLRKDCKSANEGKMHKEGYNKLNQCRTATQRKIFQCNKHMKVFHKYSNRNKVRHTKKKTFKCIKCSKSFFMLSCLIRHKRIHIRQNIYKCEERGKAFKSFSTLTKHKIIHTEDKPYKYKKCGNAFKFSSTFTKHKRIHTGETPFRCEECGKAFNQSSNLTDHKRIHTGEKTYKCEECGKAFKGSSNFNAHKVIHTAEKPYKCEDCGKTFNHFSALRKHKIIHTGKKPYKREECGKAFSQSSTLRKHEIIHTGEKPYKCEECGKAFKWSSKLTVHKVVHTGEKPYKCEECGKAFSQFSTLKKHKIIHTGKKPYKCEECGKAFNSSSTLMKHKIIHTGEKPYKCEECGKAFRQSSHLTRHKAIHTGEKPYKCEECGKAFNHFSDLRRHKIIHTGKKPYKCEECGKAFSQSSTLRNHQIIHTGEKPYKCEECGKAFKWSSKLTVHKVIHTGEKPCKCEECGKAFKHFSALRKHKVIHTREKLYKCEECGKAFNNSSILAKHKIIHTGKKPYKCEECGKAFRQSSHLTRHKAIHTGEKPYKCEECGKAFSHFSALRRHKIIHTGKKPYKCEECGKAFSHFSALRRHKIIHTGEKPYKCEECGKAFKWSSKLTVHKVIHTAEKPCKCEECGKSFKHFSALRKHKVIHTREKLYKCEECVKAFNSFSALMKHKVIHTGEKPYKCEECGKAFKWSSKLTVHKVIHTGEKPCKCEECGKAFKHFSALRKHKVIHTGKKPYKCEECGKAFSQSSSLRKHEIIHSGEKPYKCEECGKAFKWLSKLTVHKVIHTAEKPCKCEECGKAFKHFSALRKHKIIHTGKKPYKCEECGKAFNDSSTLMKHKIIHTGKKPYKCAECGKAFKQSSHLTRHKAIHTGEKPYKCEECGKDFNNSSTLKKHKLIHTREKLYKCEECVKAFNNFSALMKHKIIHTGEKPYKCEECGKAFKWSSKLTEHKVIHTGEKPCKCEECDKAFKHFSALRKHKVIHTGKKPYQCDECGKAFNNSSTLTKHKIIHTGEKPYKCEECGKAFSQSSILTKHKIIHSVEKPYKCEECGKAFNQSSHLTRHKTIHTGEKPYKCEECGKAFIQCSYLIRHKTIHTREKPTNVKKVPKLLSNPHTLLDKTIHTGEKPYKCEECAKAF

SEQ ID NO: 7294 - protein, 503 aa, Homo sapiens
MGALTFRDVAIEFSLEEWQCLDTEQQNLYRNVMLDNYRNLVFLGIAVSKPDLITCLEQEKEPWNLKTHDMVAKPPVICSHIAQDLWPEQGIKDYFQEVILRQYKKCRHENLLLRKGCKNVDEFKMHKKGYNRHNQCLTTSHSKIFQCDKYVKVFHKFSNSNRHKIRHTSKKPFKCKECGKLFCILSHLAQHKKIHTGEKSYKCEEYGKAFNESSNCTTHKRITEKKPYKCKECGKAFNWFSHFTTHKRIHTGEKPYQCEKCGKFFNQSTNLTTHKRIHTGEKPYKCEECGKAFNQSSNLTEHKKIHTKEQPYKCEKCGKAFKWSSTLTKHKRIHNGEKPYKCEECGKAFNRSSTLNRHKITHTGGKPYKYKECGKAFNQSSTLTIHKIIHTVEKFYKCEECGKAFSRISHLTTHKRIHTGEKPYKCEECGRAFNQSSTLTTHKRIHTGEKPYECEECGKAFNRSSTLTTHKIIHSGEKIYKCKECGKAFRRFSHLTRHKTIHT

SEQ ID NO: 7295 - protein, 585 aa, Homo sapiens
MELLTFRDVAIEFSPEEWKCLDPAQQNLYRDVMLENYRNLISLGVAISNPDLVIYLEQRKEPYKVKIHETVAKHPAVCSHFTQDFLPVQGIEDSFHKLILRRYEKCGHENLELRKSCKRKVQKGGYNEFNQCLSTIQSKIFQCNVHVKVFSTFSNSNQRRIRHTGEKHFKECGKSFQKFSDLTQHQGIHAGEKPYTCEECGKDFKWYLIFNEYEIIHTGEKPFTCEECGNIFTTSSNFAKHKVHTGEKSYKYEECGKAFNRSSTLTKHKRIHAEEKPFTCEECGKIITSSSNVAKHKKIHTGEKLYKCQECGKVFNRSTTLTKHNRIHTGEKPYTCEECGKAFSRSSVLNEHKRIHTGEKPYKCEQCGKAFRQSATLNKHKSIHTGEKPYTCEECGKAFSRFTTLNEHKRIHTGERPHKCEECGKAFGWSTDLNKHKIIHTGEKPYKCEECGKAFGWSAYLSKHKKIHTGEKPYRCEECGKAFLCSRALNKHKTIHTGEKPYECEECGKAFGWSTYLSKHKKIHTGEKPYRCEECGKAFRRSRVLNKYKTIHTGDKTPKCKGCGKAFKWSSYLNQHNKIYTGEKL

SEQ ID NO: 7296 - protein, 427 aa, Homo sapiens
MGVLTFRDVAVEFSPEEWECLDSAQQRLYRDVMLENYGNLVSLGLAIFKPDLMTCLEQRKEPWKVKRQEAVAKHPAGSFHFTAEILPDHDIKDSFQKVILRKYGSCDLNNLHLKKDYQSVGNCKGQKSSYNGLHQCLSATHSKTCQCNKCGRGFQLCSIFTEHKDIFSREKCHKCEECGKDCRLFSDFTRHKKIHTVERCYKCEECGKAFKKFSNLTEHKRVHTGEKPYKCEGCGKTFTCSSTLVKHKRNHTGDRPYKCEECGKAFKCFSDLTNHKRIHTGEKPYKCEECNKAYRWFSDLAKHKIIHTGDKPYTCNECGKAFKWFSALSKHKRIHTGEKPYICEECGKAFTRSSTLFNHKRIHMEERPYKCEECSKTFKCFSDLTNHKRIHTGEKPYKCEECGKASSWFSHLIRHKRIHTREKLHKC

SEQ ID NO: 7297 - protein, 427 aa, Homo sapiens; identical to SEQ ID NO: 7296

SEQ ID NO: 7298 - protein, 137 aa, Homo sapiens
MDDLRYGVYPVKGASGYPGAERNLLEYSYFEKGPLTFRDVVIEFSQEEWQCLDTAQQDLYRKVMLENFRNLVFLGIDVSKPDLITCLEQGKDPWNMKRHSMVATPPESGVLKFPTIIILLSRCFFQSVNICFIYLEP

SEQ ID NO: 7299 - protein, 117 aa, Homo sapiens
MDDLRYGVYPVKGASGYPGAERNLLEYSYFEKGPLTFRDVVIEFSQEEWQCLDTAQQDLYRKVMLENFRNLVFLGIDVSKPDLITCLEQGKDPWNMKRHSMVATPPDGVSLLFPRPE

SEQ ID NO: 7300 - protein, 193 aa, Homo sapiens
MAQASLLACEGLAGVSLVPTAASKKMMLSQIASKQAENGERAGSPDVLRCSSQGHRKDSDKSRSRKDDDSLSEASHSKKTVKKVVVVEQNGSFQVKIPKNFVCEHCFGAFRSSYHLKRHILIHTGEKPFECDICDMRFIQKYHLERHKRVHSGEKPYQCERCHQCFSRTDRLLRHKRMCQGCQSKTSDGQFSL

SEQ ID NO: 7301 - protein, 778 aa, Homo sapiens
MNLTEDCMVFEDVAIYFSQEEWGILNDAQRHLHSNVMLENFALLSSVGCWHGAKDEEVPSKQCVSVRVLQVTIPKPALSTLKAQPCKMCSSILKDILHLAEHDGTHPEQGLYTCAAEHDLHQKEQIREKLTRSDEWRPSFVNHSAHVGERNFTCTQGGKDFTASSDLLQQQVLNSGWKLYRDTQDGEAFQGEQNDFNSSQGGKDFCHQHGLFEHQKTHNGERPYEFSECGELFRYNSNLIKYQQNHAGERPYEGTEYGKTFIRKSNLVQHQKIHSEGFLSKRSDPIEHQEILSRPTPYECTQCGKAFLTQAHLVGHQKTHTGEQPYECNKCGKFFMYNSKLIRHQKVHTGERRYECSECGKLFMDSFTLGRHQRVHTGERPFECSICGKFFSHRSTLNMHQRVHAGKRLYKCSECGKAFSLKHNVVQHLKIHTGERPYECTECEKAFVRKSHLVQHQKIHTDAFSKRSDLIQHKRIDIRPRPYTCSECGKAFLTQAHLVGHQKIHTGERPYECTQCAKAFVRKSHLVQHEKIHTDAFSKRSDLIQHKRIDLRPRPYVCSECGKAFLTQAHLDGHQKIQTGERRYECNECGKFFLDSYKLVIHQRIHTGEKPYKCSKCGKFFRYRCTLSRHQKVHTGERPYECSECGKFFRDSYKLIIHQRVHTGEKPYECSNCGKFLRYRSTFIKHHKVCTGEKPHECSKCRELFRTKSSLIIHQQSHTGESPFKLRECGKDFNKCNTGQRQKTHTGERSYECGESSKVFKYNSSLIKHQIIHTGKRP

SEQ ID NO: 7302 - protein, 397 aa, Homo sapiens
MMFQDPVACEDVAVNFTQEEWALLDISQRKLYREVMLETFRNLTSIGKKWKDQNIEYEYQNPRRNFRSLIEGNVNEIKEDSHCGETFTQVPDDRLNFQEKKASPEAKSCDNFVCGEVGIGNSSFNMNIRGDIGHKAYEYQDYAPKPYKCQQPKKAFRYHPSFRTQERNHTGEKPYACKECGKTFISHSGIRRRMVMHSGDGPYKCKFCGKAVHCLRLYLIHERTHTGEKPYECKQCVKSFSYSATHRIHERTHTGEKPYECQQCGKAFHSSSSFQAHKRTHTGGKPYECKQCGKSFSWCHSFQIHERTHTGEKPCECSKCNKAFRSYRSYLRHKRSHTGEKPYQCKECRKAFTYPSSLRRHERTHSAKKPYECKQCGKALSYKFSNTPKNALWRKTL

SEQ ID NO: 7303 - protein, 394 aa, Homo sapiens
MDPVACEDVAVNFTQEEWALLDISQRKLYREVMLETFRNLTSIGKKWKDQNIEYEYQNPRRNFRSLIEGNVNEIKEDSHCGETFTQVPDDRLNFQEKKASPEAKSCDNFVCGEVGIGNSSFNMNIRGDIGHKAYEYQDYAPKPYKCQQPKKAFRYHPSFRTQERNHTGEKPYACKECGKTFISHSGIRRRMVMHSGDGPYKCKFCGKAVHCLRLYLIHERTHTGEKPYECKQCVKSFSYSATHRIHERTHTGEKPYECQQCGKAFHSSSSFQAHKRTHTGGKPYECKQCGKSFSWCHSFQIHERTHTGEKPCECSKCNKAFRSYRSYLRHKRSHTGEKPYQCKECRKAFTYPSSLRRHERTHSAKKPYECKQCGKALSYKFSNTPKNALWRKTL

SEQ ID NO: 7304 - protein, 414 aa, Homo sapiens
MPCCSHRSCREDPGTSESREMDPVACEDVAVNFTQEEWALLDISQRKLYREVMLETFRNLTSIGKKWKDQNIEYEYQNPRRNFRSLIEGNVNEIKEDSHCGETFTQVPDDRLNFQEKKASPEAKSCDNFVCGEVGIGNSSFNMNIRGDIGHKAYEYQDYAPKPYKCQQPKKAFRYHPSFRTQERNHTGEKPYACKECGKTFISHSGIRRRMVMHSGDGPYKCKFCGKAVHCLRLYLIHERTHTGEKPYECKQCVKSFSYSATHRIHERTHTGEKPYECQQCGKAFHSSSSFQAHKRTHTGGKPYECKQCGKSFSWCHSFQIHERTHTGEKPCECSKCNKAFRSYRSYLRHKRSHTGEKPYQCKECRKAFTYPSSLRRHERTHSAKKPYECKQCGKALSYKFSNTPKNALWRKTL

SEQ ID NO: 7305 - protein, 272 aa, Homo sapiens
MNIRGDIGHKAYEYQDYAPKPYKCQQPKKAFRYHPSFRTQERNHTGEKPYACKECGKTFISHSGIRRRMVMHSGDGPYKCKFCGKAVHCLRLYLIHERTHTGEKPYECKQCVKSFSYSATHRIHERTHTGEKPYECQQCGKAFHSSSSFQAHKRTHTGGKPYECKQCGKSFSWCHSFQIHERTHTGEKPCECSKCNKAFRSYRSYLRHKRSHTGEKPYQCKECRKAFTYPSSLRRHERTHSAKKPYECKQCGKALSYKFSNTPKNALWRKTL

SEQ ID NO: 7306 - protein, 408 aa, Homo sapiens
MAPPLAPLPPRDPNGAGPEWREPGAVSFADVAVYFCREEWGCLRPAQRALYRDVMRETYGHLSALGIGGNKPALISWVEEEAELWGPAAQDPEVAKCQTQTDPADSRNKKKERQREGTGALEKPDPVAAGSPGLKSPQAPSAGPPYGWEQLSKAPHRGRPSLCAHPPVPRADQRHGCYVCGKSFAWRSTLVEHVYSHTGEKPFHCTDCGKGFGHASSLSKHRAIHRGERPHRCLECGRAFTQRSALTSHLRVHTGEKPYGCADCGRRFSQSSALYQHRRVHSGETPFPCPDCGRAFAYPSDLRRHVRTHTGEKPYPCPDCGRCFRQSSEMAAHRRTHSGEKPYPCPQCGRRFGQKSAVAKHQWVHRPGAGGHRGRVAGRLSVTLTPGHGDLDPPVGFQLYPEIFQECG

SEQ ID NO: 7307 - protein, 407 aa, Homo sapiens
MAPPLAPLPPRDPNGAGPEWREPGAVSFADVAVYFCREEWGCLRPAQRALYRDVMRETYGHLSALGIGGNKPALISWVEEEAELWGPAAQDPEVAKCQTQTDPDSRNKKKERQREGTGALEKPDPVAAGSPGLKSPQAPSAGPPYGWEQLSKAPHRGRPSLCAHPPVPRADQRHGCYVCGKSFAWRSTLVEHVYSHTGEKPFHCTDCGKGFGHASSLSKHRAIHRGERPHRCLECGRAFTQRSALTSHLRVHTGEKPYGCADCGRRFSQSSALYQHRRVHSGETPFPCPDCGRAFAYPSDLRRHVRTHTGEKPYPCPDCGRCFRQSSEMAAHRRTHSGEKPYPCPQCGRRFGQKSAVAKHQWVHRPGAGGHRGRVAGRLSVTLTPGHGDLDPPVGFQLYPEIFQECG

SEQ ID NO: 7308 - protein, 6 aa, Homo sapiens
MMKEFS

SEQ ID NO: 7309 - protein, 523 aa, Homo sapiens
MALPQGLLTFRDVAIEFSQEEWKCLDPAQRTLYRDVMLENYRNLVSLDISSKCMMKEFSSTAQGNREVFHAGTSQRHESHHNGDFCFQDIDKDIHDIEFQWQEDERNGHEALMTKIKKLTGSTERYDQNYAGNKPVKYQLGFSFHSHLPELHIFHTEEKIDNQVVKSIHDASLVSTAQRISCRPETHISNDYGNNFLNSSLFTQKQEVHMREKSFQCNDSGKAYNCSSLLRKHQLIHLGEKQYKCDICGKVFNSKRYVARHRRCHTGEKPYKCNECGKTFSQTYYLTCHRRLHTGEKPYKCEECDKAFHFKSKLQIHRRIHTGEKPYKCNECGKTFSQKSYLTCHRRLHTGEKPYKCNECGKTFSRKSHFTCHHRVHTGEKPYKCNECSKTFSHKSSLTYHRRLHTEEKPYKCNECGKTFNQQLTLNICRLHSGEKPYKCEECDKAYSFKSNLEIHQKIHTEENPYKCNECGKTFSRTSSLTYHHRLHTGQKPYKCEDCDEAFSFKSNLERHRRIYTGEKLHV

SEQ ID NO: 7310 - protein, 128 aa, Homo sapiens
MMKEFSSTAQGNREVFHAGTSQRHESHHNGDFCFQDIDKDIHDIEFQWQEDERNGHEALMTKIKKLTGSTERYDQNYAGNKPVKYQLGFSFHSHLPELHIFHTEEKIDNQVVKSIHDASLVSTAQRIS

SEQ ID NO: 7311 - protein, 471 aa, Homo sapiens
MLCEGEAQKRKAEESGMPLTQGHLTFRDVAIEFSQEEWKCLDPVQKALYRDVMLENYRNLVSLGICLPDLSIISMMKQRTEPWTVENEMKVAKNPDRWEGIKDINTGRSCAVRSKAGNKPITNQLGLTFQLPLPELEIFQGEGKIYECNQVQKFISHSSSVSPLQRIYSGVKTHIFNKHRNDFVDFPLLSQEQKAHIRRKPYECNEQGKVFRVSSSLPNHQVIHTADKPNRCHECGKTVRDKSGLAEHWRIRTGEKPYKCKECGKLFNRIAYLARHEKVHTGESPYKCNECGKVFSRITYLVRHQKIHTREKPHKCNKCGKVYSSSSYLAQHWRIHTGEKLYKCNKCGKEFSGHSSLTTHLLIHTGEKPYKCKECDKAFRHKFSLTVHQRNHNGEKPYKCHECGKVFTQVSHLARHQKIHTGEKPYKCNECGKVFTQNSHLANHQRIHTGEKPYKCHVCGLSLWSGKESVR

SEQ ID NO: 7312 - protein, 468 aa, Homo sapiens
MAQLRRGHLTFRDVAIEFSQEEWKCLDPVQKALYRDVMLENYRNLVSLGICLPDLSIISMMKQRTEPWTVENEMKVAKNPDRWEGIKDINTGRSCAVRSKAGNKPITNQLGLTFQLPLPELEIFQGEGKIYECNQVQKFISHSSSVSPLQRIYSGVKTHIFNKHRNDFVDFPLLSQEQKAHIRRKPYECNEQGKVFRVSSSLPNHQVIHTADKPNRCHECGKTVRDKSGLAEHWRIRTGEKPYKCKECGKLFNRIAYLARHEKVHTGESPYKCNECGKVFSRITYLVRHQKIHTREKPHKCNKCGKVYSSSSYLAQHWRIHTGEKLYKCNKCGKEFSGHSSLTTHLLIHTGEKPYKCKECDKAFRHKFSLTVHQRNHNGEKPYKCHECGKVFTQVSHLARHQKIHTGEKPYKCNECGKVFTQNSHLANHQRIHTGEKPYKCHVCGKVFRHSSWFVQHQRSVHERVLTN

SEQ ID NO: 7313 - protein, 540 aa, Homo sapiens
MEREALPWGLEPQDVQSSDEMRSPEGYLRGNMSENEEEEISQQEGSGDYEVEEIPFGLEPQSPGFEPQSPEFEPQSPRFEPESPGFESRSPGLVPPSPEFAPRSPESDSQSPEFESQSPRYEPQSPGYEPRSPGYEPRSPGYESESSRYESQNTELKTQSPEFEAQSSKFQEGAEMLLNPEEKSPLNISVGVHPLDSFTQGFGEQPTGDLPIGPPFEMPTGALLSTPQFEMLQNPLGLTGALRGPGRRGGRARGGQGPRPNICGICGKSFGRGSTLIQHQRIHTGEKPYKCEVCSKAFSQSSDLIKHQRTHTGERPYKCPRCGKAFADSSYLLRHQRTHSGQKPYKCPHCGKAFGDSSYLLRHQRTHSHERPYSCTECGKCYSQNSSLRSHQRVHTGQRPFSCGICGKSFSQRSALIPHARSHAREKPFKCPECGKRFGQSSVLAIHARTHLPGRTYSCPDCGKTFNRSSTLIQHQRSHTGERPYRCAVCGKGFCRSSTLLQHHRVHSGERPYKCDDCGKAFSQSSDLIRHQRTHAAGRR

SEQ ID NO: 7314 - protein, 453 aa, Homo sapiens
MSENEEEEISQQEGSGDYEVEEIPFGLEPQSPGFEPQSPEFEPQSPRFEPESPGFESRSPGLVPPSPEFAPRSPESDSQSPEFESQSPRYEPQSPGYEPRSPGYEPRSPGYESESSRYESQNTELKTQSPEFEAQSSKFQEGAEMLLNPEEKSPLNISVGVHPLDSFTQGFGEQPTGDLPIGPPFEMPTGALLSTPQFEMLQNPLGLTGALRGPGRRGGRARGGQGPRPNICGICGKSFGRGSTLIQHQRTHSGQKPYKCPHCGKAFGDSSYLLRHQRTHSHERPYSCTECGKCYSQNSSLRSHQRVHTGQRPFSCGICGKSFSQRSALIPHARSHAREKPFKCPECGKRFGQSSVLAIHARTHLPGRTYSCPDCGKTFNRSSTLIQHQRSHTGERPYRCAVCGKGFCRSSTLLQHHRVHSGERPYKCDDCGKAFSQSSDLIRHQRTHAAGRR

SEQ ID NO: 7315 - protein, 691 aa, Homo sapiens
MMAENNLKMLKIQQCVVANKLPRNRPYVCNICFKHFETPSKLARHYLIHTGQKPFECDVCHKTFRQLVHLERHQLTHSLPFKCSICQRHFKNLKTFVKHQQLHNETYQNNVKQVRRLLEAKQEKSMYGVYNTFTTEERWALHPCSKSDPMYSMKRRKNIHACTICGKMFPSQSKLDRHVLIHTGQRPFKCVLCTKSFRQSTHLKIHQLTHSEERPFQCCFCQKGFKIQSKLLKHKQIHTRNKAFRALLLKKRRTESRPLPNKLNANQGGFENGEIGESEENNPLDVHSIYIVPFQCPKCEKCFESEQILNEHSCFAARSGKIPSRFKRSYNYKTIVKKILAKLKRARSKKLDNFQSEKKVFKKSFLRNCDLISGEQSSEQTQRTFVGSLGKHGTYKTIGNRKKKTLTLPFSWQNMGKNLKGILTTENILSIDNSVNKKDLSICGSSGEEFFNNCEVLQCGFSVPRENIRTRHKICPCDKCEKVFPSISKLKRHYLIHTGQRPFGCNICGKSFRQSAHLKRHEQTHNEKSPYASLCQVEFGNFNNLSNHSGNNVNYNASQQCQAPGVQKYEVSESDQMSGVKAESQDFIPGSTGQPCLPNVLLESEQSNPFCSYSEHQEKNDVFLYRCSVCAKSFRSPSKLERHYLIHAGQKPFECSVCGKTFRQAPHWKRHQLTHFKERPQGKVVALDSVM

SEQ ID NO: 7316 - protein, 132 aa, Homo sapiens
MMAENNLKMLKIQQCVVANKLPRNRPYVCNICFKHFETPSKLARHYLIHTGQKPFECDVCHKTFRQLVHLERHQLTHSLPFKCSICQRHFKNLKTFVKHQQLHNETYQNNVKQVRRLLEAKQEKSMYGVYNT

SEQ ID NO: 7317 - protein, 317 aa, Homo sapiens
MPGEQQAEEEEEEEMQEEMVLLVKGEEDEGEEKYEVVKLKIPMDNKEVPGEAPAPSADPARPHACPDCGRAFARRSTLAKHARTHTGERPFGCTECGRRFSQKSALTKHGRTHTGERPYECPECDKRFSAASNLRQHRRRHTGEKPYACAHCGRRFAQSSNYAQHLRVHTGEKPYACPDCGRAFGGSSCLARHRRTHTGERPYACADCGTRFAQSSALAKHRRVHTGEKPHRCAVCGRRFGHRSNLAEHARTHTGERPYPCAECGRRFRLSSHFIRHRRAHMRRRLYICAGCGRDFKLPPGATAATATERCPECEGS

SEQ ID NO: 7318 - protein, 317 aa, Homo sapiens; identical to SEQ ID NO: 7317

SEQ ID NO: 7319 - protein, 414 aa, Homo sapiens
MNSEVIVDPIQGQVNFEDVFVYFSQEEWVLLDEAQRLLYRDVMLENFALMASLGHTSFMSHIVASLVMGSEPWVPDWVDMTLAVATGCWHGMEDEEIPFEQSFSIGIFSANLHQHQKQHSGEKPFRSDKSRPFLLNNCAVQSMEMSFVTGEACKDFLASSSIFEHHAPHNEWKPHSNTKCEEASHCGKRHYKCSECGKTFSRKDSLVQHQRVHTGERPYECGECGKTFSRKPILAQHQRIHTGEMPYECGICGKVFNHSSNLIVHQRVHTGARPYKCSECGKAYSHKSTLVQHESIHTGERPYECSECGKYFGHKYRLIKHWSVHTGARPYECIACGKFFSQSSDLIAHQRVHNGEKPYVCSECGKAFSHKHVLVQHHRIHTGERPYKCSECGKAFRQRASLIRHWKIHTGERP

SEQ ID NO: 7320 - protein, 244 aa, Homo sapiens
MAAAEPMGPAQGQVNFEDVFVYFSQEEWVLLDEAQRLLYRDVMLENFALMASLGCWHGMEDEEIPFEQSFSIGMSQIRIPKGGPSTQKAYPCGTCGLVLKDILHLAEHQETHPGQKPYMCVLCGKQFCFSANLHQHQKQHSGEKPFRSDKSRPFLLNNCAVQSMEMSFVTGEACKDFLASSSIFEHHAPHNEWKPHSNTKCEEASHCGKRHYKCSECEKTAANYREYDPSKGTSTCVSITLAPL

SEQ ID NO: 7321 - protein, 489 aa, Homo sapiens
MAAAEPMGPAQVPMNSEVIVDPIQGQVNFEDVFVYFSQEEWVLLDEAQRLLYRDVMLENFALMASLGHTSFMSHIVASLVMGSEPWVPDWVDMTLAVATETPGGSDPGCWHGMEDEEIPFEQSFSIGMSQIRIPKGGPSTQKAYPCGTCGLVLKDILHLAEHQETHPGQKPYMCVLCGKQFCFSANLHQHQKQHSGEKPFRSDKSRPFLLNNCAVQSMEMSFVTGEACKDFLASSSIFEHHAPHNEWKPHSNTKCEEASHCGKRHYKCSECGKTFSRKDSLVQHQRVHTGERPYECGECGKTFSRKPILAQHQRIHTGEMPYECGICGKVFNHSSNLIVHQRVHTGARPYKCSECGKAYSHKSTLVQHESIHTGERPYECSECGKYFGHKYRLIKHWSVHTGARPYECIACGKFFSQSSDLIAHQRVHNGEKPYVCSECGKAFSHKHVLVQHHRIHTGERPYKCSECGKAFRQRASLIRHWKIHTGERP

SEQ ID NO: 7322 - protein, 448 aa, Homo sapiens
MAAAEPMGPAQVPMNSEVIVDPIQGQVNFEDVFVYFSQEEWVLLDEAQRLLYRDVMLENFALMASLGCWHGMEDEEIPFEQSFSIGMSQIRIPKGGPSTQKAYPCGTCGLVLKDILHLAEHQETHPGQKPYMCVLCGKQFCFSANLHQHQKQHSGEKPFRSDKSRPFLLNNCAVQSMEMSFVTGEACKDFLASSSIFEHHAPHNEWKPHSNTKCEEASHCGKRHYKCSECGKTFSRKDSLVQHQRVHTGERPYECGECGKTFSRKPILAQHQRIHTGEMPYECGICGKVFNHSSNLIVHQRVHTGARPYKCSECGKAYSHKSTLVQHESIHTGERPYECSECGKYFGHKYRLIKHWSVHTGARPYECIACGKFFSQSSDLIAHQRVHNGEKPYVCSECGKAFSHKHVLVQHHRIHTGERPYKCSECGKAFRQRASLIRHWKIHTGERP

SEQ ID NO: 7323 - protein, 377 aa, Homo sapiens
MEDEEIPFEQSFSIGMSQIRIPKGGPSTQKAYPCGTCGLVLKDILHLAEHQETHPGQKPYMCVLCGKQFCFSANLHQHQKQHSGEKPFRSDKSRPFLLNNCAVQSMEMSFVTGEACKDFLASSSIFEHHAPHNEWKPHSNTKCEEASHCGKRHYKCSECGKTFSRKDSLVQHQRVHTGERPYECGECGKTFSRKPILAQHQRIHTGEMPYECGICGKVFNHSSNLIVHQRVHTGARPYKCSECGKAYSHKSTLVQHESIHTGERPYECSECGKYFGHKYRLIKHWSVHTGARPYECIACGKFFSQSSDLIAHQRVHNGEKPYVCSECGKAFSHKHVLVQHHRIHTGERPYKCSECGKAFRQRASLIRHWKIHTGERP

SEQ ID NO: 7324 - protein, 442 aa, Homo sapiens
MAAATLRDPAQQGYVTFEDVAVYFSQEEWRLLDDAQRLLYRNVMLENFTLLASLGLASSKTHEITQLESWEEPFMPAWEVVTSAILRGSWQGAKAEAAAEQSASVEVPSSNVQQHQKQHCGEKPLKRQEGRVPVLRSCRVHLSEKSLQSREVGKDLLTSSGVLKHQVTHTGEKSHRSSKSREAFHAGKRHYKCSECGKAFGQKYLLVQHQRLHTGEKPYECSECGKLFSHKSNLFIHQIVHTGERPYGCSDCGKSFSRNADLIQHQRVHTGEKPFTCSECGKAFRHNSTLVQHHRIHTGVRPYECSECGKLFSFNSSLMKHQRVHTGERPYKCSECGKFYSHKSSLINHWRVHTGERPYECSECGKFFSQSSSLMQHRKVHTGEKPFKCNECGRFFSENSSLVKHQRVHTGAKPYECRECGKFFRHSSSLVKHRRIHTGEIQ

SEQ ID NO: 7325 - protein, 140 aa, Homo sapiens
GSVAAPRVARALSSVVVSPPQAPMAAATLRDPAQQGYVTFEDVAVYFSQEEWRLLDDAQRLLYRNVMLENFTLLASLGLASSKTHEITQLESWEEPFMPAWEVVTSAILRVWLRNRSANLLTQIFFPNRQPQVAPEQGRE

SEQ ID NO: 7326 - protein, 483 aa, Homo sapiens
MWLGTSGKSGLPGHCLENPLQECHPAQLEEWALKGISRPSVISQPEQKEEPWVLPLQNFEARKIPRESHTDCEHQVAKLNQDNSETAEQCGTSSERTNKDLSHTLSWGGNWEQGLELEGQHGTLPGEGQLESFSQERDLNKLLDGYVGEKPMCAECGKSFNQSSYLIRHLRTHTGERPYTCIECGKGFKQSSDLVTHRRTHTGEKPYQCKGCEKKFSDSSTLIKHQRTHTGERPYECPECGKTFGRKPHLIMHQRTHTGEKPYACLECHKSFSRSSNFITHQRTHTGVKPYRCNDCGESFSQSSDLIKHQRTHTGERPFKCPECGKGFRDSSHFVAHMSTHSGERPFSCPDCHKSFSQSSHLVTHQRTHTGERPFKCENCGKGFADSSALIKHQRIHTGERPYKCGECGKSFNQSSHFITHQRIHLGDRPYRCPECGKTFNQRSHFLTHQRTHTGEKPFHCSKCNKSFRQKAHLLCHQNTHLI

SEQ ID NO: 7327 - protein, 79 aa, Homo sapiens
MWLGTSGKSGLPGHCLENPLQECHPAQLEEWALKGISRPSVISQPEQKEEPWVLPLQNFEARKIPRESHTDCEHQVAKL

SEQ ID NO: 7328 - protein, 537 aa, Homo sapiens
MESGLAGNGTGAGLVMKVKQEKPERLLQTLAPQAMLVEKDKENIFQQHRGLPPRQTMGRPRALGGQEESGSPRWAPPTEQDAGLAGRAPGSASGPLSPSLSSGEGHFVCLDCGKRFSWWSSLKIHQRTHTGEKPYLCGKCGKSFSQKPNLARHQRHHTGERPFCCPECARRFSQKQHLLKHQKTHSRPATHSCPECERCFRHQVGLRIHQRAHARDRQGSRAGLHELIQDAAARRACRLQPGPPRGRPEWAWLGLCQGWWGQPGARAAVSGPEGPGEPRQFICNECGKSFTWWSSLNIHQRIHTGERPYACPECGRRFSQKPNLTRHLRNHTGERPHPCPHCGRGFRQKQHLLKHLRTHLPGAQAAPCPSCGKSCRSRAALRAHQRAHAVAEPAVPAGEPGDQPQAEAIPGLAARPRSSQRSPGARDTLWGRGQAGLAGPGEPRQFICNECGKSFSWWSALTIHQRIHTGERPYPCPECGRRFSQKPNLTRHRRNHTGERPYLCPACGRGFSQKQHLLKHQRVHRAAPACSPKEEAR

SEQ ID NO: 7329 - protein, 144 aa, Homo sapiens
MESGLAGNGTGAGLVMKVKQEKPERLLQTLAPQAMLVEKDKENIFQQHRGLPPRQTMGRPRALGGQEESGSPRWAPPTEQDAGLAGRAPGSASGPLSPSLSSGEGHFVCLDCGKRFSWWSSLKIHQRTHTGEKPYLCGKCGKSF

SEQ ID NO: 7330 - protein, 166 aa, Homo sapiens
MESGLAGNGTGAGLVMKVKQEKPERLLQTLAPQAMLVEKDKENIFQQHRGLPPRQTMGRPRALGGQEESGSPRWAPPTEQDAGLAGRAPGSASGPLSPSLSSGEGHFVCLDCGKRFSWWSSLKIHQRTHTGEKPYLCGKCGKSFSQKPNLARHQRHHTGERPFCCP

SEQ ID NO: 7331 - protein, 518 aa, Homo sapiens
MAAAALRPPAQGTVTFEDVAVNFSQEEWSLLSEAQRCLYHDVMLENLTLISSLGCWYGAKDETPSKQTLSIQQESPLRTHWTGVCTKKVHLWGMCGPLLGDILHQGTQHNQKLNGFGAYEKKLDDDANHHQDQKQHIGEKSYRSNAKGTSFVKNCKFHMSHEPFIFHEVGKDFLSSLRLLQQEDIHTSGKSNFETKHGIPLQGGKTHYICGESTIPFSNKHSLVLHQRLLPREGPYVCSDSGKFTSKSNSFNNHQGVRTGKRPYQCGQCDESFWYKAHLTEHQRVHTGERPYECGECDKSFSHKHSLVDHQRVHTGERPYECDECGKSFSHKRSLVHHQRVHTGERPYQCGECGKSFNHKCNLIQHQRVHTGERPFECTACGKLFRSNSHLKEHQRVHTGERPYECKECRKSFRYKSHLTEHQRVHTGERPYECRECGKCFHQKGSLIQHQQIHSGERPHECGECGKCFHQKGSLIRHQQIHSGERPHECGECGKCFRQKGNLIKHQRVHTGERHHEC

SEQ ID NO: 7332 - protein, 687 aa, Homo sapiens
MLENYENLASVGHHLFQPSVIYWLEQEEELRAGRRAVLQEWRLKTKGPALRQDRSWFRASNETQTARSHNGGQLCDRTQCGEAFSEHSGLSTHVRTQNTGDSCVSNHYERDFFIPCQKTLFKIGEQFSVLGQCGKAFSSTPNVVSQQACTRDRSLDYSSCGEVFLNQSYLQARAGSHNGEETWKWKPCGKALTHSMGCATPVEMHAVRNPHVCRECGKAFRYTAYLTGRVQVHPGEKPCELEECGKASPVSSSLTQHVRIHAAEKPCECKECGKAFTGLSGLSKHVQTDPGQKPYECKDCGKACGGFYLLNEHGKTHTREKPFACVVCGKYFRNSSCLNNHVRIHTGIKPYTCSYCGKAFTVRCGLTRHVRTHTGEKPYTCKDCGKAFCTSSGLTEHVRTHTGEKPYECKDCGKSFTVSSSLTEHARIHTGEKPYECKQCGKAFTGRSGLTKHMRTHTGEKPYECKDCGKAYNRVYLLNEHVKTHTEEKPFICTVCRKSFRNSSCLNKHIQIHTGIKPYECKDCGKTFTVSSSLTEHIRTHTGEKPYECKVCGKAFTTSSHLIVHIRTHTGEKPYICKECGKAFASSSHLIEHRRTHTGEKPYICNECGKAFRASSHLHKHGRIHTGQKPYKCKECGKAYNRFYLLKEHLKTYTEEQVFVCKDCGKSFKNSSCLNHHTQIHTDEKPF

SEQ ID NO: 7333 - protein, 729 aa, Homo sapiens
MAAPDLAHGGHVSRDSVCLHEEQTQAAGMVAGWLINCYQDAVTFDDVAVDFTQEEWTLLDPSQRDLYRDVMLENYENLASVEWRLKTKGPALRQDRSWFRASNETQTARSHNGGQLCDRTQCGEAFSEHSGLSTHVRTQNTGDSCVSNHYERDFFIPCQKTLFKIGEQFSVLGQCGKAFSSTPNVVSQQACTRDRSLDYSSCGEVFLNQSYLQARAGSHNGEETWKWKPCGKALTHSMGCATPVEMHAVRNPHVCRECGKAFRYTAYLTGRVQVHPGEKPCELEECGKASPVSSSLTQHVRIHAAEKPCECKECGKAFTGLSGLSKHVQTDPGQKPYECKDCGKACGGFYLLNEHGKTHTREKPFACVVCGKYFRNSSCLNNHVRIHTGIKPYTCSYCGKAFTVRCGLTRHVRTHTGEKPYTCKDCGKAFCTSSGLTEHVRTHTGEKPYECKDCGKSFTVSSSLTEHARIHTGEKPYECKQCGKAFTGRSGLTKHMRTHTGEKPYECKDCGKAYNRVYLLNEHVKTHTEEKPFICTVCRKSFRNSSCLNKHIQIHTGIKPYECKDCGKTFTVSSSLTEHIRTHTGEKPYECKVCGKAFTTSSHLIVHIRTHTGEKPYICKECGKAFASSSHLIEHRRTHTGEKPYICNECGKAFRASSHLHKHGRIHTGQKPYKCKECGKAYNRFYLLKEHLKTYTEEQVFVCKDCGKSFKNSSCLNHHTQIHTDEKPF

SEQ ID NO: 7334 - protein, 641 aa, Homo sapiens
MVHGSVTFRDVAIDFSQEEWECLQPDQRTLYRDVMLENYSHLISLGSSISKPDVITLLEQEKEPWMVVRKETSRRYPDLELKYGPEKVSPENDTSEVNLPKQVIKQISTTLGIEAFYFRNDSEYRQFEGLQGYQEGNINQKMISYEKLPTHTPHASLICNTHKPYECKECGKYFSRSANLIQHQSIHTGEKPFECKECGKAFRLHIQFTRHQKFHTGEKPFECNECGKAFSLLTLLNRHKNIHTGEKLFECKECGKSFNRSSNLVQHQSIHSGVKPYECKECGKGFNRGAHLIQHQKIHSNEKPFVCKECGMAFRYHYQLIEHCQIHTGEKPFECKECGKAFTLLTKLVRHQKIHTGEKPFECRECGKAFSLLNQLNRHKNIHTGEKPFECKECGKSFNRSSNLVQHQSIHAGIKPYECKECGKGFNRGAHLIQHQKIHSNEKPFVCRECEMAFRYHCQLIEHSRIHTGDKPFECQDCGKAFNRGSSLVQHQSIHTGEKPYECKECGKAFRLYLQLSQHQKTHTGEKPFECKECGKFFRRGSNLNQHRSIHTGKKPFECKECGKAFRLHMHLIRHQKLHTGEKPFECKECGKAFRLHMQLIRHQKLHTGEKPFECKECGKVFSLPTQLNRHKNIHTGEKAS

SEQ ID NO: 7335 - protein, 158 aa, Homo sapiens
MGRSPRKIDQFCNSSNMVHGSVTFRDVAIDFSQEEWECLQPDQRTLYRDVMLENYSHLISLGSSISKPDVITLLEQEKEPWMVVRKETSRRYPDLELKYGPEKVSPENDTSEVNLPKQISSLASKPSFTAIHIQRRIHCRICIAFGYLSLVYCSLEIL

SEQ ID NO: 7336 - protein, 115 aa, Homo sapiens
MVHGSVTFRDVAIDFSQEEWECLQPDQRTLYRDVMLENYSHLISLGSSISKPDVITLLEQEKEPWMVVRKETSRRYPDLELKYGPEKVSPENDTSEVNLPKQVIKQKKGKKKKKK

SEQ ID NO: 7337 - protein, 641 aa, Homo sapiens; identical to SEQ ID NO: 7334

SEQ ID NO: 7338 - protein, 642 aa, Homo sapiens
MVHGSVTFRDVAIDFSQEEWECLQPDQRTLYRDVMLENYSHLISLAGSSISKPDVITLLEQEKEPWMVVRKETSRRYPDLELKYGPEKVSPENDTSEVNLPKQVIKQISTTLGIEAFYFRNDSEYRQFEGLQGYQEGNINQKMISYEKLPTHTPHASLICNTHKPYECKECGKYFSRSANLIQHQSIHTGEKPFECKECGKAFRLHIQFTRHQKFHTGEKPFECNECGKAFSLLTLLNRHKNIHTGEKLFECKECGKSFNRSSNLVQHQSIHSGVKPYECKECGKGFNRGAHLIQHQKIHSNEKPFVCKECGMAFRYHYQLIEHCQIHTGEKPFECKECGKAFTLLTKLVRHQKIHTGEKPFECRECGKAFSLLNQLNRHKNIHTGEKPFECKECGKSFNRSSNLVQHQSIHAGIKPYECKECGKGFNRGAHLIQHQKIHSNEKPFVCRECEMAFRYHCQLIEHSRIHTGDKPFECQDCGKAFNRGSSLVQHQSIHTGEKPYECKECGKAFRLYLQLSQHQKTHTGEKPFECKECGKFFRRGSNLNQHRSIHTGKKPFECKECGKAFRLHMHLIRHQKLHTGEKPFECKECGKAFRLHMQLIRHQKLHTGEKPFECKECGKVFSLPTQLNRHKNIHTGEKAS

SEQ ID NO: 7339 - protein, 641 aa, Homo sapiens; identical to SEQ ID NO: 7334

SEQ ID NO: 7340 - protein, 685 aa, Homo sapiens
MPAYTHASPIHNTHKPYECKECGKYFSCGSNLIQHQSIHTGEKPYKCKECGKAFQLHIQLTRHQKFHTGEKTFECKECGKAFNLPTQLNRHKNIHTVKKLFECKECGKSFNRSSNLTQHQSIHAGVKPYQCKECGKAFNRGSNLIQHQKIHSNEKPFVCRECEMAFRYHYQLIEHCRIHTGEKPFECKECRKAFTLLTKLVRHQKIHMGEKPFECRECGKAFSLLNQLNRHKNIHTGEKPFECKECGKSFNRSSNLIQHQSIHADVKPYECKECGKGFNRGANLIQHQKIHSNEKPFVCRECEMAFRYHYQLIQHCQIHTGGKPFECKECGKAFSLLTQLARHKNIHTGEKPFECKDCGKAFNRGSNLVQHQSIHTGEKPYECKECGKAFRLHLQLSQHEKTHTGEKPFECKECGKFFRRGSNLNQHRSIHTGKKPFECKECGKAFRLHMHLIRHQKFHTGEKPFECKECGKAFSLHTQLNHHKNIHTGEKPFKCKECGKSFNRVSNLVQHQSIHAGVKPYECKECGKGFSRVSNLIQHQKTHSSAKPFVCKECRKTFRYHYQLTEHYRIHTGEKPFECKECGKAFGLLTQLAQHQIIHTGEKPFKCKECGKAFNRGSNLVQPQSIHTGEKPYECKECGKAFRLHLQLSLHQKLVQVRNPLNVRNVGQPSDISSNLLNIRKFILG

SEQ ID NO: 7341 - protein, 833 aa, Homo sapiens
MVHGSVTFRDVAIDFSQEEWECLQPDQRTLYRDVMLENYSHLISLGSSISKPDVITLLEQEKEPWIVVSKETSRWYPDLESKYGPEKISPENDIFEINLPKHVIKQISKTLGLEAFYFRNDSEYRSRFEGRQGHQEGYINQKIISYEEMPAYTHASPIHNTHKPYECKECGKYFSCGSNLIQHQSIHTGEKPYKCKECGKAFQLHIQLTRHQKFHTGEKTFECKECGKAFNLPTQLNRHKNIHTVKKLFECKECGKSFNRSSNLTQHQSIHAGVKPYQCKECGKAFNRGSNLIQHQKIHSNEKPFVCRECEMAFRYHYQLIEHCRIHTGEKPFECKECRKAFTLLTKLVRHQKIHMGEKPFECRECGKAFSLLNQLNRHKNIHTGEKPFECKECGKSFNRSSNLIQHQSIHADVKPYECKECGKGFNRGANLIQHQKIHSNEKPFVCRECEMAFRYHYQLIQHCQIHTGGKPFECKECGKAFSLLTQLARHKNIHTGEKPFECKDCGKAFNRGSNLVQHQSIHTGEKPYECKECGKAFRLHLQLSQHEKTHTGEKPFECKECGKFFRRGSNLNQHRSIHTGKKPFECKECGKAFRLHMHLIRHQKFHTGEKPFECKECGKAFSLHTQLNHHKNIHTGEKPFKCKECGKSFNRVSNLVQHQSIHAGVKPYECKECGKGFSRVSNLIQHQKTHSSAKPFVCKECRKTFRYHYQLTEHYRIHTGEKPFECKECGKAFGLLTQLAQHQIIHTGEKPFKCKECGKAFNRGSNLVQPQSIHTGEKPYECKECGKAFRLHLQLSLHQKLVQVRNPLNVRNVGQPSDISSNLLNIRKFILG

SEQ ID NO: 7342 - protein, 205 aa, Homo sapiens
MNTFQASVSFQDVTVEFSQEEWQHMGPVERTLYRDVMLENYSHLVSVGYCFTKPELIFTLEQGEDPWLLEKEKGFLSRNSPEDSQPDEISEKSPENQGKHLLQVLFTNKLLTTEQEISGKPHNRDINIFRARMMPCKCDIAGSACQGLSLMAPHCQYSKEKAHERNVCDKWLISIKDGRTNTQEKSFAYSKIVKTLHHKEEVIQH

SEQ ID NO: 7343 - protein, 699 aa, Homo sapiens
MNTFQASVSFQDVTVEFSQEEWQHMGPVERTLYRDVMLENYSHLVSVGYCFTKPELIFTLEQGEDPWLLEKEKGFLSRNSPEDSQPDEISEKSPENQGKHLLQVLFTNKLLTTEQEISGKPHNRDINIFRARMMPCKCDIAGSACQGLSLMAPHCQYSKEKAHERNVCDKWLISIKDGRTNTQEKSFAYSKIVKTLHHKEEVIQHQTIQTLGQDFEYNESRKAFLEKAALVTSNSTHPKGKSYNFNKFGENKYDKSTFIIPQNMNPEKSHYEFNDTGNCFCRITHKTLTGGKSFSQKSHIREHHRVHIGVKPFEYGKSFNRNSTLPVHQRTHATDKYSDYHPCTETFSYQSTFSVHQKVHIRAKPYEYNECGKSCSMNSHLIWPQKSHTGEKPYECPECGKAFSEKSRLRKHQRTHTGEKPYKCDGCDKAFSAKSGLRIHQRTHTGEKPFECHECGKSFNYKSILIVHQRTHTGEKPFECNECGKSFSHMSGLRNHRRTHTGERPYKCDECGKAFKLKSGLRKHHRTHTGEKPYKCNQCGKAFGQKSQLRGHHRIHTGEKPYKCNHCGEAFSQKSNLRVHHRTHTGEKPYQCEECGKTFRQKSNLRGHQRTHTGEKPYECNECGKAFSEKSVLRKHQRTHTGEKPYNCNQCGEAFSQKSNLRVHQRTHTGEKPYKCDKCGRTFSQKSSLREHQKAHPGD

SEQ ID NO: 7344 - protein, 567 aa, Homo sapiens
MMPCKCDIAGSACQGLSLMAPHCQYSKEKAHERNVCDKWLISIKDGRTNTQEKSFAYSKIVKTLHHKEEVIQHQTIQTLGQDFEYNESRKAFLEKAALVTSNSTHPKGKSYNFNKFGENKYDKSTFIIPQNMNPEKSHYEFNDTGNCFCRITHKTLTGGKSFSQKSHIREHHRVHIGVKPFEYGKSFNRNSTLPVHQRTHATDKYSDYHPCTETFSYQSTFSVHQKVHIRAKPYEYNECGKSCSMNSHLIWPQKSHTGEKPYECPECGKAFSEKSRLRKHQRTHTGEKPYKCDGCDKAFSAKSGLRIHQRTHTGEKPFECHECGKSFNYKSILIVHQRTHTGEKPFECNECGKSFSHMSGLRNHRRTHTGERPYKCDECGKAFKLKSGLRKHHRTHTGEKPYKCNQCGKAFGQKSQLRGHHRIHTGEKPYKCNHCGEAFSQKSNLRVHHRTHTGEKPYQCEECGKTFRQKSNLRGHQRTHTGEKPYECNECGKAFSEKSVLRKHQRTHTGEKPYNCNQCGEAFSQKSNLRVHQRTHTGEKPYKCDKCGRTFSQKSSLREHQKAHPGD

SEQ ID NO: 7345 - protein, 323 aa, Homo sapiens
MAAARPEAQSRSSPTPESRSQEPLDLVLVPDDCRPGTPPSDLIEIQVVKVTDTTLVPEPPEPGSFHCALCPAAFRLVSELLFHEHGHLAGAEGGGQGGDPSRCHVCGHSCPGPASLRAHYSLHTGERPYRCALCPRAFKALAPLLRHQHRHGVEPGTSRRPPDTAAVAEQRPGVAPERAEVVMAAAAAGAAVGKPFACRFCAKPFRRSSDMRDHERVHTGERPYHCGICGKGFTQSSVLSGHARIHTGERPFRCTLCDRTFNNSSNFRKHQRTHFHGPGPGLGDSGGQLGSSAAEGSGSGCGVGDPAEEGRGETAKVKVEADQ

SEQ ID NO: 7346 - protein, 405 aa, Homo sapiens
MGPPLAPRPAHVPGEAGPRRTRESRPGAVSFADVAVYFSPEEWECLRPAQRALYRDVMRETFGHLGALGFSVPKPAFISWVEGEVEAWSPEAQDPDGESSAAFSRGQGQEAGSRDGNEEKERLKKCPKQKEVAHEVAVKEWWPSVACPEFCNPRQSPMNPWLKDTLTRRLPHSCPDCGRNFSYPSLLASHQRVHSGERPFSCGQCQARFSQRRYLLQHQFIHTGEKPYPCPDCGRRFRQRGSLAIHRRAHTGEKPYACSDCKSRFTYPYLLAIHQRKHTGEKPYSCPDCSLRFAYTSLLAIHRRIHTGEKPYPCPDCGRRFTYSSLLLSHRRIHSDSRPFPCVECGKGFKRKTALEAHRWIHRSCSERRAWQQAVVGRSEPIPVLGGKDPPVHFRHFPDIFQECG

SEQ ID NO: 7347 - protein, 370 aa, Homo sapiens
MPAASAEGPVPGRDAGDLRPPGRAGRAHCFSFAGFSVPKPAFISWVEGEVEAWSPEAQDPDGESSAAFSRGQGQEAGSRDGNEEKERLKKCPKQKEVAHEVAVKEWWPSVACPEFCNPRQSPMNPWLKDTLTRRLPHSCPDCGRNFSYPSLLASHQRVHSGERPFSCGQCQARFSQRRYLLQHQFIHTGEKPYPCPDCGRRFRQRGSLAIHRRAHTGEKPYACSDCKSRFTYPYLLAIHQRKHTGEKPYSCPDCSLRFAYTSLLAIHRRIHTGEKPYPCPDCGRRFTYSSLLLSHRRIHSDSRPFPCVECGKGFKRKTALEAHRWIHRSCSERRAWQQAVVGRSEPIPVLGGKDPPVHFRHFPDIFQECG

SEQ ID NO: 7348 - protein, 390 aa, Homo sapiens
MGPPLAPRPAHVPGEAGPRRTRESRPGAVSFADVAVYFSPEEWECLRPAQRALYRDVMRETFGHLGALGFSVPKPAFISWVEGEVEAWSPEAQDPDGSRDGNEEKERLKKCPKQKEVAHEVAVKEWWPSVACPEFCNPRQSPMNPWLKDTLTRRLPHSCPDCGRNFSYPSLLASHQRVHSGERPFSCGQCQARFSQRRYLLQHQFIHTGEKPYPCPDCGRRFRQRGSLAIHRRAHTGEKPYACSDCKSRFTYPYLLAIHQRKHTGEKPYSCPDCSLRFAYTSLLAIHRRIHTGEKPYPCPDCGRRFTYSSLLLSHRRIHSDSRPFPCVECGKGFKRKTALEAHRWIHRSCSERRAWQQAVVGRSEPIPVLGGKDPPVHFRHFPDIFQECG

SEQ ID NO: 7349 - protein, 745 aa, Homo sapiens
MRSNYETLVSLDDGLPKPELISWIEHGGEPFRKWRESQKSGNIICSSVDMHFDPGFEEQLFWGSQQAMNSGKTKSHFQLDPESQCSFGSFVSFRPDQGITLGSPQRHDARAPPPLACGPSESTLKEGIPGPRNLDLPGLWDVPAWESTQHPWPVCGESCWENNHLVMHQRGHSKDRTRRAWEKFNKRAETQMPWSSPRVQRHFRCGVCGKSFRRKLCLLRHLAAHTGRGPFRNADGEMCFRHELTHPSHRLPQQGEKPAQCTPCGKRSLPVDSTQARRCQHSREGPASWREGRGASSSVHSGQKPGSRLPQEGNSHQEGDTEALQHGAEGPCSCSECGERSPMSARLASPCRAHTGEKPFQCAHCTKRFRLRRLLQVHQHAHGGERPFSCRKCGKGFAKQCKLTEHIRVHSGEKPFRCAKCGRNFRQRGQLLRHQRLHTDEKPFQCPECGLSFRLESMLRAHRLRHGGERPFSCSECGRGFTHQCKLREHLRVHSGERPFQCLKCDKRFRLKGILKAHQHTHSKERPFSCGECGKGFTRQSKLTEHLRVHSGERPFQCPECNRSFRLKGQLLSHQRLHTGERPFQCPECDKRYRVKADMKAHQLLHSGEMPFSCECGKGFVKHSKLIEHIRTHTGEKPFQCPKCDKSFRLKAQLLSHQGLHTGERPFHCPECDKNFRERGHMLRHQRIHRPERPFACGDCGKGFIYKSKLAEHIRVHTKSCPAPNELDIKKRLSQLFAMIEADWS

SEQ ID NO: 7350 - protein, 782 aa, Homo sapiens
MAEPPRLPLTFEDVAIYFSEQEWQDLEAWQKELYKHVMRSNYETLVSLDDGLPKPELISWIEHGGEPFRKWRESQKSGNIICSSVDMHFDPGFEEQLFWGSQQAMNSGKTKSHFQLDPESQCSFGSFVSFRPDQGITLGSPQRHDARAPPPLACGPSESTLKEGIPGPRNLDLPGLWDVPAWESTQHPWPVCGESCWENNHLVMHQRGHSKDRTRRAWEKFNKRAETQMPWSSPRVQRHFRCGVCGKSFRRKLCLLRHLAAHTGRGPFRNADGEMCFRHELTHPSHRLPQQGEKPAQCTPCGKRSLPVDSTQARRCQHSREGPASWREGRGASSSVHSGQKPGSRLPQEGNSHQEGDTEALQHGAEGPCSCSECGERSPMSARLASPCRAHTGEKPFQCAHCTKRFRLRRLLQVHQHAHGGERPFSCRKCGKGFAKQCKLTEHIRVHSGEKPFRCAKCGRNFRQRGQLLRHQRLHTDEKPFQCPECGLSFRLESMLRAHRLRHGGERPFSCSECGRGFTHQCKLREHLRVHSGERPFQCLKCDKRFRLKGILKAHQHTHSKERPFSCGECGKGFTRQSKLTEHLRVHSGERPFQCPECNRSFRLKGQLLSHQRLHTGERPFQCPECDKRYRVKADMKAHQLLHSGEMPFSCECGKGFVKHSKLIEHIRTHTGEKPFQCPKCDKSFRLKAQLLSHQGLHTGERPFHCPECDKNFRERGHMLRHQRIHRPERPFACGDCGKGFIYKSKLAEHIRVHTKSCPAPNELDIKKRLSQLFAMIEADWS

SEQ ID NO: 7351 - protein, 351 aa, Homo sapiens
MHFDPGFEEQLFWGSQQAMNSGKTKSHFQLDPESQCSFGSFVSFRPDQGITLGSPQRHDARAPPPLACGPSESTLKEGIPGPRNLDLPGLWDVPAWESTQHPWPVCGESCWENNHLVMHQRGHSKDRTRRAWEKFNKRAETQMPWSSPRVQRHFRCGVCGKSFRRKLCLLRHLAAHTGRGPFRNADGEMCFRHELTHPSHRLPQQGEKPAQCTPCGKRSLPVDSTQARRCQHSREGPASWREGRGASSSVHSGQKPGSRLPQEGNSHQEGDTEALQHGAEGPCSCSECGERSPMSARLASPCRAHTGEKPFQCAHCTKRFRLRRLLQVHQHAHGGETVLLQEVWQGLRQAV

SEQ ID NO: 7352 - protein, 383 aa, Homo sapiens
MELREEAWSPGPLDSEDQQMASHENPVDILIMDDDDVPSWPPTKLSPPQSAPPAGPPPRPRPPAPYICNECGKSFSHWSKLTRHQRTHTGERPNACADCGKTFSQSSHLVQHRRIHTGEKPYACLECGKRFSWSSNLMQHQRIHTGEKPYTCPDCGRSFTQSKSLAKHRRSHSGLKPFVCPRCGRGFSQPKSLARHLRLHPELSGPGVAAKVLAASVRRAKGPEEAVAADGEIAIPVGDGEGIIVVGAPGEGAAAAAAMAGAGAKAAGPRSRRAPAPKPYVCLECGKGFGHGAGLLAHQRAQHGDGLGAAGGEEPAHICVECGEGFVQGAALRRHKKIHAVGAPSVCSSCGQSYYRAGGEEEDDDDDEAAGGRCPECRGGEGR

SEQ ID NO: 7353 - protein, 615 aa, Homo sapiens
MNVRILRRHLVFPFIFIVIKELTLEGTPMNVNNLENPLDAPQNFKCMQGLSVEKPYKCKKCEKAFNNLSSFQIHERMHRGGKYHACKGSGNTYRFSGFYHRHKMPHAGGKFYGCKKCGKAFISFCAFRYHQRTHTKEKPYACKQCGKAYISYTSFQYHQLNHTGAKCYECKQCGKGFDLPNSIRYHEMTHTGEKPHECKQCGKTFRCASSLRIHGRTHTGEKPYECKQCGKVSRYWSGLQVHEVTHIGKKLYECKECGKSYYSSGSFLNHKRIHTREKSYECKECGKAFGNPISFQKHEGSHRKWKPYECKECGKVFSFSSSLRRHERTHTEKLCECKQHGKGFFHRSCPRHMKIDTGEILHKRKIRGKVFHSPSSFQTCERSHTREKRYKCKQCGKPFIYFNAFQRHQRSHTGENPYECKQCGKACISSTAFQCRELSHTGAKRYKCKQCGKGFNLPSSIRYHEMTHTGEKPYECKQCGRAFRSASHLRTHERTHIGEKPYECKQCGKVYRYWSGLRIHGLTHIGKKPYEFNDRGKSFYSSNFFLNHKRVHTRVKTYECKECGKAFDNPTSFQKHEGSHRKGKSYECKECGKVFSFSRSFRRYERAHTGEKPCE

SEQ ID NO: 7354 - protein, 259 aa, Homo sapiens
RSHTREKRYKCKQCGKPFIYFNAFQRHQRSHTGENPYECKQCGKACISSTAFQCRELSHTGAKRYKCKQCGKGFNLPSSIRYHEMTHTGEKPYECKQCGRAFRSASHLRTHERTHIGEKPYECKQCGKVYRYWSGLRIHGLTHIGKKPYECKECGKAFDNPTSFQKHEGSHRKGKSYECKECGKVFSFSRSFRRHGRMHTGEKPYECKNCGKAFTSAKSLQNHGRTHTGEKPCECKQCGKAFICSSSCQRHEETHSVNM

SEQ ID NO: 7355 - protein, 425 aa, Homo sapiens
MFPPARGKELLSFEDVAMYFTREEWGHLNWGQKDLYRDVMLENYRNMVLLGFQFPKPEMICQLENWDEQWILDLPRTGNRKASGSACPGSEARHKMKKLTPKQKFSEDLESYKISVVMQESAEKLSEKLHKCKEFVDSCRLTFPTSGDEYSRGFLQNLNLIQDQNAQTRWKQGRYDEDGKPFNQRSLLLGHERILTRAKSYECSECGKVIRRKAWFDQHQRIHFLENPFECKVCGQAFRQRSALTVHKQCHLQNKPYRCHDCGKCFRQLAYLVEHKRIHTKEKPYKCSKCEKTFSQNSTLIRHQVIHSGEKRHKCLECGKAFGRHSTLLCHQQIHSKPNTHKCSECGQSFGRNVDLIQHQRIHTKEEFFQCGECGKTFSFKRNLFRHQVIHTGSQPYQCVICGKSFKWHTSFIKHQGTHKGQIST

SEQ ID NO: 7356 - protein, 62 aa, Homo sapiens
MFPPARGKELLSFEDVAMYFTREEWGHLNWGQKDLYRDVMLENYRNMVLLVYFQFDAAIPLC

SEQ ID NO: 7357 - protein, 636 aa, Homo sapiens
MAHLMMFRDVAVDFSQEEWECLDLEQRDLYRDVMLENYSNMVSLGFCIYQPEAFSLLEKGKEPWKILRDETRGPCPDMQSRCQTKKLLPKNGIFEREIAQLEIMRICKNHSLDCLCFRGDWEGNTQFQTLQDNQEECFKQVIRTCEKRPTFNQHTVFNLHQRLNTGDKLNEFKELGKAFISGSDHTQHQLIHTSEKFCGDKECGNTFLPDSEVIQYQTVHTVKKTYECKECGKSFSLRSSLTGHKRIHTGEKPFKCKDCGKAFRFHSQLSVHKRIHTGEKSYECKECGKAFSCGSDLTRHQRIHTGEKPYECNECRKAFSQRSHLIKHQRIHTGEKPYECKECGKAFTRGSHLTQHQRIHTGEKSHECKECGKAFIRGSNLAQHQNVHVGRKPYKCEKCGKAYIWSSHLARHQRIHTGRKPYECKQCGKTFTWASYLAQHEKIHNERKSYECKECGKTFLHGSEFNRHQKIHTGERNYECKECGKTFFRGSELNRHQKIHTGKRPYECEECGKAFLWGSQLTRHQRMHTGEEPYVCKECGKSFIWGSQLTRHKKIHTDAEPYGCKKSSHIFSHHSYFTEQKIHNSANLCEWTDYGNTFSHESNFAQHQNIYTFEKSYEFKDFEKAFSSSSHFISLL

SEQ ID NO: 7358 - protein, 135 aa, Homo sapiens
MAHLMMFRDVAVDFSQEEWECLDLEQRDLYRDVMLENYSNMVSLGFCIYQPEAFSLLEKGKEPWKILRDETRGPCPDMQSRCQTKKLLPKNGIFEREIAQLEIMRICKNHSLDCLCFRGDWEGNTQFQTLQDNQE

SEQ ID NO: 7359 - protein, 49 aa, Homo sapiens
MAHLMMFRDVAVDFSQEEWECLDLEQRDLYRDVMLENYSNMVSLGFCIY

SEQ ID NO: 7360 - protein, 179 aa, Homo sapiens
MAHLMMFRDVAVDFSQEEWECLDLEQRDLYRDVMLENYSNMVSLGFCIYQPEAFSLLEKGKEPWKILRDETRGPCPDMQSRCQTKKLLPKNGIFEREIAQLEIMRICKNHSLDCLCFRGDWEGNTQFQTLQDNQEECFKQVIRTCEKRPTFNQHTVFNLHQRLNTGDKLNEFKELGKAF

SEQ ID NO: 7361 - protein, 576 aa, Homo sapiens
MDSVAFEDVSVSFSQEEWALLAPSQKKLYRDVMQETFKNLASIGEKWEDPNVEDQHKNQGRNLRSHTGERLCEGKEGSQCAENFSPNLSVTKKTAGVKPYECTICGKAFMRLSSLTRHMRSHTGYELFEKPYKCKECEKAFSYLKSFQRHERSHTGEKPYKCKQCGKTFIYHQPFQRHERTHIGEKPYECKQCGKALSCSSSLRVHERIHTGEKPYECKQCGKAFSCSSSIRVHERTHTGEKPYACKECGKAFISHTSVLTHMITHNGDRPYKCKECGKAFIFPSFLRVHERIHTGEKPYKCKQCGKAFRCSTSIQIHERIHTGEKPYKCKECGKSFSARPAFRVHVRVHTGEKPYKCKECGKAFSRISYFRIHERTHTGEKPYECKKCGKTFNYPLDLKIHKRNHTGEKPYECKECAKTFISLENFRRHMITHTGDGPYKCRDCGKVFIFPSALRTHERTHTGEKPYECKQCGKAFSCSSYIRIHKRTHTGEKPYECKECGKAFIYPTSFQGHMRMHTGEKPYKCKECGKAFSLHSSFQRHTRIHNYEKPLECKQCGKAFSVSTSLKKHMRMHNR

SEQ ID NO: 7362 - protein, 477 aa, Homo sapiens
MDSVAFEDVSVSFSQEEWALLAPSQKKLYRDVMQETFKNLASIGEKWEDPNVEDQHKNQGRNLRSHTGERLCEGKEGSQCAENFSPNLSVTKKTAGVKPYECTICGKAFMRLSSLTRHMRSHTGYELFEKPYKCKESGEKPYKCKQCGKTFIYHQPFQRHERTHIGEKPYECKQCGKALSCSSSLRVHERIHTGEKPYECKQCGKAFSCSSSIRVHERTHTGEKPYACKECGKAFISHTSVLTHMITHNGDRPYKCKECGKAFIFPSFLRVHERIHTGEKPYKCKQCGKAFRCSTSIQIHERIHTGEKPYKCKECGKSFSARPAFRVHVRVHTGEKPYKCKECGKAFSRISYFRIHERTHTGEKPYECKKCGKTFNYPLDLKIHKRNHTGEKPYECKDCGKVFIFPSALRTHERTHTGEKPYECKQCGKAFSCSSYIRIHKRTHTGEKPYECKECGKAFIYPTSFQGHMRMHTGEKP

SEQ ID NO: 7363 - protein, 544 aa, Homo sapiens
MQETFKNLASIGEKWEDPNVEDQHKNQGRNLRSHTGERLCEGKEGSQCAENFSPNLSVTKKTAGVKPYECTICGKAFMRLSSLTRHMRSHTGYELFEKPYKCKECEKAFSYLKSFQRHERSHTGEKPYKCKQCGKTFIYHQPFQRHERTHIGEKPYECKQCGKALSCSSSLRVHERIHTGEKPYECKQCGKAFSCSSSIRVHERTHTGEKPYACKECGKAFISHTSVLTHMITHNGDRPYKCKECGKAFIFPSFLRVHERIHTGEKPYKCKQCGKAFRCSTSIQIHERIHTGEKPYKCKECGKSFSARPAFRVHVRVHTGEKPYKCKECGKAFSRISYFRIHERTHTGEKPYECKKCGKTFNYPLDLKIHKRNHTGEKPYECKECAKTFISLENFRRHMITHTGDGPYKCRDCGKVFIFPSALRTHERTHTGEKPYECKQCGKAFSCSSYIRIHKRTHTGEKPYECKECGKAFIYPTSFQGHMRMHTGEKPYKCKECGKAFSLHSSFQRHTRIHNYEKPLECKQCGKAFSVSTSLKKHMRMHNR

SEQ ID NO: 7364 - protein, 467 aa, Homo sapiens
MRLSSLTRHMRSHTGYELFEKPYKCKECEKAFSYLKSFQRHERSHTGEKPYKCKQCGKTFIYHQPFQRHERTHIGEKPYECKQCGKALSCSSSLRVHERIHTGEKPYECKQCGKAFSCSSSIRVHERTHTGEKPYACKECGKAFISHTSVLTHMITHNGDRPYKCKECGKAFIFPSFLRVHERIHTGEKPYKCKQCGKAFRCSTSIQIHERIHTGEKPYKCKECGKSFSARPAFRVHVRVHTGEKPYKCKECGKAFSRISYFRIHERTHTGEKPYECKKCGKTFNYPLDLKIHKRNHTGEKPYECKECAKTFISLENFRRHMITHTGDGPYKCRDCGKVFIFPSALRTHERTHTGEKPYECKQCGKAFSCSSYIRIHKRTHTGEKPYECKECGKAFIYPTSFQGHMRMHTGEKPYKCKECGKAFSLHSSFQRHTRIHNYEKPLECKQCGKAFSVSTSLKKHMRMHNR

SEQ ID NO: 7365 - protein, 344 aa, Homo sapiens
LAEHQTTHPRQKPFVCEESGDAFNNKSTLVQHQRIHSRERPYECSKCGIFFTYAADLTQHQKVHNRGKPYECCECGKFFSQHSSLVKHRRVHTGESPHVCGDCGKFFSRSSNLIQHKRVHTGEKPYECSDCGKFFSQRSNLIHHKRVHTGRSAHECSECGKSFNCNSSLIKHWRVHTGERPYKCNECGKFFSHIASLIQHQIVHTGERPHGCGECGKAFSRSSDLMKHQRVHTGERPYECNECGKLFSQSSSLNSHRRLHTGERPYQCSECGKFFNQSSSLNNHRRLHTGERPYECSECGKTFRQRSNLRQHLKVHKPDRPYECSECGKAFNQRPTLIRHQKIH

SEQ ID NO: 7366 - protein, 632 aa, Homo sapiens
MAAAALRDPAQGCVTFEDVTIYFSQEEWVLLDEAQRLLYCDVMLENFALIASLGLISFRSHIVSQLEMGKEPWVPDSVDMTSAMARGAYGRPGSDFCHGTEGKDLPSEHNVSVEGVAQDRSPEATLCPQKTCPCDICGLRLKDILHLAEHQTTHPRQKPFVCEAYVKGSEFSANLPRKQVQQNVHNPIRTEEGQASPVKTCRDHTSDQLSTCREGGKDFVATAGFLQCEVTPSDGEPHEATEGVVDFHIALRHNKCCESGDAFNNKSTLVQHQRIHSRERPYECSKCGIFFTYAADLTQHQKVHNRGKPYECCECGKFFSQHSSLVKHRRVHTGESPHVCGDCGKFFSRSSNLIQHKRVHTGEKPYECSDCGKFFSQRSNLIHHKRVHTGRSAHECSECGKSFNCNSSLIKHWRVHTGERPYKCNECGKFFSHIASLIQHQIVHTGERPHGCGECGKAFSRSSDLMKHQRVHTGERPYECNECGKLFSQSSSLNSHRRLHTGERPYQCSECGKFFNQSSSLNNHRRLHTGERPYECSECGKTFRQRSNLRQHLKVHKPDRPYECSECGKAFNQRPTLIRHQKIHIRERSMENVLLPCSQHTPEISSENRPYQGAVNYKLKLVHPSTHPGEVP

SEQ ID NO: 7367 - protein, 611 aa, Homo sapiens
MQETIRNLDCVGMKWKDQNIEDQYRYPRKNLRCRMLERFVESKDGTQCGETSSQIQDSIVTKNTLPGVGPYESRMSGEVIMGHSSLNCYIRVGAGHKPYEYHECGEKPDTHKQRGKAFSYHNSLQTHERLHTGKKPYNCKECGKSFSSLGNLQRHMAVQRGDGPYKCKLCGKAFFWPSLLHMHERTHTGEKPYECKQCSKAFSFYSSYLRHERTHTGEKLYECKQCSKAFPDYSSCLRHERTHTGKKPYTCKQCGKAFSASTSLRRHETTHTDEKPYACQQCGKAFHHLGSFQRHMVMHTRDGPHKCKICGKGFDCPSSLKSHERTHTGEKLYECKQCGKALSHSSSFRRHMTMHTGDGPHKCKICGKAFVYPSVFQRHEKTHTAEKPYKCKQCGKAYRISSSLRRHETTHTGEKPYKCKCGKAFIDFYSFQNHKTTHAGEKPYECKECGKAFSCFQYLSQHRRTHTGEKPYECNTCKKAFSHFGNLKVHERIHSGEKPYECKECGKAFSWLTCFLRHERIHMREKPYECQQCGKAFTHSRFLQGHEKTHTGENPYECKECGKAFASLSSLHRHKKTHWKKTHTGENPYGCKECGKAFASLSSLHRHKKTH

SEQ ID NO: 7368 - protein, 643 aa, Homo sapiens
MASVALEDVAVNFTREEWALLGPCQKNLYKDVMQETIRNLDCVGMKWKDQNIEDQYRYPRKNLRCRMLERFVESKDGTQCGETSSQIQDSIVTKNTLPGVGPYESRMSGEVIMGHSSLNCYIRVGAGHKPYEYHECGEKPDTHKQRGKAFSYHNSLQTHERLHTGKKPYNCKECGKSFSSLGNLQRHMAVQRGDGPYKCKLCGKAFFWPSLLHMHERTHTGEKPYECKQCSKAFSFYSSYLRHERTHTGEKLYECKQCSKAFPDYSSCLRHERTHTGKKPYTCKQCGKAFSASTSLRRHETTHTDEKPYACQQCGKAFHHLGSFQRHMVMHTRDGPHKCKICGKGFDCPSSLKSHERTHTGEKLYECKQCGKALSHSSSFRRHMTMHTGDGPHKCKICGKAFVYPSVFQRHEKTHTAEKPYKCKQCGKAYRISSSLRRHETTHTGEKPYKCKCGKAFIDFYSFQNHKTTHAGEKPYECKECGKAFSCFQYLSQHRRTHTGEKPYECNTCKKAFSHFGNLKVHERIHSGEKPYECKECGKAFSWLTCFLRHERIHMREKPYECQQCGKAFTHSRFLQGHEKTHTGENPYECKECGKAFASLSSLHRHKKTHWKKTHTGENPYGCKECGKAFASLSSLHRHKKTH

SEQ ID NO: 7369 - protein, 664 aa, Homo sapiens
MPLRDKYCQTDHHHHGCCEPVYILEPGDPPLLQQPLQTSKSGIQQIIECFRSGTKQLKHILLKDVDTIFECKLCRSLFRGLPNLITHKKFYCPPSLQMDDNLPDVNDKQSQAINDLLEAIYPSVDKREYIIKLEPIETNQNAVFQYISRTDNPIEVTESSSTPEQTEVQIQETSTEQSKTVPVTDTEVETVEPPPVEIVTDEVAPTSDEQPQESQADLETSDNSDFGHQLICCLCRKEFNSRRGVRRHIRKVHKKKMEELKKYIETRKNPNQSSKGRSKNVLVPLSRSCPVCCKSFATKANVRRHFDEVHRGLRRDSITPDIATKPGQPLFLDSISPKKSFKTRKQKSSSKAEYNLTACKCLLCKRKYSSQIMLKRHMQIVHKITLSGTNSKREKGPNNTANSSEIKVKVEPADSVESSPPSITHSPQNELKGTNHSNEKKNTPAAQKNKVKQDSESPKSTSPSAAGGQQKTRKPKLSAGFDFKQLYCKLCKRQFTSKQNLTKHIELHTDGNNIYVKFYKCPLCTYETRRKRDVIRHITVVHKKSSRYLGKITASLEIRAIKKPIDFVLNKVAKRGPSRDEAKHSDSKHDGTSNSPSKKYEVADVGIEVKVTKNFSLHRCNKCGKAFAKKTYLEHHKKTHKANASNSPEGNKTKGRSTRSKALV

SEQ ID NO: 7370 - protein, 664 aa, Homo sapiens; identical to SEQ ID NO: 7369

SEQ ID NO: 7371 - protein, 664 aa, Homo sapiens; identical to SEQ ID NO: 7369

SEQ ID NO: 7372 - protein, 242 aa, Homo sapiens
MPLRDKYCQTDHHHHGCCEPVYILEPGDPPLLQQPLQTSKSGIQQIIECFRSGTKQLKHILLKDVDTIFECKLCRSLFRGLPNLITHKKFYCPPSLQMDDNLPDVNDKQSQAINDLLEAIYPSVDKREYIIKLEPIETNQNAVFQYISRTDNPIEVTESSSTPEQTEVQIQETSTEQSKTVPVTDTEVETVEPPPVEIVTDEVAPTSDEQPQESQADLETSDNSDFGHQLICCLCRKEFNSR

SEQ ID NO: 7373 - protein, 130 aa, Homo sapiens
MPLRDKYCQTDHHHHGCCEPVYILEPGDPPLLQQPLQTSKSGIQQIIECFRSGTKQLKHILLKDVDTIFECKLCRSLFRGLPNLITHKKFYCPPSLQMDDNLPDVNDKQSQAINDLLEAIYPSVDKREYI

SEQ ID NO: 7374 - protein, 98 aa, Homo sapiens
MPLRDKYCQTDHHHHGCCEPVYILEPGDPPLLQQPLQTSKSGIQQIIECFRSGTKQLKHILLKDVDTIFECKLCRSLFRGLPNLITHKKFYCPPSLQM

SEQ ID NO: 7375 - protein, 494 aa, Homo sapiens
MQGERLRPGLDSQKEKLPGKMSPKHDGLGTADSVCSRIIQDRVSLGDDVHDCDSHGSGKNPVIQEEENIFKCNECEKVFNKKRLLARHERIHSGVKPYECTECGKTFSKSTYLLQHHMVHTGEKPYKCMECGKAFNRKSHLTQHQRIHSGEKPYKCSECGKAFTHRSTFVLHNRSHTGEKPFVCKECGKAFRDRPGFIRHYIIHSGENPYECFECGKVFKHRSYLMWHQQTHTGEKPYECSECGKAFCESAALIHHYVIHTGEKPFECLECGKAFNHRSYLKRHQRIHTGEKPYVCSECGKAFTHCSTFILHKRAHTGEKPFECKECGKAFSNRADLIRHFSIHTGEKPYECMECGKAFNRRSGLTRHQRIHSGEKPYECIECGKTFCWSTNLIRHSIIHTGEKPYECSECGKAFSRSSSLTQHQRMHTGRNPISVTDVGRPFTSGQTSVNIQELLLGKNFLNVTTEENLLQEEASYMASDRTYQRETPQVSSL

SEQ ID NO: 7376 - protein, 627 aa, Homo sapiens
MAMALTDPAQVSVTFDDVAVTFTQEEWGQLDLAQRTLYQEVMLENCGLLVSLGCPVPRPELIYHLEHGQEPWTRKEDLSQGTCPGDKGKPKSTEPTTCELALSEGISFWGQLTQGASGDSQLGQPKDQDGFSEMQGERLRPGLDSQKEKLPGKMSPKHDGLGTADSVCSRIIQDRVSLGDDVHDCDSHGSGKNPVIQEEENIFKCNECEKVFNKKRLLARHERIHSGVKPYECTECGKTFSKSTYLLQHHMVHTGEKPYKCMECGKAFNRKSHLTQHQRIHSGEKPYKCSECGKAFTHRSTFVLHNRSHTGEKPFVCKECGKAFRDRPGFIRHYIIHSGENPYECFECGKVFKHRSYLMWHQQTHTGEKPYECSECGKAFCESAALIHHYVIHTGEKPFECLECGKAFNHRSYLKRHQRIHTGEKPYVCSECGKAFTHCSTFILHKRAHTGEKPFECKECGKAFSNRADLIRHFSIHTGEKPYECMECGKAFNRRSGLTRHQRIHSGEKPYECIECGKTFCWSTNLIRHSIIHTGEKPYECSECGKAFSRSSSLTQHQRMHTGRNPISVTDVGRPFTSGQTSVNIQELLLGKNFLNVTTEENLLQEEASYMASDRTYQRETPQVSSL

SEQ ID NO: 7377 - protein, 494 aa, Homo sapiens; identical to SEQ ID NO: 7375

SEQ ID NO: 7378 - protein, 50 aa, Homo sapiens
APLLSCITGATLETLCVQRVKAFRDRPGFIRHYIIHSGENPYECFECGKV

SEQ ID NO: 7379 - protein, 903 aa, Homo sapiens
MLREEAAQKRKGKESGMALPQGRLTFRDVAIEFSLAEWKFLNPAQRALYREVMLENYRNLEAVDISSKHMMKEVLSTGQGNREVIHTGTLQRHQSYHIGDFCFQEIEKEIHNIEFQCQEDERNGHEAPTTKIKKLTGSTDQHDHRHAGNKPIKDQLGSSFYSHLPELHIFQIKGEIANQLEKSTSDASSVSTSQRISCRPQIHISNNYGNNPLNSSLLPQKQEVHMREKSFPCNESGKAFNCSSLLRKHQIPHLGDKQYKCDVCGKLFNHKQYLACHRRCHTGEKPYKCKECGKSFSYKSSLTCHHRLHTGVKPYKCNECGKVFRQNSALVIHKAIHTGEKPYKCNECGKAFNQQSHLSRHQRLHTGVKPYKCKICEKAFACHSYLANHTRIHSGEKTYKCNECGKAFNHQSSLARHHILHTGEKPYKCEECDKVFSQKSTLERHKRIHTGEKPYKCKVCDTAFTCNSQLARHRRIHTGEKTYKCNECRKTFSRRSSLLCHRRLHSGEKPYKCNQCGNTFRHRASLVYHRRLHTLEKSYKCTVCNKVFMRNSVLAVHTRIHTAKKPYKCNECGKAFNQQSHLSRHRRLHTGEKPYKCEACDKVFGQKSALESHKRIHTGEKPYRCQVCDTAFTWNSQLARHTRIHTGEKTYKCNECGKTFSYKSSLVWHRRLHGGEKSYKCKVCDKAFVCRSYVAKHTRIHSGMKPYKCNECSKTFSNRSSLVCHRRIHSGEKPYKCSECSKTFSQKATLLCHRRLHSGEKPYKCNDCGNTFRHWSSLVYHRRLHTGEKSYKCTVCDKAFVRNSYLARHIRIHTAEKPYKCNECGKAFNEQSHLSRHHRIHTGEKPYKCEACDKVFSRKSHLKRHRIIHTGEKPYKCNECGKAFSDRSTLIHHQAIHGIGKFD

SEQ ID NO: 7380 - protein, 617 aa, Homo sapiens
MALPQGLLTFRDVAIEFSQEEWKCLDPAQRTLYRDVMLENYRNLVSLDISSKCMMKEFSSTAQGNREVIHTGTLQRHESHHTGDFRFQEIDKDIHNLEFQWQEDERNSHEAPMTEIKKLTGSADRYDQRHAGNKPIKDQLGSSFHSHLPELHMFQTQGKIGNQVEKSINDASSISTSQRISCRPKTHISNNYGNNFRNSSLLTQKQEVHMREKSFQCNESGKAFNYSSLLRKHQIIHLGEKQYKCDVCGKVFNRKRNLVCHRRCHTGEKPYRCNECGKTFSQTYSLTCHRRLHTGEKPYKCEECDKAFSFKSNLKRHRRIHAGEKPYKCNECGKTFSQTSSLTCHRRLHTGEKPFKCNECGKTFSRKSSLTCHHRLHTGEKPYKCNECGKTFSQELTLKCHRRLHTGEKPYKCNECGKVFNKKANLARHHRLHSGEKPYKCTECVKTFSRNSALVIHKAIHIGEKRYKCNECGKTFSRISALVIHTAIHTGEKPYKCNECGKGFNRKTHLACHHRLHTGEKPYKCNECGKVFNRKTHLAHHHRLHTGDKPYKCNECGKVFNQKAHLARHHRLHTGEKPYKCNECGKVFNQKANLARHHRLHTGEKPYKFNECGKAFN

SEQ ID NO: 7381 - protein, 60 aa, Homo sapiens
MALPQGLLTFRDVAIEFSQEEWKCLDPAQRTLYRDVMLENYRNLVSLELSGECPLAAPAS

SEQ ID NO: 7382 - protein, 651 aa, Homo sapiens
MLREEATKKSKEKEPGMALPQGRLTFRDVAIEFSLEEWKCLNPAQRALYRAVMLENYRNLEFVDSSLKSMMEFSSTRHSITGEVIHTGTLQRHKSHHIGDFCFPEMKKDIHHFEFQWQEVERNGHEAPMTKIKKLTGSTDRSDHRHAGNKPIKDQLGLSFHSHLPELHMFQTKGKISNQLDKSIGASSASESQRISCRLKTHISNKYGKNFLHSSFTQIQEICMREKPCQSNECGKAFNYSSLLRRHHITHSREREYKCDVCGKIFNQKQYIVYHHRCHTGEKTYKCNECGKTFTQMSSLVCHRRLHTGEKPYKCNECGKTFSEKSSLRCHRRLHTGEKPYKCNECGKTFGRNSALVIHKAIHTGEKPYKCNECGKTFSQKSSLQCHHILHTGEKPYKCEECDNVYIRRSHLERHRKIHTGEGSYKCKVCDKVFRSDSYLAEHQRVHTGEKPYKCNKCGRSFSRKSSLQYHHTLHTGEKPYTCNECGKVFSRRENLARHHRLHAGEKPYKCEECDKVFSRRSHLERHRRIHTGEKPYKCKVCDKAFRSDSCLANHTRVHTGEKPYKCNKCAKVFNQKGILAQHQRVHTGEKPYKCNECGKVFNQKASLAKHQRVHTAEKPYKCNECGKAFTGQSTLIHHQAIHGCRETLQM

SEQ ID NO: 7383 - protein, 233 aa, Homo sapiens
MLREEATKKSKEKEPGMALPQGRLTFRDVAIEFSLEEWKCLNPAQRALYRAVMLENYRNLEFVDISSKCMMKEFSSTAQGNTEVIHTGTLQRHESHHIRDFCFQEIEKDIHNFEFQWQEEERNGHEAPMTEIKELTGSTDRHDQRHAGNKPIKDQLGSSFHSHLPELHIFQPEWKIGNQVEKSIINASLILTSQRISCSPKTRISNNYGNNSLHSSLPIQKLGSTHERKIFPM

SEQ ID NO: 7384 - protein, 651 aa, Homo sapiens; identical to SEQ ID NO: 7382

SEQ ID NO: 7385 - protein, 114 aa, Homo sapiens
MLREEATKKSKEKEPGMALPQGRLTFRDVAIEFSLEEWKCLNPAQRALYRAVMLENYRNLEFVDSSLKSMMEFSSTRHSITGEVIHTGTLQRHKSHHIGDFCFPEMKKDIHHFE

SEQ ID NO: 7386 - protein, 164 aa, Homo sapiens
MMKEFSSTAQGNTEVIHTGTLQRHESHHIRDFCFQEIEKDIHNFEFQWQEEERNGHEAPMTEIKELTGSTDRHDQRHAGNKPIKDQLGSSFHSHLPELHIFQPEWKIGNQVEKSIINASLILTSQRISCSPKTRISNNYGNNSLHSSLPIQKLGSTHERKIFPM

SEQ ID NO: 7387 - protein, 532 aa, Homo sapiens
MALRSVMFSDVSIDFSPEEWEYLDLEQKDLYRDVMLENYSNLVSLGCFISKPDVISSLEQGKEPWKVVRKGRRQYPDLETKYETKKLSLENDIYEINLSQWKIMERIENHGLKGLILKNDWESTGKIEGQERPQEGYFSSVKMPSEKVSSYQKRTSVTPHQRLHFVDKPYECKECGKAFRVRQQLTFHHRIHTGEKPYECKECGMAFRQTAHLTRHQRLHSGEKLYECKECGEAFICGADLRVHQKMHIGEKPYECKECGKAFRVRGQLTLHQRIHTGEKPYVCKECGKAFRQYAHLTRHQKLNSADRLYECKECGKAFLCGSGLRVHHKLHTGEKPYECKECGKAFRVRQQLTLHQRIHTGEKPYECKECGKTFSRGYHLILHHRIHTGEKPYECKECWKAFSRYSQLISHQSIHIGVKPYDCKECGKAFRLLSQLTQHQSIHIGEKPYKCKECGKAFRLRQKLTLHQSIHTGEKPFECKECRKAFRLNSSLIQHLRIHSGEKPYECKECKKAFRQHSHLTHHLKIHNVKI

SEQ ID NO: 7388 - protein, 532 aa, Homo sapiens
MALRSVMFSDVSIDFSPEEWEYLDLEQKDLYRDVMLENYSNLVSLGLLLLSFISTLEMLLLLVKENSMCLLSCFILDLETKYETKKLSLENDIYEINLSQWKIMERIENHGLKGLILKNDWESTGKIEGQERPQEGYFSSVKMPSEKVSSYQKRTSVTPHQRLHFVDKPYECKECGKAFRVRQQLTFHHRIHTGEKPYECKECGMAFRQTAHLTRHQRLHSGEKLYECKECGEAFICGADLRVHQKMHIGEKPYECKECGKAFRVRGQLTLHQRIHTGEKPYVCKECGKAFRQYAHLTRHQKLNSADRLYECKECGKAFLCGSGLRVHHKLHTGEKPYECKECGKAFRVRQQLTLHQRIHTGEKPYECKECGKTFSRGYHLILHHRIHTGEKPYECKECWKAFSRYSQLISHQSIHIGVKPYDCKECGKAFRLLSQLTQHQSIHIGEKPYKCKECGKAFRLRQKLTLHQSIHTGEKPFECKECRKAFRLNSSLIQHLRIHSGEKPYECKECKKAFRQHSHLTHHLKIHNVKI

SEQ ID NO: 7389 - protein, 610 aa, Homo sapiens
MDSVAFEDVAVNFTQEEWALLGPSQKSLYRNVMQETIRNLDCIEMKWEDQNIGDQCQNAKRNLRSHTCEIKDDSQCGETFGQIPDSIVNKNTPRVNPCDSGECGEVVLGHSSLNCNIRVDTGHKSCEHQEYGEKPYTHKQRGKAISHQHSFQTHERPPTGKKPFDCKECAKTFSSLGNLRRHMAAHHGDGPYKCKLCGKAFVWPSLFHLHERTHTGEKPYECKQCSKAFPFYSSYLRHERIHTGEKAYECKQCSKAFPDYSTYLRHERTHTGEKPYKCTQCGKAFSCYYYTRLHERTHTGEQPYACKQCGKTFYHHTSFRRHMIRHTGDGPHKCKICGKGFDCPSSVRNHETTHTGEKPYECKQCGKVLSHSSSFRSHMITHTGDGPQKCKICGKAFGCPSLFQRHERTHTGEKPYQCKQCGKAFSLAGSLRRHEATHTGVKPYKCQCGKAFSDLSSFQNHETTHTGEKPYECKECGKAFSCFKYLSQHKRTHTVEKPYECKTCRKAFSHFSNLKVHERIHSGEKPYECKECGKAFSWLTCLLRHERIHTGEKPYECLQCGKAFTRSRFLRGHEKTHTGEKLYECKECGKALSSLRSLHRHKRTHWKDTL

SEQ ID NO: 7390 - protein, 469 aa, Homo sapiens
MKWEDQNIGDQCQNAKRNLRSHTCEIKDDSQCGETFGQIPDSIVNKNTPRVNPCDSGECGEVVLGHSSLNCNIRVDTGHKSCEHQEYGEKPYTHKQRGKAISHQHSFQTHERPPTGKKPFDCKECAKTFSSLGNLRRHMAAHHGDGPYKCKLCGKAFVWPSLFHLHERTHTGEKPYECKQCSKAFPFYSSYLRHERIHTGEKAYECKQCSKAFPDYSTYLRHERTHTGEKPYKCTQCGKAFSCYYYTRLHERTHTGEQPYACKQCGKTFYHHTSFRRHMIRHTGDGPHKCKICGKGFDCPSSVRNHETTHTGEKPYECKQCGKVLSHSSSFRSHMITHTGDGPQKCKICGKAFGCPSLFQRHERTHTGEKPYQCKQCGKAFSLAGSLRRHEATHTGVKPYKCQCGKAFSDLSSFQNHETTHTGEKPYECKECGKAFSCFKYLSQHKRTHTVEKPYECKTCRKAFSHFSN

SEQ ID NO: 7391 - protein, 428 aa, Homo sapiens
MAAHHGDGPYKCKLCGKAFVWPSLFHLHERTHTGEKPYECKQCSKAFPFYSSYLRHERIHTGEKAYECKQCSKAFPDYSTYLRHERTHTGEKPYKCTQCGKAFSCYYYTRLHERTHTGEQPYACKQCGKTFYHHTSFRRHMIRHTGDGPHKCKICGKGFDCPSSVRNHETTHTGEKPYECKQCGKVLSHSSSFRSHMITHTGDGPQKCKICGKAFGCPSLFQRHERTHTGEKPYQCKQCGKAFSLAGSLRRHEATHTGVKPYKCQCGKAFSDLSSFQNHETTHTGEKPYECKECGKAFSCFKYLSQHKRTHTVEKPYECKTCRKAFSHFSNLKVHERIHSGEKPYECKECGKAFSWLTCLLRHERIHTGEKPYECLQCGKAFTRSRFLRGHEKTHTGEKLYECKECGKALSSLRSLHRHKRTHWKDTL

SEQ ID NO: 7392 - protein, 1080 aa, Homo sapiens
PSRQKKKKKKLTSDVSRQEEAEGELSEGEHWYGNSSETPSEASYGEVQENYKLSLEDRIQEQSTSPDTSLGSTTPSSHTLELVALDSEVLRDSLQCQDHLSPGVSSLCDDDPGSNKPLSSNLRRLLEAGSLKLDAAATANGRVESPVNVGSNLSFSPPSHHAQQLSVLARKLAEKQEQNDQYTPSNRFIWNQGKWLPNSTTTCSLSPDSAILKLKAAANAVLQDKSLTRTEETMRFESFSSPFSSQSASSTLAALSKKVSERSLTPGQEHPPPASSFLSLASMTSSAALLKEVAARAAGSLLAEKSSLLPEDPLPPPPSEKKPEKVTPPPPPPPPPPPPPPPQSLELLLLPVPKGRVSKPSNSASEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTSPFFSEDTFRQSPFTSNSKELLPSDSVLHGRISAPETEKIVLEAGNGLPSWKFNDQLFPCDVCGKVFGRQQTLSRHLSLHTEERKYKCHLCPYAAKCRANLNQHLTVHSVKLVSTDTEDIVSAVTSEGSDGKKHPYYYSCHVCGFETELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLNSGQW

SEQ ID NO: 7393 - protein, 731 aa, Homo sapiens
MPRRKQEQPKRLPSPSEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTSPFFSEDTFRQSPFTSNSKELLPSDSVLHGRISAPETEKIVLEAGNGLPSWKFNDQLFPCDVCGKVFGRQQTLSRHLSLHTEERKYKCHLCPYAAKCRANLNQHLTVHSVKLVSTDTEDIVSAVTSEGSDGKKHPYYYSCHVCGFETELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLKRGAW

SEQ ID NO: 7394 - protein, 1081 aa, Homo sapiens
MPRRKQEQPKRLPSHVSRQEEAEGELSEGEHWYGNSSETPSEASYGEVQENYKLSLEDRIQEQSTSPDTSLGSTTPSSHTLELVALDSEVLRDSLQCQDHLSPGVSSLCDDDPGSNKPLSSNLRRLLEAGSLKLDAAATANGRVESPVNVGSNLSFSPPSHHAQQLSVLARKLAEKQEQNDQYTPSNRFIWNQGKWLPNSTTTCSLSPDSAILKLKAAANAVLQDKSLTRTEETMRFESFSSPFSSQSASSTLAALSKKVSERSLTPGQEHPPPASSFLSLASMTSSAALLKEVAARAAGSLLAEKSSLLPEDPLPPPPSEKKPEKVTPPPPPPPPPPPPPPPQSLELLLLPVPKGRVSKPSNSASEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTSPFFSEDTFRQSPFTSNSKELLPSDSVLHGRISAPETEKIVLEAGNGLPSWKFNDQLFPCDVCGKVFGRQQTLSRHLSLHTEERKYKCHLCPYAAKCRANLNQHLTVHSVKLVSTDTEDIVSAVTSEGSDGKKHPYYYSCHVCGFETELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLNSGQW

SEQ ID NO: 7395 - protein, 731 aa, Homo sapiens
MPRRKQEQPKRLPSPSEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTSPFFSEDTFRQSPFTSNSKELLPSDSVLHGRISAPETEKIVLEAGNGLPSWKFNDQLFPCDVCGKVFGRQQTLSRHLSLHTEERKYKCHLCPYAAKCRANLNQHLTVHSVKLVSTDTEDIVSAVTSEGSDGKKHPYYYSCHVCGFETELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLNSGQW

SEQ ID NO: 7396 - protein, 1077 aa, Homo sapiens
MPRRKQEQPKRLPSHVSRQEEAEGELSEGEHWYGNSSETPSEASYGEVQENYKLSLEDRIQEQSTSPDTSLGSTTPSSHTLELVALDSEVLRDSLQCQDHLSPGVSSLCDDDPGSNKPLSSNLRRLLEAGSLKLDAAATANGRVESPVNVGSNLSFSPPSHHAQQLSVLARKLAEKQEQNDQYTPSNRFIWNQGKWLPNSTTTCSLSPDSAILKLKAAANAVLQDKSLTRTEETMRFESFSSPFSSQSASSTLAALSKKVSERSLTPGQEHPPPASSFLSLASMTSSAALLKEVAARAAGSLLAEKSSLLPEDPLPPPPSEKKPEKVTPPPPPPPPPPPPPPPQSLELLLLPVPKGRVSKPSNSASEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTSPFFSEDTFRQSPFTSNSKELLPSDSVLHGRISAPETEKIVLEAGNGLPSWKFNDQLFPCDVCGKVFGRQQTLSRHLSLHTEERKYKCHLCPYAAKCRANLNQHLTVHSVKLVSTDTEDIVSAVTSEGSDGKKHPYYYSCHVCGFETELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLK

SEQ ID NO: 7397 - protein, 432 aa, Homo sapiens
MPHSPLISIPHVWCHPEEEERMHDELLQAVSKGPVMFRDVSIDFSQEEWECLDADQMNLYKEVMLENFSNLVSVGLSNSKPAVISLLEQGKEPWMVDRELTRGLCSDLESMCETKILSLKKRHFSQVIITREDMSTFIQPTFLIPPQKTMSEEKPWECKICGKTFNQNSQFIQHQRIHFGEKHYESKEYGKSFSRGSLVTRHQRIHTGKKPYECKECGKAFSCSSYFSQHQRIHTGEKPYECKECGKAFKYCSNLNDHQRIHTGEKPYECKVCGKAFTKSSQLFLHLRIHTGEKPYECKECGKAFTQHSRLIQHQRMHTGEKPYECKQCGKAFNSASTLTNHHRIHAGEKLYECEECRKAFIQSSELIQHQRIHTDEKPYECNECGKAFNKGSNLTRHQRIHTGEKPYDCKECGKAFGSRSDLIRHEGIHTG

SEQ ID NO: 7398 - protein, 432 aa, Homo sapiens; identical to SEQ ID NO: 7397

SEQ ID NO: 7399 - protein, 936 aa, Homo sapiens
MALTQGPLTFRDVAIEFSQEEWKSLDPVQKALYWDVMLENYRNLVFLGILPKCMTKELPPIGNSNTGEKCQTVTLERHECYDVENFYLREIQKNLQDLEFQWKDGEINYKEVPMTYKNNLNGKRGQHSQEDVENKCIENQLTLSFQSRLTELQKFQTEGKIYECNQSEKTVNNSSLVSPLQRILPSVQTNISKKYENEFLQLSLPTQLEKTHIREKPYMCKGCGKAFRVSSSLINHQMVHTTEKPYKCNECGKAFHRGSLLTIHQIVHTRGKPYQCGVCGKIFRQNSDLVNHRRSHTGEKPYKCNECGKSFSQSYNLAIHQRIHTGEKPYKCNECGKTFKQGSCLTTHQIIHTGEKPYQCDICGKVFRQNSNLVNHQRIHTGEKPYKCNICGKSFSQSSNLATHQTVHSGNKPYKCDECGKTFKRSSSLTTHQIIHTGEKPYTCDVCDKVFSQRSQLARHQRSHTGEKPYKCNECGKVFSQTSHLVGHRRIHTGEKPYKCDKCGKAFKQGSLLTRHKIIHTREKRYQCGECGKVFSENSCLVRHLRIHTGEQPYKCNVCGKVFNYSGNLSIHKRIHTGEKPFQCNECGTVFRNYSCLARHLRIHTGQKPYKCNVCGKVFNDSGNLSNHKRIHTGEKPFQCNECGKVFSYYSCLARHRKIHTGEKPYKCNDCGKAYTQRSSLTKHLIIHTGEKPYNCNEFGGAFIQSSKLARYHRNPTGEKPHKCSHCGRTFSHITGLTYHQRRHTGEMPYKCIECGQVFNSTSNLARHRRIHTGEKPYKCNECGKVFRHQSTLARHRSIHTGEKPYVCNECGKAFRVRSILVNHQKMHTGDKPYKCNECGKAFIERSKLVYHQRNHTGEKPYKCIECGKAFGRFSCLNKHQMIHSGEKPYKCNECGKSFISRSGLTKHQTKHTAESLKTKFNVEKPLDVLLTSGFK

SEQ ID NO: 7400 - protein, 177 aa, Homo sapiens
SLPTQLEKTHIREKPYMCKGCGKAFRVSSSLINHQMVHTTEKPYKCNECGKAFHRGSLLTIHQIVHTRGKPYQCGVCGKIFRQNSDLVNHRRSHTGEKPYKCNECGKSFSQSYNLAIHQRIHTGEQPYKCNVCGKVFNYSGNLSIHKRIHTGEKPFQCNECGTVFRNYSCLARHLRI

SEQ ID NO: 7401 - protein, 531 aa, Homo sapiens
MEAPAQKAGQGGLPKADAQGASGAREKRPEEPRPLEEDRAGSRPTQKGDLRGAAGGRTTPPGGGSRGCSLGVSPGPGTRHSAGTRPLVREPCGPTSSQNPELVIPEGLQAREGPCRSPARGGDCSRNSCLAWHRGAPAGETPPVCDPCPERIQNHPRTQLCEVHTDCWPCQPGTGAPTCPRTPKPTSRGRNPLVEQPRACACGEAFAWRALRIPQERLQATEEPRPCARCGKRFRPNQQQQAGKSPPVCPECGQTSRPRPIVPDPPAQRLYACDECGKAFTRTSSLLQHQRIHTGERPYECAECGKAFVRCSGLYRHQKTHSAERHRRGPVLARRAFRLGCPPCGDYSERSPRRGSGAGEKPYECADCAKAFGLFSHLVEHRRVHTGEKPYACPECGKAFNQRSNLSRHQRTHSSAKPYACPLCEKAFKGRSGLVQHQRAHTGERPYGCSECGKTFRGCSELRQHERLHSGEKPYICRDCGKAFVRNCSLVRHLRTHTGERPYACGDCGRAFSQRSNLNEHRKRHGGRAAP

SEQ ID NO: 7402 - protein, 531 aa, Homo sapiens; identical to SEQ ID NO: 7401

SEQ ID NO: 7403 - protein, 738 aa, Homo sapiens
MTMLQESFSFDDLSVDFTQKEWQLLDPSQKNLYKDVMLENYSSLVSLGYEVMKPDVIFKLEQGEEPWVGDGEIPSSDSPEVWKVDGNMMWHQDNQDKLKIIKRGHECDAFGKNFNLNMNFVPLRKSNSEGDLDGLILKHHLDLLIPKGDYGKAESDDFNVFDNFFLHSKPEDTDTWLKYYDCDKYKESYKKSQIIIYHRNRLGEKLYECSECRKRFSKKPSLIKHQSRHIRDIAFGCGNCGKTFPQKSQFITHHRTHTGEKPYNCSQCGKAFSQKSQLTSHQRTHTGEKPYECGECGKAFSRKSHLISHWRTHTGEKPYGCNECGRAFSEKSNLINHQRIHTGEKPFECRECGKAFSRKSQLVTHHRTHTGTKPFGCSDCRKAFFEKSELIRHQTIHTGEKPYECSECRKAFRERSSLINHQRTHTGEKPHGCIQCGKAFSQKSHLISHQMTHTGEKPFICSKCGKAFSRKSQLVRHQRTHTGEKPYECSECGKAFSEKLSLTNHQRIHTGEKPYVCSECGKAFCQKSHLISHQRTHTGEKPYECSECGKAFGEKSSLATHQRTHTGEKPYECRDCEKAFSQKSQLNTHQRIHTGEKPYECSLCRKAFFEKSELIRHLRTHTGEKPYECNECRKAFREKSSLINHQRIHTGEKPFECSECGKAFSRKSHLIPHQRTHTGEKPYGCSECRKAFSQKSQLVNHQRIHTGEKPYRCIECGKAFSQKSQLINHQRTHTVKKS

SEQ ID NO: 7404 - protein, 738 aa, Homo sapiens; identical to SEQ ID NO: 7403

SEQ ID NO: 7405 - protein, 69 aa, Homo sapiens
MTMLQESFSFDDLSVDFTQKEWQLLDPSQKNLYKDVMLENYSSLVSLGYEVMKPDVIFKLEQGEEPWVG

SEQ ID NO: 7406 - protein, 738 aa, Homo sapiens; identical to SEQ ID NO: 7403

SEQ ID NO: 7407 - protein, 55 aa, Homo sapiens
MTMLQESFSFDDLSVDFTQKEWQLLDPSQKNLYKDVMLENYSSLVSLGYEVMKPD

SEQ ID NO: 7408 - protein, 738 aa, Homo sapiens; identical to SEQ ID NO: 7403

SEQ ID NO: 7409 - protein, 236 aa, Homo sapiens
MTMLQESFSFDDLSVDFTQKEWQLLDPSQKNLYKDVMLENYSSLVSLGYEVMKPDVIFKLEQGEEPWVGDGEIPSSDSPEVWKVDGNMMWHQDNQDKLKIIKRGHECDAFGKNFNLNMNFVPLRKSNSEGDLDGLILKHHLDLLIPKGDYGKAESDDFNVFDNFFLHSKPEDTDTWLKYYDCDKYKESYKKSQIIIYHRNRLGEKLYECSECRKRFSKKPSLIKHQSRHIRDIAFG

SEQ ID NO: 7410 - protein, 67 aa, Homo sapiens
MTMLQESFSFDDLSVDFTQKEWQLLDPSQKNLYKDVMLENYSSLVSLGYEVMKPDVIFKLEQGEEPW

SEQ ID NO: 7411 - protein, 78 aa, Homo sapiens
MTMLQESFSFDDLSVDFTQKEWQLLDPSQKNLYKDVMLENYSSLVSLGYEVMKPDVIFKLEQGEEPWVGDGEIPSSDS

SEQ ID NO: 7412 - protein, 737 aa, Homo sapiens
MTMLQESFSFDDLSVDFTQKEWQLLDPSQKNLYKDVMLENYSSLVSLGYEVMKPDVIFKLEQGEEPWVGDGEIPSSDSPVWKVDGNMMWHQDNQDKLKIIKRGHECDAFGKNFNLNMNFVPLRKSNSEGDLDGLILKHHLDLLIPKGDYGKAESDDFNVFDNFFLHSKPEDTDTWLKYYDCDKYKESYKKSQIIIYHRNRLGEKLYECSECRKRFSKKPSLIKHQSRHIRDIAFGCGNCGKTFPQKSQFITHHRTHTGEKPYNCSQCGKAFSQKSQLTSHQRTHTGEKPYECGECGKAFSRKSHLISHWRTHTGEKPYGCNECGRAFSEKSNLINHQRIHTGEKPFECRECGKAFSRKSQLVTHHRTHTGTKPFGCSDCRKAFFEKSELIRHQTIHTGEKPYECSECRKAFRERSSLINHQRTHTGEKPHGCIQCGKAFSQKSHLISHQMTHTGEKPFICSKCGKAFSRKSQLVRHQRTHTGEKPYECSECGKAFSEKLSLTNHQRIHTGEKPYVCSECGKAFCQKSHLISHQRTHTGEKPYECSECGKAFGEKSSLATHQRTHTGEKPYECRDCEKAFSQKSQLNTHQRIHTGEKPYECSLCRKAFFEKSELIRHLRTHTGEKPYECNECRKAFREKSSLINHQRIHTGEKPFECSECGKAFSRKSHLIPHQRTHTGEKPYGCSECRKAFSQKSQLVNHQRIHTGEKPYRCIECGKAFSQKSQLINHQRTHTVKKS

SEQ ID NO: 7413 - protein, 6 aa, Homo sapiens
MTMLQV

SEQ ID NO: 7414 - protein, 500 aa, Homo sapiens
MLEGHESYDTENFYFREIRKNLQEVDFQWKDGEINYKEGPMTHKNNLTGQRVRHSQGDVENKHMENQLILRFQSGLGELQKFQTAEKIYGCNQIERTVNNCFLASPLQRIFPGVQTNISRKYGNDFLQLSLPTQDEKTHIREKPYIGNECGKAFRVSSSLINHQMIHTTEKPYRCNESGKAFHRGSLLTVHQIVHTRGKPYQCDVCGRIFRQNSDLVNHRRSHTGDKPYICNECGKSFSKSSHLAVHQRIHTGEKPYKCNRCGKCFSQSSSLATHQTVHTGDKPYKCNECGKTFKRNSSLTAHHIIHAGKKPYTCDVCGKVFYQNSQLVRHQIIHTGETPYKCNECGKVFRYRSGLARHWSIHTGEKPYKCNECGKAFRVRSILLNHQMMHTGEKPYKCNECGKAFIERSNLVYHQRNHTGEKPYKCMECGKAFGRRSCLTKHQRIHSSEKPYKCNECGKSYISRSGLTKHQIKHAGENLTTKLNVERPLDVVLTSGIPK

SEQ ID NO: 7415 - protein, 924 aa, Homo sapiens
MALPQGSLTFRDVAVEFSQEEWKCLDPVQKALYRDVMLENYRNLGFLGLCLPDLNIISMLEQGKEPWTVVSQVKIARNPNCGECMKGVITGISPKCVIKELPPIQNSNTGEKFQAVMLEGHESYDTENFYFREIRKNLQEVDFQWKDGEINYKEGPMTHKNNLTGQRVRHSQGDVENKHMENQLILRFQSGLGELQKFQTAEKIYGCNQIERTVNNCFLASPLQRIFPGVQTNISRKYGNDFLQLSLPTQDEKTHIREKPYIGNECGKAFRVSSSLINHQMIHTTEKPYRCNESGKAFHRGSLLTVHQIVHTRGKPYQCDVCGRIFRQNSDLVNHRRSHTGDKPYICNECGKSFSKSSHLAVHQRIHTGEKPYKCNRCGKCFSQSSSLATHQTVHTGDKPYKCNECGKTFKRNSSLTAHHIIHAGKKPYTCDVCGKVFYQNSQLVRHQIIHTGETPYKCNECGKVFFQRSRLAGHRRIHTGEKPYKCNECGKVFSQHSHLAVHQRVHTGEKPYKCNECGKAFNWGSLLTVHQRIHTGEKPYKCNVCGKVFNYGGYLSVHMRCHTGEKPLHCNKCGMVFTYYSCLARHQRMHTGEKPYKCNVCGKVFIDSGNLSIHRRSHTGEKPFQCNECGKVFSYYSCLARHRKIHTGEKPYKCNDCGKAYTQRSSLTKHLVIHTGENPYHCNEFGEAFIQSSKLARYHRNPTGEKPHKCSECGRTFSHKTSLVYHQRRHTGEMPYKCIECGKVFNSTTTLARHRRIHTGEKPYKCNECGKVFRYRSGLARHWSIHTGEKPYKCNECGKAFRVRSILLNHQMMHTGEKPYKCNECGKAFIERSNLVYHQRNHTGEKPYKCMECGKAFGRRSCLTKHQRIHSSEKPYKCNECGKSYISRSGLTKHQIKHAGENLTTKLNVERPLDVVLTSGIPK

SEQ ID NO: 7416 - protein, 808 aa, Homo sapiens
MLEGHESYDTENFYFREIRKNLQEVDFQWKDGEINYKEGPMTHKNNLTGQRVRHSQGDVENKHMENQLILRFQSGLGELQKFQTAEKIYGCNQIERTVNNCFLASPLQRIFPGVQTNISRKYGNDFLQLSLPTQDEKTHIREKPYIGNECGKAFRVSSSLINHQMIHTTEKPYRCNESGKAFHRGSLLTVHQIVHTRGKPYQCDVCGRIFRQNSDLVNHRRSHTGDKPYICNECGKSFSKSSHLAVHQRIHTGEKPYKCNRCGKCFSQSSSLATHQTVHTGDKPYKCNECGKTFKRNSSLTAHHIIHAGKKPYTCDVCGKVFYQNSQLVRHQIIHTGETPYKCNECGKVFFQRSRLAGHRRIHTGEKPYKCNECGKVFSQHSHLAVHQRVHTGEKPYKCNECGKAFNWGSLLTVHQRIHTGEKPYKCNVCGKVFNYGGYLSVHMRCHTGEKPLHCNKCGMVFTYYSCLARHQRMHTGEKPYKCNVCGKVFIDSGNLSIHRRSHTGEKPFQCNECGKVFSYYSCLARHRKIHTGEKPYKCNDCGKAYTQRSSLTKHLVIHTGENPYHCNEFGEAFIQSSKLARYHRNPTGEKPHKCSECGRTFSHKTSLVYHQRRHTGEMPYKCIECGKVFNSTTTLARHRRIHTGEKPYKCNECGKVFRYRSGLARHWSIHTGEKPYKCNECGKAFRVRSILLNHQMMHTGEKPYKCNECGKAFIERSNLVYHQRNHTGEKPYKCMECGKAFGRRSCLTKHQRIHSSEKPYKCNECGKSYISRSGLTKHQIKHAGENLTTKLNVERPLDVVLTSGIPK

SEQ ID NO: 7417 - protein, 666 aa, Homo sapiens
MDLVAFEDVAVNFTQEEWSLLDPSQKNLYREVMQETLRNLASIGEKWKDQNIEDQYKNPRNNLRSLLGERVDENTEENHCGETSSQIPDDTLNKKTSPGVKSCESSVCGEVFVGHSSLNRHIRADTAHKPSEYQEYGQEPYKCQQRKKAFRCHPSFQMQEKAHTGEKLYDCKECGKTFISHSSIQRHMIMHNGDGTYKCKFCGKACPCLSIYLIHERVHTGEKPYKCKQCGKAFSYSTSLQIHERTHTGEKPYECKECGKAFGSPNSLYEHRRTHTGEKPYECKQCGKAFRWFHSFQIHERTHSEEKAYECTKCGKAFKCPSYLCRHEVTHSGKKPCECKQCGKALSYLNFQRHMKMHTRMRPYKCKTVEKPLILPVRFEDMKELTLERNLMNASTVVKPSIVPVPFTIMKGLTLERNPMNVSSVVKPSFLPLPFDIMKGLTLERNRMSVSNVGKPSDLPHTFKCMEGLTLKRNPMNVSSVVKPSFFPLPFDIMKGLTLERNPMSVSNVGKPSHLPHTFKCMKGLTLESNCMNLNNVKKPLDLSETFKFMKRHTLERNPIRNMEKHSTISLPFKYMQQCTEDRMPMNVKSVTKHSYLPRSFEYMQEHTLERNPMNVRNAEKRSIIFLLCVYTKGCTLERNHINVRIVGKHSVCLVPFVDIKGLTLE

SEQ ID NO: 7418 - protein, 344 aa, Homo sapiens
MDLVAFEDVAVNFTQEEWSLLDPSQKNLYREVMQETLRNLASIGEKWKDQNIEDQYKNPRNNLRSLLGERVDENTEENHCGETSSQIPDDTLNKKTSPGVKSCESSVCGEVFVGHSSLNRHIRADTCHPSFQMQEKAHTGEKLYDCKECGKTFISHSSIQRHMIMHNGDGTYKCKFCGKACPCLSIYLIHERVHTGEKPYKCKQCGKAFSYSTSLQIHERTHTGEKPYECKECGKAFGSPNSLYEHRRTHTGEKPYECKQCGKAFRWFHSFQIHERTHSEEKAYECTKCGKAFKCPSYLCRHEVTHSGKKPCECKQCGKALSYLNFQRHERTHTGEKPYECKHC

SEQ ID NO: 7419 - protein, 525 aa, Homo sapiens
MDLVAFEDVAVNFTQEEWSLLDPSQKNLYREVMQETLRNLASIGEKWKDQNIEDQYKNPRNNLRSLLGERVDENTEENHCGETSSQIPDDTLNKKTSPGVKSCESSVCGEVFVGHSSLNRHIRADTAHKPSEYQEYGQEPYKCQQRKKAFRCHPSFQMQEKAHTGEKLYDCKECGKTFISHSSIQRHMIMHNGDGTYKCKFCGKACPCLSIYLIHERVHTGEKPYKCKQCGKAFSYSTSLQIHERTHTGEKPYECKECGKAFGSPNSLYEHRRTHTGEKPYECKQCGKAFRWFHSFQIHERTHSEEKAYECTKCGKAFKCPSYLCRHEVTHSGKKPCECKQCGKALSYLNFQRHMKMHTRMRPYKCKTVEKPLILPVRFEDMKELTLERNLMNASTVVKPSIVPVPFTIMKGLTLERNPMNVSSVVKPSFLPLPFDIMKGLTLERNRMSVSNVGKPSDLPHTFKCMEGLTLKRNPMNVSSVVKPSFFPLPFDIMKGLTLERNPMSVSNVGKPSHLPHTFKCMKGQ

SEQ ID NO: 7420 - protein, 60 aa, Homo sapiens
LSLPQGLLTFRDVAIEFSQEEWKCLDPAQRTLYRDVMLENYRNLVSLGSSAVCDLGSPQP

SEQ ID NO: 7421 - protein, 886 aa, Homo sapiens
MALSQGLLTFRDVAIEFSQEEWKCLDPAQRTLYRDVMLENYRNLVSLDISSKCMMKEFSSTAQGNTEVIHTGTLQRHERHHIGDFCFQEMEKDIHDFEFQWKEDERNSHEAPMTEIKQLTGSTNRHDQRHAGNKPIKDQLGSSFHSHLPELHMFQTEGKIGNQVEKSINSASLVSTSQRISCRPKTHISKNYGNNFLNSSLLTQKQEVHMREKSFQCNESGKAFNYSSVLRKHQIIHLGAKQYKCDVCGKVFNQKRYLACHRRCHTGKKPYKCNDCGKTFSQELTLTCHHRLHTGEKHYKCSECGKTFSRNSALVIHKAIHTGEKSYKCNECGKTFSQTSYLVYHRRLHTGEKPYKCEECDKAFSFKSNLERHRKIHTGEKPYKCNECSRTFSRKSSLTRHRRLHTGEKPYKCNDCGKTFSQMSSLVYHRRLHTGEKPYKCEECDEAFSFKSNLERHRRIHTGEKPYKCNDCGKTFSQTSSLVYHRRLHTGEKPYKCEECDEAFSFKSNLERHRIIHTGEKLYKCNECGKTFSRKSSLTRHCRLHTGEKPYQCNECGKAFRGQSALIYHQAIHGIGKLYKCNDCHQVFSNATTIANHWRIHNEERSYKCNRCGKFFRHRSYLAVHWRTHSGEKPYKCEECDEAFSFKSNLQRHRRIHTGEKPYKCEECDKVFSRKSSLEKHRRIHTGEKPYKCKVCDKAFGRDSHLAQHTRIHTGEKPYKCNECGKNFRHNSALVIHKAIHSGEKPYKCNECGKTFRHNSALEIHKAIHTGEKPYKCSECGKVFNRKANLSRHHRLHTGEKPYKCNKCGKVFNQQAHLACHHRIHTGEKPYKCNECGKTFRHNSVLVIHKTIHTGEKPYKCNECGKVFNRKAKLARHHRIHTGKKH

SEQ ID NO: 7422 - protein, 970 aa, Homo sapiens
MALSQGLLTFRDVAIEFSQEEWKCLDPAQRTLYRDVMLENYRNLVSLDISSKCMMKEFSSTAQGNTEVIHTGTLQRHERHHIGDFCFQEMEKDIHDFEFQWKEDERNSHEAPMTEIKQLTGSTNRHDQRHAGNKPIKDQLGSSFHSHLPELHMFQTEGKIGNQVEKSINSASLVSTSQRISCRPKTHISKNYGNNFLNSSLLTQKQEVHMREKSFQCNESGKAFNYSSVLRKHQIIHLGAKQYKCDVCGKVFNQKRYLACHRRCHTGKKPYKCNDCGKTFSQELTLTCHHRLHTGEKHYKCSECGKTFSRNSALVIHKAIHTGEKSYKCNECGKTFSQTSYLVYHRRLHTGEKPYKCEECDKAFSFKSNLERHRKIHTGEKPYKCNECSRTFSRKSSLTRHRRLHTGEKPYKCNDCGKTFSQMSSLVYHRRLHTGEKPYKCEECDEAFSFKSNLERHRRIHTGEKPYKCNDCGKTFSQTSSLVYHRRLHTGEKPYKCEECDEAFSFKSNLERHRIIHTGEKLYKCNECGKTFSRKSSLTRHCRLHTGEKPYQCNECGKAFRGQSALIYHQAIHGIGKLYKCNDCHQVFSNATTIANHWRIHNEERSYKCNRCGKFFRHRSYLAVHWRTHSGEKPYKCEECDEAFSFKSNLQRHRRIHTGEKPYRCNECGKTFSRKSYLTCHRRLHTGEKPYKCNECGKTFGRNSALIIHKAIHTGEKPYKCNECGKAFSQKSSLTCHLRLHTGEKPYKCEECDKVFSRKSSLEKHRRIHTGEKPYKCKVCDKAFGRDSHLAQHTRIHTGEKPYKCNECGKNFRHNSALVIHKAIHSGEKPYKCNECGKTFRHNSALEIHKAIHTGEKPYKCSECGKVFNRKANLSRHHRLHTGEKPYKCNKCGKVFNQQAHLACHHRIHTGEKPYKCNECGKTFRHNSVLVIHKTIHTGEKPYKCNECGKVFNRKAKLARHHRIHTGKKH

SEQ ID NO: 7423 - protein, 533 aa, Homo sapiens
MDSSQHLVTFEDVAVDFTQEEWTLLDQAQRDLYRDVMLENYKNLIILAGSELFKRSLMSGLEQMEELRTGVTGVLQELDLQLKTKGSPLLQDISAERSPNGVQLERSNTAEKLYDSNHSGKVFNEHPFLMTHMITHIGEKTSEDNQSGKALRKNFPHSFYKKSHAEGKMPKCVKHEKAFNQFPNLTRQNKTHTQEKLCECKDCWRTFLNQSSLKLHIRSHNGDKHYVCKECGKAFSNSSHLIGHGRIHSGEKPYVCKECGKAFTQSTGLKLHIRTHSGEKPYKCKECGKAFTHSSYLTDHTRIHSGKKPYVCMECGKAFTRSTGLILHMRIHTGEKPYECKECGKAFIHSSYLTKHVRIHSGEKLYLCKACGKAFTRSSGLVLHMRTHTGEKPYECKECGKAFNNSSMLSQHVRIHTGEKPYECKECGKAFTQSSGLSTHLRTHTGEKACECKECGKAFARSTNLNMHMRTHTGEKPYACKECGKAFRYSTYLNVHTRTHTGAKPYECKKCGKNFTQSSALAKHLRTKACEKT

SEQ ID NO: 7424 - protein, 632 aa, Homo sapiens
MLREEAAQKRKEKEPGMALPQGHLTFRDVAIEFSLEEWKCLDPTQRALYRAMMLENYRNLHSVDISSKCMMKKFSSTAQGNTEVDTGTLERHESHHIGDFCFQKIGKDIHDFEFQWQEDKRNSHEATMTQIKKLTGSTDRYDRRHPGNKPIKDQLGLSFHSHLPELHIFQTKGKVGNQVEKSINDASSVLTSQRISSRPKIHISNNYENNFFHSSLLTLKQEVHIREKSFQCNESGKAFNCSSLLRKHQIIYLGGKQYKCDVCGKVFNQKRYLACHHRCHTGEKPYKCNECGKVFNQQSNLASHHRLHTGEKPYKCEECDKVFSRKSNLERHRRIHTGEKPYKCKVCEKAFRRDSHLTQHTRIHTGEKPYKCNECGKAFSGQSTLIHHQAIHGIGKLYKCNDCHKVFSNATTIANHWRIHNEERSYKCNKCGKFFRRRSYLVVHWRTHTGEKPYKCNECGKTFHHNSALVIHKAIHTGEKPYKCNECGKTFRHNSALVIHKAIHTGEKPYKCNECGKVFNQQATLARHHRLHTGEKPYKCEECDTVFSRKSHHETHKRIHTGEKPYKCDDFDEAFSQASSYAKQRRIHMGEKHHKCDDCGKAFTSHSHRIRHQRIHTGQKSYKCHKRGKVFS

SEQ ID NO: 7425 - protein, 1169 aa, Homo sapiens
MEPRESGKAPVTFDDITVYLLQEEWVLLSQQQKELCGSNKLVAPLGPTVANPELFRKFGRGPEPWLGSVQGQRSLLEHHPGKKQMGYMGEMEVQGPTRESGQSLPPQKKAYLSHLSTGSGHIEGDWAGRNRKLLKPRSIQKSWFVQFPWLIMNEEQTALFCSACREYPSIRDKRSRLIEGYTGPFKVETLKYHAKSKAHMFCVNALAARDPIWAARFRSIRDPPGDVLASPEPLFTADCPIFYPPGPLGGFDSMAELLPSSRAELEDPGGDGAIPAMYLDCISDLRQKEITDGIHSSSDINILYNDAVESCIQDPSAEGLSEEVPVVFEELPVVFEDVAVYFTREEWGMLDKRQKELYRDVMRMNYELLASLGPAAAKPDLISKLERRAAPWIKDPNGPKWGKGRPPGNKKMVAVREADTQASAADSALLPGSPVEARASCCSSSICEEGDGPRRIKRTYRPRSIQRSWFGQFPWLVIDPKETKLFCSACIERPNLHDKSSRLVRGYTGPFKVETLKYHEVSKAHRLCVNTVEIKEDTPHTALVPEISSDLMANMEHFFNAAYSIAYHSRPLNDFEKILQLLQSTGTVILGKYRNRTACTQFIKYISETLKREILEDVRNSPCVSVLLDSSTDASEQACVGIYIRYFKQMEVKESYITLAPLYSETADGYFETIVSALDELDIPFRKPGWVVGLGTDGSAMLSCRGGLVEKFQEVIPQLLPVHCVAHRLHLAVVDACGSIDLVKKCDRHIRTVFKFYQSSNKRLNELQEGAAPLEQEIIRLKDLNAVRWVASRRRTLHALLVSWPALARHLQRVAEAGGQIGHRAKGMLKLMRGFHFVKFCHFLLDFLSIYRPLSEVCQKEIVLITEVNATLGRAYVALESLRHQAGPKEEEFNASFKDGRLHGICLDKLEVAEQRFQADRERTVLTGIEYLQQRFDADRPPQLKNMEVFDTMAWPSGIELASFGNDDILNLARYFECSLPTGYSEEALLEEWLGLKTIAQHLPFSMLCKNALAQHCRFPLLSKLMAVVVCVPISTSCCERGFKAMNRIRTDERTKLSNEVLNMLMMTAVNGVAVTEYDPQPAIQHWYLTSSGRRFSHVYTCAQVPARSPASARLRKEEMGALYVEEPRTQKPPILPSREAAEVLKDCIMEPPERLLYPHTSQEAPGMS

SEQ ID NO: 7426 - protein, 563 aa, Homo sapiens
MARRLLPAHVQESVTFRDVAVFFSQDEWLHLDSAQRALYREVMLENYSILVSLGILFSKPKVISQLEQGEDPWMVESGVPQGAHLGWESLFGTIVSKEENQEVMKKLIIDGTFDFKLEKTYINEDKLEKQQGKKNRLFSKVLVTIKKVYMKERSFKGVEFGKNLGLKSSLIRKPRIVSRGRRPRSQQYSVLFKQLGVNTVRKCYKCNICGKIFLHSSSLSKHQRIHTGEKLYKCKECRKAFSQSSSLTQHLRVHTGEKPYICSECGKAFSFTTSLIGHQRMHTGERPYKCKECGKTFKGSSSLNNHQRIHTGEKPYKCNECGRAFSQCSSLIQHHRIHTGEKPYECTQCGKAFTSISRLSRHHRIHTGEKPFHCNECGKVFSYHSALIIHQRIHTGEKPYACKECGKAFSQSSALIQHQRIHTGEKPYKCNECGKAFSWISRLNIHHRIHTGEKPYNCKECGKAFSSHSGVNTHRKIHTGEKPYKCNDCEKAFNQSSALIQHQRIHTGEKPYNCKVCGKAFRQSSSLMTHMRIHTGEKPYKCKECGKAFSQSSSLTNHQRTHN

SEQ ID NO: 7427 - protein, 41 aa, Homo sapiens
MARRLLPAHVQESVTFRDVAVFFSQDEWLHLDSAQRALYRE

SEQ ID NO: 7428 - protein, 134 aa, Homo sapiens
MARRLLPAHVQESVTFRDVAVFFSQDEWLHLDSAQRALYREVMLENYSILVSLGILFSKPKVISQLEQGEDPWMVESGVPQGAHLGWESLFGTIVSKEENQEVMKKLIIDGTFDFKLEKTYINEDKLEKQQGKK

SEQ ID NO: 7429 - protein, 570 aa, Homo sapiens
MPGETEEPRPPEQQDQEGGEAAKAAPEEPQQRPPEAVAAAPAGTTSSRVLRGGRDRGRAAAAAAAAAVSRRRKAEYPRRRRSSPSARPPDVPGQQPQAAKSPSPVQGKKSPRLLCIEKVTTDKDPKEEKEEEDDSALPQEVSIAASRPSRGWRSSRTSVSRHRDTENTRSSRSKTGSLQLICKSEPNTDQLDYDVGEEHQSPGGISSEEEEEEEEEMLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTDQRDYICEYCARAFKSSHNLAVHRMIHTGEKPLQCEICGFTCRQKASLNWHMKKHDADSFYQFSCNICGKKFEKKDSVVAHKAKSHPEVLIAEALAANAGALITSTDILGTNPESLTQPSDGQGLPLLPEPLGNSTSGECLLLEAEGMSKSYCSGTERVSLMADGKIFVGSGSSGGTEGLVMNSDILGATTEVLIEDSDSAGP

SEQ ID NO: 7430 - protein, 529 aa, Homo sapiens
MPGETEEPRPPEQQDQEGGEAAKAAPEEPQQRPPEAVAAAPAGTTSSRVLRGGRDRGRAAAAAAAAAVSRRRKAEYPRRRRSSPSARPPDVPGQQPQAAKSPSPVQGKKSPRLLCIEKVTTDKDPKEEKEEEDDSALPQEVSIAASRPSRGWRSSRTSVSRHRDTENTRSSRSKTGSLQLICKSEPNTDQLDYDVGEEHQSPGGISSEEEEEEEEEMLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTDQRDYICEYCARAFKSSHNLAVHRMIHTGEKPLQCEICGFTCRQKASLNWHMKKHDADSFYQFSCNICGKKFEKKDSVVAHKAKSHPEVLIAEALAANAGALITSTDILGTNPESLTQPSDGQGLPLLPEPLGNSTSGECLLLEAEGMSKSYCSGTERARHR

SEQ ID NO: 7431 - protein, 487 aa, Homo sapiens
MAAAALRAPTQVTVSPETHMDLTKGCVTFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGECTNHHQHQKHHSAKKSLKRDMDRASYVKCCLFCMSLKPFRKWEVGKDLPAMLRLLRSLVFPGGKKPGTITECGEDIRSQKSHYKSGECGKASRHKHTPVYHPRVYTGKKLYECSKCGKAFRGKYSLVQHQRVHTGERPWECNECGKFFSQTSHLNDHRRIHTGERPYECSECGKLFRQNSSLVDHQKIHTGARPYECSQCGKSFSQKATLVKHQRVHTGERPYKCGECGNSFSQSAILNQHRRIHTGAKPYECGQCGKSFSQKATLIKHQRVHTGERPYKCGDCGKSFSQSSILIQHRRIHTGARPYECGQCGKSFSQKSGLIQHQVVHTGERPYECNKCGNSFSQCSSLIHHQKCHNT

SEQ ID NO: 7432 - protein, 438 aa, Homo sapiens
MDLTKGCVTFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGECTNHHQHQKHHSAKKSLKRDMDRASYVKCCLFCMSLKPFRKWEVGKDLPAMLRLLRSLVFPGGKKPGTITECGEDIRSQKSHYKSGECGKASRHKHTPVYHPRVYTGKKLYECSKCGKAFRGKYSLVQHQRVHTGERPWECNECGKFFSQTSHLNDHRRIHTGERPYECSQCGKSFSQKATLVKHQRVHTGERPYKCGECGNSFSQSAILNQHRRIHTGAKPYECGQCGKSFSQKATLIKHQRVHTGERPYKCGDCGKSFSQSSILIQHRRIHTGARPYECGQCGKSFSQKSGLIQHQVVHTGERPYECNKCGNSFSQCSSLIHHQKCH

SEQ ID NO: 7433 - protein, 474 aa, Homo sapiens
MAAAALRAPTQGCVTFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGECTNHHQHQKHHSAKKSLKRDMDRASYVKCCLFCMSLKPFRKWEVGKDLPAMLRLLRSLVFPGGKKPGTITECGEDIRSQKSHYKSGECGKASRHKHTPVYHPRVYTGKKLYECSKCGKAFRGKYSLVQHQRVHTGERPWECNECGKFFSQTSHLNDHRRIHTGERPYECSECGKLFRQNSSLVDHQKIHTGARPYECSQCGKSFSQKATLVKHQRVHTGERPYKCGECGNSFSQSAILNQHRRIHTGAKPYECGQCGKSFSQKATLIKHQRVHTGERPYKCGDCGKSFSQSSILIQHRRIHTGARPYECGQCGKSFSQKSGLIQHQVVHTGERPYECNKCGNSFSQCSSLIHHQKCHNT

SEQ ID NO: 7434 - protein, 487 aa, Homo sapiens; identical to SEQ ID NO: 7431

SEQ ID NO: 7435 - protein, 563 aa, Homo sapiens
MMTAESREATGLSPQAAQEKDGIVIVKVEEEDEEDHMWGQDSTLQDTPPPDPEIFRQRFRRFCYQNTFGPREALSRLKELCHQWLRPEINTKEQILELLVLEQFLSILPKELQVWLQEYRPDSGEEAVTLLEDLELDLSGQQVPGQVHGPEMLARGMVPLDPVQESSSFDLHHEATQSHFKHSSRKPRLLQSRALPAAHIPAPPHEGSPRDQAMASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERASEYSPASLDAFGAFLKSCV

SEQ ID NO: 7436 - protein, 527 aa, Homo sapiens
MWGQDSTLQDTPPPDPEIFRQRFRRFCYQNTFGPREALSRLKELCHQWLRPEINTKEQILELLVLEQFLSILPKELQVWLQEYRPDSGEEAVTLLEDLELDLSGQQVPGQVHGPEMLARGMVPLDPVQESSSFDLHHEATQSHFKHSSRKPRLLQSRALPAAHIPAPPHEGSPRDQAMASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERASEYSPASLDAFGAFLKSCV

SEQ ID NO: 7437 - protein, 125 aa, Homo sapiens
MMTAESREATGLSPQAAQEKDGIVIVKVEEEDEEDHMWGQDSTLQDTPPPDPEIFRQRFRRFCYQNTFGPREALSRLKELCHQWLRPEINTKEQILELLVLEQFLSILPKELQVWLQEYRPDSGE

SEQ ID NO: 7438 - protein, 350 aa, Homo sapiens
MASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERASEYSPASLDAFGAFLKSCV

SEQ ID NO: 7439 - protein, 967 aa, Homo sapiens
MAVALDSQIDAPLEVEGCLIMKVEKDPEWASEPILEGSDSSETFRKCFRQFCYEDVTGPHEAFSKLWELCCRWLKPEMRSKEQILELLVIEQFLTILPEKIQAWAQKQCPQSGEEAVALVVHLEKETGRLRQQVSSPVHREKHSPLGAAWEVADFQPEQVETQPRAVSREEPGSLHSGHQEQLNRKRERRPLPKNARPSPWVPALADEWNTLDQEVTTTRLPAGSQEPVKDVHVARGFSYRKSVHQIPAQRDLYRDFRKENVGNVVSLGSAVSTSNKITRLEQRKEPWTLGLHSSNKRSILRSNYVKEKSVHAIQVPARSAGKTWREQQQWGLEDEKIAGVHWSYEETKTFLAILKESRFYETLQACPRNSQVYGAVAEWLRECGFLRTPEQCRTKFKSLQKSYRKVRNGHMLEPCAFFEDMDALLNPAARAPSTDKPKEMIPVPRLKRIAISAKEHISLVEEEEAAEDSDDDEIGIEFIRKSEIHGAPVLFQNLSGVHWGYEETKTFLDILRETRFYEALQACHRKSKLYGAVAEQLRECGFLRTPEQCRTKFKSLQKSYRKVKNGHVLESCAFYKEMDALINSRASAPSPSTPEEVPSPSRQERGGIEVEPQEPTGWEPEETSQEAVIEDSCSERMSEEEIVQEPEFQGPPGLLQSPNDFEIGSSIKEDPTQIVYKDMEQHRALIEKSKRVVSQSTDPSKYRKRECISGRQWENLQGIRQGKPMSQPRDLGKAVVHQRPFVGKRPYRLLKYGESFGRSTRLMCRMTHHKENPYKCGVCGKCFGRSRSLIRHQRIHTGEKPFKCLDCGKSFNDSSNFGAHQRIHTGEKPYRCGECGKCFSQSSSLIIHQRTHTGEKPYQCGECGKSFTNSSHFSAHRRVHTGENPYKCVDCEKSFNNCTRFREHRRIHTGEKPYGCAQCGKRFSKSSVLTKHREVHVREKPLPHPPSLYCPENPHKGKTDEFRKTF

SEQ ID NO: 7440 - protein, 836 aa, Homo sapiens [sequence omitted]

SEQ ID NO: 7441 - protein, 839 aa, Homo sapiens
MIMTESREVIDLDPPAETSQEQEDLFIVKVEEEDCTWMQEYNPPTFETFYQRFRHFQYHEASGPREALSQLRVLCCEWLRPELHTKEQILELLVLEQFLTILPEEFQPWVREHHPESGEEAVAVIENIQRELEERRQQIVACPDVLPRKMATPGAVQESCSPHPLTVDTQPEQAPQKPRLLEENALPVLQVPSLPLKDSQELTASLLSTGSQKLVKIEEVADVAVSFILEEWGHLDQSQKSLYRDDRKENYGSITSMGYESRDNMELIVKQISDDSESHWVAPEHTERSVPQDPDFAEVSDLKGMVQRWQVNPTVGKSRQNPSQKRDLDAITDISPKQSTHGERGHRCSDCGKFFLQASNFIQHRRIHTGEKPFKCGECGKSYNQRVHLTQHQRVHTGEKPYKCQVCGKAFRVSSHLVQHHSVHSGERPYGCNECGKNFGRHSHLIEHLKRHFREKSQRCSDKRSKNTKLSVKKKISEYSEADMELSGKTQRNVSQVQDFGEGCEFQGKLDRKQGIPMKEILGQPSSKRMNYSEVPYVHKKSSTGERPHKCNECGKSFIQSAHLIQHQRIHTGEKPFRCEECGKSYNQRVHLTQHQRVHTGEKPYTCPLCGKAFRVRSHLVQHQSVHSGERPFKCNECGKGFGRRSHLAGHLRLHSREKSHQCRECGEIFFQYVSLIEHQVLHMGQKNEKNGICEEAYSWNLTVIEDKKIELQEQPYQCDICGKAFGYSSDLIQHYRTHTAEKPYQCDICRENVGQCSHTKQHQKIYSSTKSHQCHECGRGFTLKSHLNQHQRIHTGEKPFQCKECGMNFSWSCSLFKHLRSHERTDPINTLSVEGSLL

SEQ ID NO: 7442 - protein, 839 aa, Homo sapiens; identical to SEQ ID NO: 7441

SEQ ID NO: 7443 - protein, 96 aa, Homo sapiens
FRHFQYHEASGPREALSQLRVLCCEWLRPELHTKEQILELLVLEQFLTILPEEFQPWVREHHPESGEEAVAVIENIQRELEERRQQVSRAQWLTLV

SEQ ID NO: 7444 - protein, 839 aa, Homo sapiens; identical to SEQ ID NO: 7441

SEQ ID NO: 7445 - protein, 766 aa, Homo sapiens
MIMTESREVIDLDPPAETSQEQEDLFIVKVEEEDCTWMQEYNPPTFETFYQRFRHFQYHEASGPREALSQLRVLCCEWLRPELHTKEQILELLVLEQFLTILPEEFQPWVREHHPESGEEAVAVIENIQRELEERRQQIVACPDVLPRKMATPGAVQESCSPHPLTVDTQPEQAPQKPRLLEENALPVLQVPSLPLKDSQELTASLLSTGSQKLVKIEEVADVAVSFILEEWGHLDQSQKSLYRDDRKENYGSITSMGYESRDNMELIVKQISDDSESHWVAPEHTERSVPQDPDFAEVSDLKGMVQRWQVNPTVGKSRQNPSQKRDLDAITDISPKQSTHGERGHRCSDCGKFFLQASNFIQHRRIHTGEKPFKCGECGKSYNQRVHLTQHQRVHTGEKPYKCQVCGKAFRVSSHLVQHHSVHSGERPYGCNECGKNFGRHSHLIEHLKRHFREKSQRCSDKRSKNTKLSVKKKISEYSEADMELSGKTQRNVSQVQDFGEGCEFQGKLDRKQGIPMKEILGQPSSKRMNYSEVPYVHKKSSTGERPHKCNECGKSFIQSAHLIQHQRIHTGEKPFRCEECGKSYNQRVHLTQHQRVHTGEKPYTCPLCGKAFRVRSHLVQHQSVHSGERPFKCNECGKGFGRRSHLAGHLRLHSREKSHQCRECGEIFFQYVSLIEHQVLHMGQKNEKNGICEEAYSWNLTVIEDKKIELQEQPYQCDICGKAFGYSSDLIQHYRTHTAEKPYQCDICRVVIYRMSFSLHCSWD

SEQ ID NO: 7446 - protein, 481 aa, Homo sapiens
MRGLPRKREAWTQPHPLEALYESLRVLEKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACSSSLESMQLSLITCSQCMRKVGLWGFQQIESSMTDLDASFGLTSSPIPGLEGRPERLPLVPESPRRMMTRSQDATFSPGSEQAEKSPGPIVSRTRSWDSSSPVDRPEPEAASPTTRTRPVTRSMGTGDTPGLEVPSSPLRKAKRARLCSSSSSDTSSRSFFDPTSQHRDWCPWVNITLGKESRENGGTEPDASAPAEPGWKAVLTILLAHKQSSQPAETDSMSLSEKSRKVFRIFRQWESLCSC

SEQ ID NO: 7447 - protein, 502 aa, Homo sapiens
MAAPCEGQAFAVGVEKNWGAVVRSPEGTPQKIRQLIDEGIAPEEGGVDAKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACSSSLESMQLSLITCSQCMRKVGLWGFQQIESSMTDLDASFGLTSSPIPGLEGRPERLPLVPESPRRMMTRSQDATFSPGSEQAEKSPGPIVSRTRSWDSSSPVDRPEPEAASPTTRTRPVTRSMGTGDTPGLEVPSSPLRKAKRARLCSSSSSDTSSRSFFDPTSQHRDWCPWVNITLGKESRENGGTEPDASAPAEPGWKAVLTILLAHKQSSQPAETDSMSLSEKSRKVFRIFRQWESLCSC

SEQ ID NO: 7448 - protein, 431 aa, Homo sapiens
MAAPCEGQAFAVGVEKNWGAVVRSPEGTPQKIRQLIDEGIAPEEGGVDAKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACSSSLESMQLSLITCSQCMRKVGLWGFQQIESSMTDLDASFGLTSSPIPGLEGRPERLPLVPESPRRMMTRSQDATFSPGSEQDTSSRSFFDPTSQHRDWCPWVNITLGKESRENGGTEPDASAPAEPGWKAVLTILLAHKQSSQPAETDSMSLSEKSRKVFRIFRQWESLCSC

SEQ ID NO: 7449 - protein, 531 aa, Homo sapiens
MDEESLESALQTYRAQLQQVELALGAGLDSSEQADLRQLQGDLKELIELTEASLVSVRKSSLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSAQSSALCPSLAVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 7450 - protein, 511 aa, Homo sapiens
MDEESLESALQTYRAQLQQVELALGAGLDSSEQADLRQLQGDLKELIELTEASLVSVRKSSLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 7451 - protein, 502 aa, Homo sapiens
MDEESLESALQTYRAQLQQVELALGAGLDSSEQADLRQLQGDLKELIELTEASLVSVRKSSLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 7452 - protein, 511 aa, Homo sapiens; identical to SEQ ID NO: 7450

SEQ ID NO: 7453 - protein, 97 aa, Homo sapiens
MDEESLESALQTYRAQLQQVELALGAGLDSSEQADLRQLQGDLKELIELTEASLVSVRKSSLLAALDEERPGRQEDAEYQAFREAITEAVEAPAAAR

SEQ ID NO: 7454 - protein, 511 aa, Homo sapiens; identical to SEQ ID NO: 7450

SEQ ID NO: 7455 - protein, 472 aa, Homo sapiens
MNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLAREVPSINKETLTTQKGVECDGSKKILPLGIDDVSSLQHYVQNNSHDDNGYRKLVGNNPSKFVGQQLKCNACRKLFSSKSRLQSHLRRHACQKPFECHSCGRAFGEKWKLDKHQKTHAEERPYKCENCGNAYKQKSNLFQHQKMHTKEKPYQCKTCGKAFSWKSSCINHEKIHNAKKSYQCNECEKSFRQNSTLIQHKKVHTGQKPFQCTDCGKAFIYKSDLVKHQRIHTGEKPYKCSICEKAFSQKSNVIDHEKIHTGKRAYECDLCGNTFIQKKNLIQHKKIHTGEKPYECNRCGKAFFQKSNLHSHQKTHSGERTYRCSECGKTFIRKLNLSLHKKTHTGQKPYGCSECGKAFADRSYLVRHQKRIHSR

SEQ ID NO: 7456 - protein, 638 aa, Homo sapiens
MESCSVTRLECSGAISAHCSLHLPGSSDSPASASQIAGTTDAIWNEQEKAELFTDKFCQVCGVMLQFESQRISHYEGEKHAQNVSFYFQMHGEQNEVPGKKMKMHVENFQVHRYEGVDKNKFCDLCNMMFSSPLIAQSHYVGKVHAKKLKQLMEEHDQASPSGFQPEMAFSMRTYVCHICSIAFTSLDMFRSHMQGSEHQIKESIVINLVKNSRKTQDSYQNECADYINVQKARGLEAKTCFRKMEESSLETRRYREVVDSRPRHRMFEQRLPFETFRTYAAPYNISQAMEKQLPHSKKTYDSFQDELEDYIKVQKARGLDPKTCFRKMRENSVDTHGYREMVDSGPRSRMCEQRFSHEASQTYQRPYHISPVESQLPQWLPTHSKRTYDSFQDELEDYIKVQKARGLEPKTCFRKIGDSSVETHRNREMVDVRPRHRMLEQKLPCETFQTYSGPYSISQVVENQLPHCLPAHDSKQRLDSISYCQLTRDCFPEKPVPLSLNQQENNSGSYSVESEVYKHLSSENNTADHQAGHKQKHQKRKRHLEEGKERPEKEQSKHKRKKSYEDTDLDKDKSIRQRKREEDRVKVSSGKLKHRKKKKSHDVPSEKEERKHRKEKKKSVEERTEEEMLWDESILGF

SEQ ID NO: 7457 - protein, 467 aa, Homo sapiens
MRTYVCHICSIAFTSLDMFRSHMQGSEHQIKESIVINLVKNSRKTQDSYQNECADYINVQKARGLEAKTCFRKMEESSLETRRYREVVDSRPRHRMFEQRLPFETFRTYAAPYNISQAMEKQLPHSKKTYDSFQDELEDYIKVQKARGLDPKTCFRKMRENSVDTHGYREMVDSGPRSRMCEQRFSHEASQTYQRPYHISPVESQLPQWLPTHSKRTYDSFQDELEDYIKVQKARGLEPKTCFRKIGDSSVETHRNREMVDVRPRHRMLEQKLPCETFQTYSGPYSISQVVENQLPHCLPAHDSKQRLDSISYCQLTRDCFPEKPVPLSLNQQENNSGSYSVESEVYKHLSSENNTADHQAGHKQKHQKRKRHLEEGKERPEKEQSKHKRKKSYEDTDLDKDKSIRQRKREEDRVKVSSGKLKHRKKKKSHDVPSEKEERKHRKEKKKSVEERTEEEMLWDESILGF

SEQ ID NO: 7458 - protein, 638 aa, Homo sapiens; identical to SEQ ID NO: 7456

SEQ ID NO: 7459 - protein, 199 aa, Homo sapiens
MASGSGTKNLDFRRKWDKDEYEKLAEKRLTEEREKKDGKPVQPVKRELLRHRDYKVDLESKLGKTIVITKTTPQSEMGGYYCNVCDCVVKDSINFLDHINGKKHQRNLGMSMRVERSTLDQVKKRFEVNKKKMEEKQKDYDFEERMKELREEEEKAKAYKKEKQKEKKRRAEEDLTFEEDDEMAAVMGFSGFGSTKKSY

SEQ ID NO: 7460 - protein, 289 aa, Homo sapiens
MILLQHAVLPPPKQPSPSPPMSVATRSTGTLQLPPQKPFGQEASLPLAGEEELSKGGEQDCALEELCKPLYCKLCNVTLNSAQQAQAHYQGKNHGKKLRNYYAANSCPPPARMSNVVEPAATPVVPVPPQMGSFKPGGRVILATENDYCKLCDASFSSPAVAQAHYQGKNHAKRLRLAEAQSNSFSESSELGQRRARKEGNEFKMMPNRRNMYTVQNNSAGPYFNPRSRQRIPRDLAMCVTPSGQFYCSMCNVGAGEEMEFRQHLESKQHKSKVSEQRYRNEMENLGYV

SEQ ID NO: 7461 - protein, 148 aa, Homo sapiens
MILLQHAVLPPPKQPSPSPPMSVATRSTGTLQLPPQKPFGQEASLPLAGEEELSKGGEQDCALEELCKPLYCKLCNVTLNSAQQAQAHYQGKNHGKKLRNYYAANSCPPPARMSNVVEPAATPVVPVPPQMGSFKPGGRVILATENDY

SEQ ID NO: 7462 - protein, 288 aa, Homo sapiens
MILLQHAVLPPPKQPSPSPPMSVATRSTGTLQLPPQKPFGQEASLPLAGEEELSKGGEQDCALEELCKPLYCKLCNVTLNSAQQAQAHYQGKNHGKKLRNYYAANSCPPPARMSNVVEPAATPVVPVPPQMGSFKPGGRVILATENDYCKLCDASFSSPAVAQAHYQGKNHAKRLRLAEAQSNSFSESSELGQRRARKEGNEFKMMPNRRNMYTVQNNSGPYFNPRSRQRIPRDLAMCVTPSGQFYCSMCNVGAGEEMEFRQHLESKQHKSKVSEQRYRNEMENLGYV

SEQ ID NO: 7463 - protein, 229 aa, Homo sapiens
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTATPLSPLKPPRMDTAPVVASPYQRRDSDRYCGLCAAWFNNPLMAQQHYDGKKHKKNAARVALLEQLGTTLDMGELRGLRRNYRCTICSVSLNSIEQYHAHLKGSKHQTNLKNK

SEQ ID NO: 7464 - protein, 153 aa, Homo sapiens
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTGLRRNYRCTICSVSLNSIEQYHAHLKGSKHQTNLKNK

SEQ ID NO: 7465 - protein, 211 aa, Homo sapiens
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTATPLSPLKPPRMDTAPVVASPYQRRDSDRYCGLCAAWFNNPLMAQQHYDGKKHKKNAARVALLEQLGTTLDMGELRGLRRNYRCTICSVSLNSIE

SEQ ID NO: 7466 - protein, 894 aa, Homo sapiens
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 7467 - protein, 920 aa, Homo sapiens
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTEQFNGQGASFNGGSVSYSQPGLSGPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 7468 - protein, 923 aa, Homo sapiens
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTEQFNGQGASFNGGSVSYSQPGLSGPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCARPQHHPSPSPPAAACVSCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 7469 - protein, 920 aa, Homo sapiens; identical to SEQ ID NO: 7467

SEQ ID NO: 7470 - protein, 90 aa, Homo sapiens
MNSMNPMKPALPPAPHGDGSFAYESVPWQQSATQPAGSLSVVTTVWGVGNATQSQVLGNPMGPAGSPSGSSMMPGVAGGSSALTSPQCLG

SEQ ID NO: 7471 - protein, 1142 aa, Homo sapiens
MKEPLLGGECDKAVASQLGLLDEIKTEPDNAQEYCHRQQSRTQENELKINAVFSESASQLTAGIQLSLASSGVNKMLPSVSTTAIQVSCAGCKKILQKGQTAYQRKGSAQLFCSIPCITEYISSASSPVPSKRTCSNCSKDILNPKDVISVQLEDTTSCKTFCSLSCLSSYEEKRKPFVTICTNSILTKCSMCQKTAIIQYEVKYQNVKHNLCSNACLSKFHSANNFIMNCCENCGTYCYTSSSLSHILQMEGQSHYFNSSKSITAYKQKPAKPLISVPCKPLKPSDEMIETTSDLGKTELFCSINCFSAYSKAKMESSSVSVVSVVHDTSTELLSPKKDTTPVISNIVSLADTDVALPIMNTDVLQDTVSSVTATADVIVDLSKSSPSEPSNAVASSSTEQPSVSPSSSVFSQHAIGSSTEVQKDNMKSMKISDELCHPKCTSKVQKVKGKSRSIKKSCCADFECLENSKKDVAFCYSCQLFCQKYFSCGRESFATHGTSNWKKTLEKFRKHEKSEMHLKSLEFWREYQFCDGAVSDDLSIHSKQIEGNKKYLKLIIENILFLGKQCLPLRGNDQSVSSVNKGNFLELLEMRAKDKGEETFRLMNSQVDFYNSTQIQSDIIEIIKTEMLQDIVNEINDSSAFSIICDETINSAMKEQLSICVRYPQKSSKAILIKERFLGFVDTEEMTGTHLHRTIKTYLQQIGVDMDKIHGQAYDSTTNLKIKFNKIAAEFKKEEPRALYIHCYAHFLDLSIIRFCKEVKELRSALKTLSSLFNTICMSGEMLANFRNIYRLSQNKTCKKHISQSCWTVHDRTLLSVIDSLPEIIETLEVIASHSSNTSFADELSHLLTLVSKFEFVFCLKFLYRVLSVTGILSKELQNKTIDIFSLSSKIEAILECLSSERNDVYFKTIWDGTEEICQKITCKGFKVEKPSLQKRRKIQKSVDLGNSDNMFFPTSTEEQYKINIYYQGLDTILQNLKLCFSEFDYCKIKQISELLFKWNEPLNETTAKHVQEFYKLDEDIIPELRFYRHYAKLNFVIDDSCINFVSLGCLFIQHGLHSNIPCLSKLLYIALSWPITSASTENSFSTLPRLKTYLCNTMGQEKLTGPALMAVEQELVNKLMEPERLNEIVEKFISQMKEI

SEQ ID NO: 7472 - protein, 1067 aa, Homo sapiens
MLPSVSTTAIQVSCAGCKKILQKGQTAYQRKGSAQLFCSIPCITEYISSASSPVPSKRTCSNCSKDILNPKDVISVQLEDTTSCKTFCSLSCLSSYEEKRKPFVTICTNSILTKCSMCQKTAIIQYEVKYQNVKHNLCSNACLSKFHSANNFIMNCCENCGTYCYTSSSLSHILQMEGQSHYFNSSKSITAYKQKPAKPLISVPCKPLKPSDEMIETTSDLGKTELFCSINCFSAYSKAKMESSSVSVVSVVHDTSTELLSPKKDTTPVISNIVSLADTDVALPIMNTDVLQDTVSSVTATADVIVDLSKSSPSEPSNAVASSSTEQPSVSPSSSVFSQHAIGSSTEVQKDNMKSMKISDELCHPKCTSKVQKVKGKSRSIKKSCCADFECLENSKKDVAFCYSCQLFCQKYFSCGRESFATHGTSNWKKTLEKFRKHEKSEMHLKSLEFWREYQFCDGAVSDDLSIHSKQIEGNKKYLKLIIENILFLGKQCLPLRGNDQSVSSVNKGNFLELLEMRAKDKGEETFRLMNSQVDFYNSTQIQSDIIEIIKTEMLQDIVNEINDSSAFSIICDETINSAMKEQLSICVRYPQKSSKAILIKERFLGFVDTEEMTGTHLHRTIKTYLQQIGVDMDKIHGQAYDSTTNLKIKFNKIAAEFKKEEPRALYIHCYAHFLDLSIIRFCKEVKELRSALKTLSSLFNTICMSGEMLANFRNIYRLSQNKTCKKHISQSCWTVHDRTLLSVIDSLPEIIETLEVIASHSSNTSFADELSHLLTLVSKFEFVFCLKFLYRVLSVTGILSKELQNKTIDIFSLSSKIEAILECLSSERNDVYFKTIWDGTEEICQKITCKGFKVEKPSLQKRRKIQKSVDLGNSDNMFFPTSTEEQYKINIYYQGLDTILQNLKLCFSEFDYCKIKQISELLFKWNEPLNETTAKHVQEFYKLDEDIIPELRFYRHYAKLNFVIDDSCINFVSLGCLFIQHGLHSNIPCLSKLLYIALSWPITSASTENSFSTLPRLKTYLCNTMGQEKLTGPALMAVEQELVNKLMEPERLNEIVEKFISQMKEI

SEQ ID NO: 7473 - protein, 1142 aa, Homo sapiens; identical to SEQ ID NO: 7471

SEQ ID NO: 7474 - protein, 462 aa, Homo sapiens
MKEPLLGGECDKAVASQLGLLDEIKTEPDNAQEYCHRQQSRTQENELKINAVFSESASQLTAGIQLSLASSGVNKMLPSVSTTAIQVSCAGCKKILQKGQTAYQRKGSAQLFCSIPCITEYISSASSPVPSKRTCSNCSKDILNPKDVISVQLEDTTSCKTFCSLSCLSSYEEKRKPFVTICTNSILTKCSMCQKTAIIQYEVKYQNVKHNLCSNACLSKFHSANNFIMNCCENCGTYCYTSSSLSHILQMEGQSHYFNSSKSITAYKQKPAKPLISVPCKPLKPSDEMIETTSDLGKTELFCSINCFSAYSKAKMESSSVSVVSVVHDTSTELLSPKKDTTPVISNIVSLADTDVALPIMNTDVLQDTVSSVTATADVIVDLSKSSPSEPSNAVASSSTEQPSVSPSSSVFSQHAIGSSTEVQKDNMKSMKISDELCHPKCTSKVQKVKGKSRSIKKSCCA

SEQ ID NO: 7475 - protein, 669 aa, Homo sapiens
MEKCSVGGLELTEQTPALLGNMAMATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPDSWISQSASFPSNQKQPGVDSLSPVALLRKQNFQPTAQQQLTKPAKITCANCKKPLQKGQTAYQRKGSAHLFCSTTCLSSFSHKRTQNTRSIICKKDASTKKANVILPVESSKSFQEFYSTSCLSPCENNWNLKKGVFNKSRCTICSKLAEIRHEVSVNNVTHKLCSNHCFNKYRLANGLIMNCCEHCGEYMPSKSTGNNILVIGGQQKRFCCQSCINEYKQMMETKSKKLTASENRKRNAFREENEKQLYGSSNTLLKKIEGIPEKKEKTSQLQLSVECGTDTLLIQENVNLPPSSTSTIADTFQEQLEEKNFEDSIVPVVLSADPGTWPRILNIKQRDTLVENVPPQVRNFNFPKDNTGRKFSETYYTRILPNGEKTTRSWLLYSTSKDSVFCLYCKLFGEGKNQLKNENGCKDWQHLSHILSKHEESEMHVNNSVKYSKLKSDLKKNKAIDAAEHRLYENEKNDGVLLLYT

SEQ ID NO: 7476 - protein, 382 aa, Homo sapiens
MEKCSVGGLELTEQTPALLGNMAMATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPDSWISQSASFPSNQKQPGVDSLSPVALLRKQNFQPTAQQQLTKPAKITCANCKKPLQKGQTAYQRKGSAHLFCSTTCLSSFSHKRTQNTRSIICKKDASTKKANVILPVESSKSFQEFYSTSCLSPCENNWNLKKGVFNKSRCTICSKLAEVWIFIPKLLFRLTVIILTFKCYYVLFHLHNARVLDV

SEQ ID NO: 7477 - protein, 208 aa, Homo sapiens
MEKCSVGGLELTEQTPALLGNMAMATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPEMHLQRRLMSFFQ

SEQ ID NO: 7478 - protein, 170 aa, Homo sapiens
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKYKILNIPFYFTFFLVCILFSSNILLIL

SEQ ID NO: 7479 - protein, 1325 aa, Homo sapiens
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKDILNPKDVITTRFENSYPSKDFCSQSCLSSYELKKKPVVTIYTKSISTKCSMCQKNADTRFEVKYQNVVHGLCSDACFSKFHSTNNLTMNCCENCGSYCYSSSGPCQSQKVFSSTSVTAYKQNSAQIPPYALGKSLRPSAEMIETTNDSGKTELFCSINCLSAYRVKTVTSSGVQVSCHSCKTSAIPQYHLAMSNGTIYSFCSSSCVVAFQNVFSKPKGTNSSAVPLSQGQVVVSPPSSRSAVSIGGGNTSAVSPSSIRGSAAASLQPLAEQSQQVALTHTVVKLKCQHCNHLFATKPELLFYKGKMFLFCGKNCSDEYKKKNKVVAMCDYCKLQKIIKETVRFSGVDKPFCSEVCKFLSARDFGERWGNYCKMCSYCSQTSPNLVENRLEGKLEEFCCEDCMSKFTVLFYQMAKCDGCKRQGKLSESIKWRGNIKHFCNLFCVLEFCHQQIMNDCLPQNKVNISKAKTAVTELPSARTDTTPVITSVMSLAKIPATLSTGNTNSVLKGAVTKEAAKIIQDESTQEDAMKFPSSQSSQPSRLLKNKGISCKPVTQTKATSCKPHTQHKECQTDLPMPNEKNDAELDSPPSKKKRLGFFQTYDTEYLKVGFIICPGSKESSPRPQCVICGEILSSENMKPANLSHHLKTKHSELENKPVDFFEQKSLEMECQNSSLKKCLLVEKSLVKASYLIAFQTAASKKPFSIAEELIKPYLVEMCSEVLGSSAGDKMKTIPLSNVTIQHRIDELSADIEDQLIQKVRESKWFALQIDESSEISNITLLLCYIRFIDYDCRDVKEELLFCIEMPTQITGFEIFELINKYIDSKSLNWKHCVGLCTDGAASMTGRYSGLKAKIQEVAMNTAAFTHCFIHRERLVAEKLSPCLHKILLQSAQILSFIKSNALNSRMLTILCEEMGSEHVSLPLHAEVRWISRGRMLKRLFELRHEIEIFLSQKHSDLAKYFHDEEWVGKLAYLSDIFSLINELNLSLQGTLTTFFNLCNKIDVFKRKLKMWLKRTQENDYDMFPSFSEFSNSSGLNMTDITRIIFEHLEGLSQVFSDCFPPEQDLRSGNLWIIHPFMNHQNNNLTDFEEEKLTELSSDLGLQALFKSVSVTQFWINAKTSYPELHERAMKFLLPFSTVYLCDAAFSALTESKQKNLLGSGPALRLAVTSLIPRIEKLVKEKE

SEQ ID NO: 7480 - protein, 170 aa, Homo sapiens; identical to SEQ ID NO: 7478

SEQ ID NO: 7481 - protein, 723 aa, Homo sapiens
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKDILNPKDVITTRFENSYPSKDFCSQSCLSSYELKKKPVVTIYTKSISTKCSMCQKNADTRFEVKYQNVVHGLCSDACFSKFHSTNNLTMNCCENCGSYCYSSSGPCQSQKVFSSTSVTAYKQNSAQIPPYALGKSLRPSAEMIETTNDSGKTELFCSINCLSAYRVKTVTSSGVQVSCHSCKTSAIPQYHLAMSNGTIYSFCSSSCVVAFQNVFSKPKGTNSSAVPLSQGQVVVSPPSSRSAVSIGGGNTSAVSPSSIRGSAAASLQPLAEQSQQVALTHTVVKLKCQHCNHLFATKPELLFYKGKMFLFCGKNCSDEYKKKNKVVAMCDYCKLQKIIKETVRFSGVDKPFCSEVCKFLSARDFGERWGNYCKMCSYCSQTSPNLVENRLEGKLEEFCCEDCMSKFTVLFYQMAKCDGCKRQGKLSESIKWRGNIKHFCNLFCVLEFCHQQIMNDCLPQNKVNISKAKTAVTELPSARTDTTPVITSVMSLAKIPATLSTGNTNSVLKGAVTKEAAKIIQDESTQEDAMKFPSSQSSQPSRLLKNKGISCKPVTQTKATSCKPHTQHKECQTECPVRAVC

SEQ ID NO: 7482 - protein, 208 aa, Homo sapiens
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKDILNPKDVITTRFENSYPSKDFCSQSCLSSYELKKKPVVTIYTKSISTKCSMCQKNADTRFEVKY

SEQ ID NO: 7483 - protein, 562 aa, Homo sapiens
MSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 7484 - protein, 585 aa, Homo sapiens
MVIFTSLHRYVIFISCIIVINWYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 7485 - protein, 602 aa, Homo sapiens
MARLTKRRQADTKAIQHLWAAIEIIRNQKQIANIDRITKYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 7486 - protein, 528 aa, Homo sapiens
MSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWVNTSLF

SEQ ID NO: 7487 - protein, 562 aa, Homo sapiens; identical to SEQ ID NO: 7483

SEQ ID NO: 7488 - protein, 508 aa, Homo sapiens
MSRVHGMHPKETTRQLSLAVKDGLIVETLTVGCKGSKAGIEQEGYWLPGDEISIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 7489 - protein, 517 aa, Homo sapiens
MARLTKRRQADTKAIQHLWAAIEIIRNQKQIANIDRITKYMSRVHGMHPKETTRQLSLAVKDGLIVETLTVGCKGSKAGIEQEGYWLPGDEISIKKKNTNKQEMGTYLRFIVSRMKERKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 7490 - protein, 602 aa, Homo sapiens; identical to SEQ ID NO: 7485

SEQ ID NO: 7491 - protein, 522 aa, Homo sapiens
MARLTKRRQADTKAIQHLWAAIEIIRNQKQIANIDRITKYMSRVHGMHPKETTRQLSLAVKDGLIVETLTVGCKGSKAGIEQEGYWLPGDEISIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHEIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 7492 - protein, 567 aa, Homo sapiens
MARLTKRRQADTKAIQHLWAAIEIIRNQKQIANIDRITKYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGDSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWVNTSLF

SEQ ID NO: 7493 - protein, 397 aa, Homo sapiens
MGTYLRFIVSRMKERAIDLNKKGKDNKHPMYRRLVHSAVDVPTIQELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 7494 - protein, 482 aa, Homo sapiens
MSRVHGMHPKETTRQLSLAVKDGLIVETLTVGCKGSKAGIEQEGYWLPGDEISIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHEIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 7495 - protein, 1169 aa, Homo sapiens
MDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLGHRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 7496 - protein, 1186 aa, Homo sapiens
MDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 7497 - protein, 1160 aa, Homo sapiens
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 7498 - protein, 1214 aa, Homo sapiens
MDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 7499 - protein, 1135 aa, Homo sapiens
MHPQSLAEEEIKTEQEVVEGMDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 7500 - protein, 1136 aa, Homo sapiens
MHPQSLAEEEIKTEQEVVEGMDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 7501 - protein, 1186 aa, Homo sapiens
MFSSLQKSFNLAEEEIKTEQEVVEGMDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 7502 - protein, 24 aa, Homo sapiens
MDISTRSKDPGSAERTAQKRKFPS

SEQ ID NO: 7503 - protein, 42 aa, Homo sapiens
MDISTRSKDPGSAERTAQKRKFPSPPHSSNGHSPQDTSTSPI

SEQ ID NO: 7504 - protein, 1105 aa, Homo sapiens
MDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECETDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 7505 - protein, 1188 aa, Homo sapiens
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 7506 - protein, 1096 aa, Homo sapiens
  MOD_RES (1)..(1): Any amino acid
XTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLGHRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 7507 - protein, 1241 aa, Homo sapiens
MVFLEEFEARSCLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 7508 - protein, 1134 aa, Homo sapiens
MHPQSLAEEEIKTEQEVVEGMDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 7509 - protein, 934 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTQRNQKKKMKKRVKDELRKLNTMTAAEANEIEDVWQLDLSSRWQLY

SEQ ID NO: 7510 - protein, 1918 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTQRNQKKKMKKRVKDELRKLNTMTAAEANEIEDVWQLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKGVSSNLFFVEHNFPEQEIQEGKSHQNQHEAHFVVELCKYFLCQEYLPSQITILTTYTGQLFCLRKLMPAKTFAGVRVHVVDKYQGEENDIILLSLVRSNQEGKVGFLQISNRICVALSRAKKGMYCIGNMQMLAKVPLWSKIIHTLRENNQIGPMLRLCCQNHPETHTLVSKASDFQKVPEGGCSLPCEFRLGCGHVCTRACHPYDSSHKEFQCMKPCQKVICQEGHRCPLVCFQECQPCQVKVPKTIPRCGHEQMVPCSVPESDFCCQEPCSKSLRCGHRCSHPCGEDCVQLCSEMVTIKLKCGHSQPVKCGHVEGLLYGGLLVKCTTKCGTILDCGHPCPGSCHSCFEGRFHERCQQPCKRLLICSHKCQEPCIGECPPCQRTCQNRCVHSQCKKKCGELCSPCVEPCVWRCQHYQCTKLCSEPCNRPPCYVPCTKLLVCGHPCIGLCGEPCPKKCRICHMDEVTQIFFGFEDEPDARFVQLEDCSHIFEVQALDRYMNEQKDDEVAIRLKVCPICQVPIRKNLRYGTSIKQRLEEIEIIKEKIQGSAGEIATSQERLKALLERKSLLHQLLPEDFLMLKEKLAQKNLSVKDLGLVENYISFYDHLASLWDSLKKMHVLEEKRVRTRLEQVHEWLAKKRLSFTSQELSDLRSEIQRLTYLVNLLTRYKIAEKKVKDSIAVEVYSVQNILEKTCKFTQEDEQLVQEKMEALKATLPCSGLGISEEERVQIVSAIGYPRGHWFKCRNGHIYVIGDCGGAMERGTCPDCKEVIGGTNHTLERSNQLASEMDGAQHAAWSDTANNLMNFEEIQGMM

SEQ ID NO: 7511 - protein, 1270 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTQRNQKKKMKKRVKDELRKLNTMTAAEANEIEDVWQLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKAKSNSCRALATGMRRKHKISGMILSFFKLTIRSARFQLLLSGSWTTASFPFSRSRFAVLICRDNKRMPAVKPVSTNTGSHGLQMPGALMGETFQKGSTSRDAAACLLSSLVNKIPPRSLTWASDCCISFSSASSCRTAYTSFSIFSILSRNLRMTSQWEKIKRIYK

SEQ ID NO: 7512 - protein, 1918 aa, Homo sapiens; identical to SEQ ID NO: 7510

SEQ ID NO: 7513 - protein, 915 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTQRNQKKKMKKREKEEKKEREKRRKKK

SEQ ID NO: 7514 - protein, 707 aa, Homo sapiens
SKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTVPCLVLMSADPAQP

SEQ ID NO: 7515 - protein, 61 aa, Homo sapiens
MEERRPHLDARPRNSHTNHRGPVDGELPPRAEIMPLHSSLGDRSKTLSQKKKSFFLVLAPT

SEQ ID NO: 7516 - protein, 320 aa, Homo sapiens
MSTKNFRVSDGDWICPDKKCGNVNFARRTSCNRCGREKTTEAKMMKAGGTEIGKTLAEKSRGLFSANDWQCKTCSNVNWARRSECNMCNTPKYAKLEERTGYGGGFNERENVEYIEREESDGEYDEFGRKKKKYRGKAVGPASILKEVEDKESEGEEEDEDEDLSKYKLDEDEDEDDADLSKYNLDASEEEDSNKKKSNRRSRSKSRSSHSRSSSRSSSPSSSRSRSRSRSRSSSSSQSRSRSSSRERSRSRGSKSRSSSRSHRGSSSPRKRSYSSSSSSPERNRKRSRSRSSSSGDRKKRRTRSRSPESQVIGENTKQP

SEQ ID NO: 7517 - protein, 330 aa, Homo sapiens
MSTKNFRVSDGDWICPDKKCGNVNFARRTSCNRCGREKTTEAKMMKAGGTEIGKTLAEKSRGLFSANDWQCKTCSNVNWARRSECNMCNTPKYAKLEERTGYGGGFNERENVEYIEREESDGEYDEFGRKKKKYRGKAVGPASILKEVEDKESEGEEEDEDEDLSKYKLDEDEDEDDADLSKYNLDASEEEDSNKKKSNRRSRSKSRSSHSRSSSRSSSPSSSRSRSRSRSRSSSSSQSRSRSSSRERSRSRGSKSRSSSRSHRGSSSPRKRSYSSSSSSPERNRKRSRSRSSSSGDRKKRRTRSRSPERRHRSSSGSSHSGSRSSSKKK

SEQ ID NO: 7518 - protein, 485 aa, Homo sapiens
MLERLKAPWSAALQRKYFDLGIWTAPISPMALTMLNGLLIKDSSPPMLLHQVNKTAQLDTFNYQSCFMQSVFDHFPEILFIHRTYNPRGKVLYTFLVDGPRVQLEGHLARAVYFAIPAKEDTEGLAQMFQVFKKFNPAWERVCTILVDPHFLPLPILAMEFPTAEVLLSAFHICKFLQAKFYQLSLERPVERLLLTSLQSTMCSATAGNLRKLYTLLSNCIPPAKLPELHSHWLLNDRIWLAHRWRSRAESSHYFQSLEVTTHILSQFFGTTPSEKQGMASLFRYMQQNSADKANFNQGLCAQNNHAPSDTIPESPKLEQLVESHIQHSLNAICTGPAAQLCLGELAVVQKSTHLIGSGSEKMNIQILEDTHKVQPQPPASCSCYFNQAFHLPCRHILAMLSARRQVLQPDMLPAQWTAGCATSLDSILGSKWSETLDKHLAVTHLTEEVGQLLQHCTKEEFERRYSTLRELADSWIGPYEQVQL

SEQ ID NO: 7519 - protein, 485 aa, Homo sapiens; identical to SEQ ID NO: 7518

SEQ ID NO: 7520 - protein, 140 aa, Homo sapiens
MAVVLPAVVEELLSEMAAAVQESARIPDEYLLSLKFLFGSSATQALDLVDRQSITLISSPSGRRVYQVLGSSSKTYTCLASCHYCSCPAFAFSVLRKSDSILCKHLLAVYLSQVMRTCQQLSVSDKQLTDILLMEKKQEA

SEQ ID NO: 7521 - protein, 140 aa, Homo sapiens; identical to SEQ ID NO: 7520

SEQ ID NO: 7522 - protein, 409 aa, Homo sapiens
MIDLWLYSYQRLLQTIAVLEAQRSQAVQDLESLGRHQREALKNPIGFVEKLQKKADIGLPYPQRVVQLPEIVWDQYTHSLGNFEREFKNRKRHTRRVKLVFDKVGLPARPKSPLDPKKDGESLSYSMLPLSDGPEGSSSRPQMIRGRLCDDTKPETFNQLWTVEEQKKLEQLLIKYPPEEVESRRWQKIADELGNRTAKQVASRVQKYFIKLTKAGIPVPGRTPNLYIYSKKSSTSRRQHPLNKHLFKPSTFMTSHEPPVYMDEDDDRSCFHSHMNTAVEDASDDESIPIMYRNLPEYKELLQFKKLKKQKLQQMQAESGFVQHVGFKCDNCGIEPIQGVRWHCQDCPPEMSLDFCDSCSDCLHETDIHKEDHQLEPIYRSETFLDRDYCVSQGTSYNYLDPNYFPANR

SEQ ID NO: 7523 - protein, 903 aa, Homo sapiens
MAASRSTRVTRSTVGLNGLDESFCGRTLRNRSIAHPEEISSNSQVRSRSPKKRPEPVPIQKGNNNGRTTDLKQQSTRESWVSPRKRGLSSSEKDNIERQAIENCERRQTEPVSPVLKRIKRCLRSEAPNSSEEDSPIKSDKESVEQRSTVVDNDADFQGTKRACRCLILDDCEKREIKKVNVSEEGPLNSAVVEEITGYLAVNGVDDSDSAVINCDDCQPDGNTKQNSIGSYVLQEKSVAENGDTDTQTSMFLDSRKEDSYIDHKVPCTDSQVQVKLEDHKIVTACLPVEHVNQLTTEPATGPFSETQSSLRDSEEEVDVVGDSSASKEQCKENTNNELDTSLESMPASGEPEPSPVLDCVSAQMMSLSEPQEHRYTLRTSPRRAAPTRGSPTKNSSPYRENGQFEENNLSPNETNATVSDNVSQSPTNPGEISQNEKGICCDSQNNGSEGVSKPPSEARLNIGHLPSAKESASQHITEEEDDDPDVYYFESDHVALKHNKDYQRLLQTIAVLEAQRSQAVQDLESLGRHQREALKNPIGFVEKLQKKADIGLPYPQRVVQLPEIVWDQYTHSLGNFEREFKNRKRHTRRVKLVFDKVGLPARPKSPLDPKKDGESLSYSMLPLSDGPEGSSSRPQMIRGRLCDDTKPETFNQLWTVEEQKKLEQLLIKYPPEEVESRRWQKIADELGNRTAKQVASRVQKYFIKLTKAGIPVPGRTPNLYIYSKKSSTSRRQHPLNKHLFKPSTFMTSHEPPVYMDEDDDRSCFHSHMNTAVEDASDDESIPIMYRNLPEYKELLQFKKLKKQKLQQMQAESGFVQHVGFKCDNCGIEPIQGVRWHCQDCPPEMSLDFCDSCSDCLHETDIHKEDHQLEPIYRSETFLDRDYCVSQGTSYNYLDPNYFPANR

SEQ ID NO: 7524 - protein, 36 aa, Homo sapiens
MAASRSTRVTRSTVGLNGLDESFCGRTLRNRSIAHP

SEQ ID NO: 7525 - protein, 58 aa, Homo sapiens
MAASRSTRVTRSTVGLNGLDESFCGRTLRNRSIAHPEEISSNSQVRSRSPKKRPEPVP

SEQ ID NO: 7526 - protein, 126 aa, Homo sapiens
MSVMDLANTCSSFQSDLDFCSDCGSVLPLPGAQDTVTCIRCGFNINVRDFEGKVVKTSVVFHQLGTAMPMSVEEGPECQGPVVDRRCPRCGHEGMAYHTRQMRSADEGQTVFYTCTNCKFQEKEDS

SEQ ID NO: 7527 - protein, 126 aa, Homo sapiens; identical to SEQ ID NO: 7526

SEQ ID NO: 7528 - protein, 126 aa, Homo sapiens; identical to SEQ ID NO: 7526

SEQ ID NO: 7529 - protein, 126 aa, Homo sapiens; identical to SEQ ID NO: 7526

SEQ ID NO: 7530 - protein, 126 aa, Homo sapiens; identical to SEQ ID NO: 7526

SEQ ID NO: 7531 - protein, 126 aa, Homo sapiens; identical to SEQ ID NO: 7526

SEQ ID NO: 7532 - protein, 126 aa, Homo sapiens; identical to SEQ ID NO: 7526

SEQ ID NO: 7533 - protein, 126 aa, Homo sapiens; identical to SEQ ID NO: 7526

SEQ ID NO: 7534 - protein, 126 aa, Homo sapiens; identical to SEQ ID NO: 7526

SEQ ID NO: 7535 - protein, 126 aa, Homo sapiens; identical to SEQ ID NO: 7526

SEQ ID NO: 7536 - protein, 126 aa, Homo sapiens; identical to SEQ ID NO: 7526

SEQ ID NO: 7537 - protein, 126 aa, Homo sapiens; identical to SEQ ID NO: 7526

SEQ ID NO: 7538 - protein, 126 aa, Homo sapiens; identical to SEQ ID NO: 7526

SEQ ID NO: 7539 - protein, 126 aa, Homo sapiens; identical to SEQ ID NO: 7526

SEQ ID NO: 7540 - protein, 126 aa, Homo sapiens; identical to SEQ ID NO: 7526

SEQ ID NO: 7541 - protein, 126 aa, Homo sapiens; identical to SEQ ID NO: 7526

SEQ ID NO: 7542 - protein, 126 aa, Homo sapiens; identical to SEQ ID NO: 7526

SEQ ID NO: 7543 - protein, 126 aa, Homo sapiens; identical to SEQ ID NO: 7526

SEQ ID NO: 7544 - protein, 126 aa, Homo sapiens; identical to SEQ ID NO: 7526

SEQ ID NO: 7545 - protein, 126 aa, Homo sapiens; identical to SEQ ID NO: 7526

SEQ ID NO: 7546 - protein, 126 aa, Homo sapiens; identical to SEQ ID NO: 7526

SEQ ID NO: 7547 - protein, 126 aa, Homo sapiens; identical to SEQ ID NO: 7526

SEQ ID NO: 7548 - protein, 126 aa, Homo sapiens; identical to SEQ ID NO: 7526

SEQ ID NO: 7549 - protein, 126 aa, Homo sapiens; identical to SEQ ID NO: 7526

SEQ ID NO: 7550 - protein, 126 aa, Homo sapiens; identical to SEQ ID NO: 7526

SEQ ID NO: 7551 - protein, 126 aa, Homo sapiens; identical to SEQ ID NO: 7526

SEQ ID NO: 7552 - protein, 126 aa, Homo sapiens; identical to SEQ ID NO: 7526

SEQ ID NO: 7553 - protein, 126 aa, Homo sapiens; identical to SEQ ID NO: 7526

SEQ ID NO: 7554 - protein, 126 aa, Homo sapiens; identical to SEQ ID NO: 7526

SEQ ID NO: 7555 - protein, 126 aa, Homo sapiens; identical to SEQ ID NO: 7526

SEQ ID NO: 7556 - protein, 126 aa, Homo sapiens; identical to SEQ ID NO: 7526

SEQ ID NO: 7557 - protein, 126 aa, Homo sapiens; identical to SEQ ID NO: 7526

SEQ ID NO: 7558 - protein, 710 aa, Homo sapiens
MDLPALLPAPTARGGQHGGGPGPLRRAPAPLGASPARRRLLLVRGPEDGGPGARPGEASGPSPPPAEDDSDGDSFLVLLEVPHGGAAAEAAGSQEAEPGSRVNLASRPEQGPSGPAAPPGPGVAPAGAVTISSQDLLVRLDRGVLALSAPPGPATAGAAAPRRAPQASGPSTPGYRCPEPQCALAFAKKHQLKVHLLTHGGGQGRRPFKCPLEGCGWAFTTSYKLKRHLQSHDKLRPFGCPVGGCGKKFTTVYNLKAHMKGHEQESLFKCEVCAERFPTHAKLSSHQRSHFEPERPYKCDFPGCEKTFITVSALFSHNRAHFREQELFSCSFPGCSKQYDKACRLKIHLRSHTGERPFICDSDSCGWTFTSMSKLLRHRRKHDDDRRFTCPVEGCGKSFTRAEHLKGHSITHLGTKPFECPVEGCCARFSARSSLYIHSKKHVQDVGAPKSRCPVSTCNRLFTSKHSMKAHMVRQHSRRQDLLPQLEAPSSLTPSSELSSPGQSELTNMDLAALFSDTPANASGSAGGSDEALNSGILTIDVTSVSSSLGGNLPANNSSLGPMEPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLV

SEQ ID NO: 7559 - protein, 858 aa, Homo sapiens
MDLPALLPAPTARGGQHGGGPGPLRRAPAPLGASPARRRLLLVRGPEDGGPGARPGEASGPSPPPAEDDSDGDSFLVLLEVPHGGAAAEAAGSQEAEPGSRVNLASRPEQGPSGPAAPPGPGVAPAGAVTISSQDLLVRLDRGVLALSAPPGPATAGAAAPRRAPQASGPSTPGYRCPEPQCALAFAKKHQLKVHLLTHGGGQGRRPFKCPLEGCGWAFTTSYKLKRHLQSHDKLRPFGCPVGGCGKKFTTVYNLKAHMKGHEQESLFKCEVCAERFPTHAKLSSHQRSHFEPERPYKCDFPGCEKTFITVSALFSHNRAHFREQELFSCSFPGCSKQYDKACRLKIHLRSHTGERPFICDSDSCGWTFTSMSKLLRHRRKHDDDRRFTCPVEGCGKSFTRAEHLKGHSITHLGTKPFECPVEGCCARFSARSSLYIHSKKHVQDVGAPKSRCPVSTCNRLFTSKHSMKAHMVRQHSRRQDLLPQLEAPSSLTPSSELSSPGQSELTNMDLAALFSDTPANASGSAGGSDEALNSGILTIDVTSVSSSLGGNLPANNSSLGPMEPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLESGGSARTDYRAIQLAKEKKQRGAGSNAGASQSTQRKIKEGKMSPPHFHASQNSWLCGSLVVPSGGRPGPAPAAGVQCGAQGVQVQLVQDDPSGEGVLPSARGPATFLPFLTVDLPVYVLQEVLPSSGGPAGPEATQFPGSTINLQDLQ

SEQ ID NO: 7560 - DNA, 546 bp, Artificial Sequence
  Description of Artificial Sequence: Synthetic coding sequence
atgatggacaacagaggcaacagcagcctgcccgacaagctgcccatcttccccgacagcgccagactgcccctgaccagaagcttctacctggagcccatggtgaccttccacgtgcaccccgaggcccccgtgagcagcccctacagcgaggagctgcccagactgcccttccccagcgacagcctgatcctgggcaactacagcgagccctgccccttcagcttccccatgccctaccccaactacagaggctgcgagtacagctacggccccgccttcaccagaaagagaaacgagagagagagacagagagtgaagtgcgtgaacgagggctacgcccagctgagacaccacctgcccgaggagtacctggagaagagactgagcaaggtggagaccctgagagccgccatcaagtacatcaactacctgcagagcctgctgtaccccgacaaggccgagaccaagaacaaccccggcaaggtgagcagcatgatcgccaccaccagccaccacgccgaccccatgttcagaatcgtgtag

SEQ ID NO: 7561 - DNA, 546 bp, Artificial Sequence; identical to SEQ ID NO: 7560
  Description of Artificial Sequence: Synthetic coding sequence

SEQ ID NO: 7562 - DNA, 522 bp, Artificial Sequence
  Description of Artificial Sequence: Synthetic coding sequence
atgatggagaccagaaagcccgccgagagactggccctgccctacagcctgagaaccgcccccctgggcgtgcccggcaccctgcccggcctgcccagaagagaccccctgagagtggccctgagactggacgccgcctgctgggagtgggccagaagcggctgcgccagaggctggcagtacctgcccgtgcccctggacagcgccttcgagcccgccttcctgagaaagagaaacgagagagagagacagagagtgagatgcgtgaacgagggctacgccagactgagagaccacctgcccagagagctggccgacaagagactgagcaaggtggagaccctgagagccgccatcgactacatcaagcacctgcaggagctgctggagagacaggcctggggcctggagggcgccgccggcgccgtgccccagagaagagccgagtgcaacagcgacggcgagagcaaggccagcagcgcccccagccccagcagcgagcccgaggagggcggcagctag

SEQ ID NO: 7563 - DNA, 819 bp, Artificial Sequence
  Description of Artificial Sequence: Synthetic coding sequence
atggaggccgaggagagcgagaaggccgccaccgagcaggagcccctggagggcaccgagcagaccctggacgccgaggaggagcaggaggagagcgaggaggccgcctgcggcagcaagaagagagtggtgcccggcatcgtgtacctgggccacatcccccccagattcagacccctgcacgtgagaaacctgctgagcgcctacggcgaggtgggcagagtgttcttccaggccgaggacagattcgtgagaagaaagaagaaggccgccgccgccgccggcggcaagaagagaagctacaccaaggactacaccgagggctgggtggagttcagagacaagagaatcgccaagagagtggccgccagcctgcacaacacccccatgggcgccagaagaagaagccccttcagatacgacctgtggaacctgaagtacctgcacagattcacctggagccacctgagcgagcacctggccttcgagagacaggtgagaagacagagactgagagccgaggtggcccaggccaagagagagaccgacttctacctgcagagcgtggagagaggccagagattcctggccgccgacggcgaccccgccagacccgacggcagctggaccttcgcccagagacccaccgagcaggagctgagagccagaaaggccgccagacccggcggcagagagagagccagactggccaccgcccaggacaaggccagaagcaacaagggcctgctggccagaatcttcggcgcccccccccccagcgagagcatggagggccccagcctggtgagagacagctag

SEQ ID NO: 7564 - DNA, 3396 bp, Artificial Sequence
  Description of Artificial Sequence: Synthetic coding sequence
atgttccagatccccgtggagaacctggacaacatcagaaaggtgagaaagaaggtgaagggcatcctggtggacatcggcctggacagctgcaaggagctgctgaaggacctgaagggcttcgaccccggcgagaagtacttccacaacaccagctggggcgacgtgagcctgtgggagcccagcggcaagaaggtgagatacagaaccaagccctactgctgcggcctgtgcaagtacagcaccaaggtgctgaccagcttcaagaaccacctgcacagataccacgaggacgagatcgaccaggagctggtgatcccctgccccaactgcgtgttcgccagccagcccaaggtggtgggcagacacttcagaatgttccacgcccccgtgagaaaggtgcagaactacaccgtgaacatcctgggcgagaccaagagcagcagaagcgacgtgatcagcttcacctgcctgaagtgcaacttcagcaacaccctgtactacagcatgaagaagcacgtgctggtggcccacttccactacctgatcaacagctacttcggcctgagaaccgaggagatgggcgagcagcccaagaccaacgacaccgtgagcatcgagaagatccccccccccgacaagtactactgcaagaagtgcaacgccaacgccagcagccaggacgccctgatgtaccacatcctgaccagcgacatccacagagacctggagaacaagctgagaagcgtgatcagcgagcacatcaagagaaccggcctgctgaagcagacccacatcgcccccaagcccgccgcccacctggccgcccccgccaacggcagcgcccccagcgcccccgcccagcccccctgcttccacctggccctgccccagaacagccccagccccgccgccggccagcccgtgaccgtggcccagggcgcccccggcagcctgacccacagcccccccgccgccggccagagccacatgaccctggtgagcagccccctgcccgtgggccagaacagcctgaccctgcagccccccgccccccagcccgtgttcctgagccacggcgtgcccctgcaccagagcgtgaacccccccgtgctgcccctgagccagcccgtgggccccgtgaacaagagcgtgggcaccagcgtgctgcccatcaaccagaccgtgagacccggcgtgctgcccctgacccagcccgtgggccccatcaacagacccgtgggccccggcgtgctgcccgtgagccccagcgtgacccccggcgtgctgcaggccgtgagccccggcgtgctgagcgtgagcagagccgtgcccagcggcgtgctgcccgccggccagatgacccccgccggccagatgacccccgccggcgtgatccccggccagaccgccaccagcggcgtgctgcccaccggccagatggtgcagagcggcgtgctgcccgtgggccagaccgcccccagcagagtgctgccccccggccagaccgcccccctgagagtgatcagcgccggccaggtggtgcccagcggcctgctgagccccaaccagaccgtgagcagcagcgccgtggtgcccgtgaaccagggcgtgaacagcggcgtgctgcagctgagccagcccgtggtgagcggcgtgctgcccgtgggccagcccgtgagacccggcgtgctgcagctgaaccagaccgtgggcaccaacatcctgcccgtgaaccagcccgtgagacccggcgccagccagaacaccaccttcctgaccagcggcagcatcctgagacagctgatccccaccggcaagcaggtgaacggcatccccacctacaccctggcccccgtgagcgtgaccctgcccgtgccccccggcggcctggccaccgtggcccccccccagatgcccatccagctgctgcccagcggcgccgccgcccccatggccggcagcatgcccggcatgcccagcccccccgtgctggtgaacgccgcccagagcgtgttcgtgcaggccagcagcagcgccgccgacaccaaccaggtgctgaagcaggccaagcagtggaagacctgccccgtgtgcaacgagctgttccccagcaacgtgtaccaggtgcacatggaggtggcccacaagcacagcgagagcaagagcggcgagaagctggagcccgagaagctggccgcctgcgcccccttcctgaagtggatgagagagaagaccgtgagatgcctgagctgcaagtgcctggtgagcgaggaggagctgatccaccacctgctgatgcacggcctgggctgcctgttctgcccctgcaccttccacgacatcaagggcctgagcgagcacagcagaaacagacacctgggcaagaagaagctgcccatggactacagcaacagaggcttccagctggacgtggacgccaacggcaacctgctgttcccccacctggacttcatcaccatcctgcccaaggagaagctgggcgagagagaggtgtacctggccatcctggccggcatccacagcaagagcctggtgcccgtgtacgtgaaggtgagaccccaggccgagggcacccccggcagcaccggcaagagagtgagcacctgccccttctgcttcggccccttcgtgaccaccgaggcctacgagctgcacctgaaggagagacaccacatcatgcccaccgtgcacaccgtgctgaagagccccgccttcaagtgcatccactgctgcggcgtgtacaccggcaacatgaccctggccgccatcgccgtgcacctggtgagatgcagaagcgcccccaaggacagcagcagcgacctgcaggcccagcccggcttcatccacaacagcgagctgctgctggtgagcggcgaggtgatgcacgacagcagcttcagcgtgaagagaaagctgcccgacggccacctgggcgccgaggaccagagacacggcgaggagcagccccccatcctgaacgccgacgccgcccccggccccgagaaggtgaccagcgtggtgcccttcaagagacagagaaacgagagcagaaccgagggccccatcgtgaaggacgaggccctgcagatcctggccctggaccccaagaagtacgagggcagaagctacgaggagaagaagcagttcctgaaggactacttccacaagaagccctaccccagcaagaaggagatcgagctgctgagcagcctgttctgggtgtggaagatcgacgtggccagcttcttcggcaagagaagatacatctgcatgaaggccatcaagaaccacaagcccagcgtgctgctgggcttcgacatgagcgagctgaagaacgtgaagcacagactgaacttcgagtacgagccctag

SEQ ID NO: 7565 - DNA, 516 bp, Artificial Sequence
  Description of Artificial Sequence: Synthetic coding sequence
atgttccagatccccgtggagaacctggacaacatcagaaaggtgagaaagaaggtgaagggcatcctggtggacatcggcctggacagctgcaaggagctgctgaaggacctgaagggcttcgaccccggcgagaagtacttccacaacaccagctggggcgacgtgagcctgtgggagcccagcggcaagaaggtgagatacagaaccaagccctactgctgcggcctgtgcaagtacagcaccaaggtgctgaccagcttcaagaaccacctgcacagataccacgaggacgagatcgaccaggagctggtgatcccctgccccaactgcgtgttcgccagccagcccaaggtggtgggcagacacttcagaatgttccacgcccccgtgagaaaggtgcagaactacaccgtgaacatcctgggcgagaccaagagcagcagaagcgacgtgatcagcttcacctgcctgaagtgcaacttcagcaacaccctgtactacagcatgaagtag

SEQ ID NO: 7566 - DNA, 1512 bp, Artificial Sequence
  Description of Artificial Sequence: Synthetic coding sequence
atggccgccgccatcaccgacatggccgacctggaggagctgagcagactgagccccctgccccccggcagccccggcagcgccgccagaggcagagccgagccccccgaggaggaggaggaggaggaggaggaggaggaggaggccgaggccgaggccgtggccgccctgctgctgaacggcggcagcggcggcggcggcggcggcggcggcggcggcgtgggcggcggcgaggccgagaccatgagcgagcccagccccgagagcgccagccaggccggcgaggacgaggacgaggaggaggacgacgaggaggaggaggacgagagcagcagcagcggcggcggcgaggaggagagcagcgccgagagcctggtgggcagcagcggcggcagcagcagcgacgagaccagaagcctgagccccggcgccgccagcagcagcagcggcgacggcgacggcaaggagggcctggaggagcccaagggccccagaggcagccagggcggcggcggcggcggcagcagcagcagcagcgtggtgagcagcggcggcgacgagggctacggcaccggcggcggcggcagcagcgccaccagcggcggcagaagaggcagcctggagatgagcagcgacggcgagcccctgagcagaatggacagcgaggacagcatcagcagcaccatcatggacgtggacagcaccatcagcagcggcagaagcacccccgccatgatgaacggccagggcagcaccaccagcagcagcaagaacatcgcctacaactgctgctgggaccagtgccaggcctgcttcaacagcagccccgacctggccgaccacatcagaagcatccacgtggacggccagagaggcggcgtgttcgtgtgcctgtggaagggctgcaaggtgtacaacacccccagcaccagccagagctggctgcagagacacatgctgacccacagcggcgacaagcccttcaagtgcgtggtgggcggctgcaacgccagcttcgccagccagggcggcctggccagacacgtgcccacccacttcagccagcagaacagcagcaaggtgagcagccagcccaaggccaaggaggagagccccagcaaggccggcatgaacaagagaagaaagctgaagaacaagagaagaagaagcctgcccagaccccacgacttcttcgacgcccagaccctggacgccatcagacacagagccatctgcttcaacctgagcgcccacatcgagagcctgggcaagggccacagcgtggtgttccacagcaccgtgatcgccaagagaaaggaggacagcggcaagatcaagctgctgctgcactggatgcccgaggacatcctgcccgacgtgtgggtgaacgagagcgagagacaccagctgaagaccaaggtggtgcacctgagcaagctgcccaaggacaccgccctgctgctggaccccaacatctacagaaccatgccccagaagagactgaagagatag

SEQ ID NO: 7567 - DNA, 906 bp, Artificial Sequence
  Description of Artificial Sequence: Synthetic coding sequence
atgtacaccagaagatacagcagcatcagcagcaccatcatggacgtggacagcaccatcagcagcggcagaagcacccccgccatgatgaacggccagggcagcaccaccagcagcagcaagaacatcgcctacaactgctgctgggaccagtgccaggcctgcttcaacagcagccccgacctggccgaccacatcagaagcatccacgtggacggccagagaggcggcgtgttcgtgtgcctgtggaagggctgcaaggtgtacaacacccccagcaccagccagagctggctgcagagacacatgctgacccacagcggcgacaagcccttcaagtgcgtggtgggcggctgcaacgccagcttcgccagccagggcggcctggccagacacgtgcccacccacttcagccagcagaacagcagcaaggtgagcagccagcccaaggccaaggaggagagccccagcaaggccggcatgaacaagagaagaaagctgaagaacaagagaagaagaagcctgcccagaccccacgacttcttcgacgcccagaccctggacgccatcagacacagagccatctgcttcaacctgagcgcccacatcgagagcctgggcaagggccacagcgtggtgttccacagcaccgtgatcgccaagagaaaggaggacagcggcaagatcaagctgctgctgcactggatgcccgaggacatcctgcccgacgtgtgggtgaacgagagcgagagacaccagctgaagaccaaggtggtgcacctgagcaagctgcccaaggacaccgccctgctgctggaccccaacatctacagaaccatgccccagaagagactgaagagaaccctgatcagaaaggtgttcaacctgtacctgagcaagcagtag

SEQ ID NO: 7568 - DNA, 1554 bp, Artificial Sequence
  Description of Artificial Sequence: Synthetic coding sequence
atggccgccgccatcaccgacatggccgacctggaggagctgagcagactgagccccctgccccccggcagccccggcagcgccgccagaggcagagccgagccccccgaggaggaggaggaggaggaggaggaggaggaggaggccgaggccgaggccgtggccgccctgctgctgaacggcggcagcggcggcggcggcggcggcggcggcggcggcgtgggcggcggcgaggccgagaccatgagcgagcccagccccgagagcgccagccaggccggcgaggacgaggacgaggaggaggacgacgaggaggaggaggacgagagcagcagcagcggcggcggcgaggaggagagcagcgccgagagcctggtgggcagcagcggcggcagcagcagcgacgagaccagaagcctgagccccggcgccgccagcagcagcagcggcgacggcgacggcaaggagggcctggaggagcccaagggccccagaggcagccagggcggcggcggcggcggcagcagcagcagcagcgtggtgagcagcggcggcgacgagggctacggcaccggcggcggcggcagcagcgccaccagcggcggcagaagaggcagcctggagatgagcagcgacggcgagcccctgagcagaatggacagcgaggacagcatcagcagcaccatcatggacgtggacagcaccatcagcagcggcagaagcacccccgccatgatgaacggccagggcagcaccaccagcagcagcaagaacatcgcctacaactgctgctgggaccagtgccaggcctgcttcaacagcagccccgacctggccgaccacatcagaagcatccacgtggacggccagagaggcggcgtgttcgtgtgcctgtggaagggctgcaaggtgtacaacacccccagcaccagccagagctggctgcagagacacatgctgacccacagcggcgacaagcccttcaagtgcgtggtgggcggctgcaacgccagcttcgccagccagggcggcctggccagacacgtgcccacccacttcagccagcagaacagcagcaaggtgagcagccagcccaaggccaaggaggagagccccagcaaggccggcatgaacaagagaagaaagctgaagaacaagagaagaagaagcctgcccagaccccacgacttcttcgacgcccagaccctggacgccatcagacacagagccatctgcttcaacctgagcgcccacatcgagagcctgggcaagggccacagcgtggtgttccacagcaccgtgatcgccaagagaaaggaggacagcggcaagatcaagctgctgctgcactggatgcccgaggacatcctgcccgacgtgtgggtgaacgagagcgagagacaccagctgaagaccaaggtggtgcacctgagcaagctgcccaaggacaccgccctgctgctggaccccaacatctacagaaccatgccccagaagagactgaagagaaccctgatcagaaaggtgttcaacctgtacctgagcaagcagtag

SEQ ID NO: 7569 - DNA, 1314 bp, Artificial Sequence
  Description of Artificial Sequence: Synthetic coding sequence
atggccgccgccatcaccgacatggccgacctggaggagctgagcagactgagccccctgccccccggcagccccggcagcgccgccagaggcagagccgagccccccgaggaggaggaggaggacgagagcagcagcagcggcggcggcgaggaggagagcagcgccgagagcctggtgggcagcagcggcggcagcagcagcgacgagaccagaagcctgagccccggcgccgccagcagcagcagcggcgacggcgacggcaaggagggcctggaggagcccaagggccccagaggcagccagggcggcggcggcggcggcagcagcagcagcagcgtggtgagcagcggcggcgacgagggctacggcaccggcggcggcggcagcagcgccaccagcggcggcagaagaggcagcctggagatgagcagcgacggcgagcccctgagcagaatggacagcgaggacagcatcagcagcaccatcatggacgtggacagcaccatcagcagcggcagaagcacccccgccatgatgaacggccagggcagcaccaccagcagcagcaagaacatcgcctacaactgctgctgggaccagtgccaggcctgcttcaacagcagccccgacctggccgaccacatcagaagcatccacgtggacggccagagaggcggcgtgttcgtgtgcctgtggaagggctgcaaggtgtacaacacccccagcaccagccagagctggctgcagagacacatgctgacccacagcggcgacaagcccttcaagtgcgtggtgggcggctgcaacgccagcttcgccagccagggcggcctggccagacacgtgcccacccacttcagccagcagaacagcagcaaggtgagcagccagcccaaggccaaggaggagagccccagcaaggccggcatgaacaagagaagaaagctgaagaacaagagaagaagaagcctgcccagaccccacgacttcttcgacgcccagaccctggacgccatcagacacagagccatctgcttcaacctgagcgcccacatcgagagcctgggcaagggccacagcgtggtgttccacagcaccgtgatcgccaagagaaaggaggacagcggcaagatcaagctgctgctgcactggatgcccgaggacatcctgcccgacgtgtgggtgaacgagagcgagagacaccagctgaagaccaaggtggtgcacctgagcaagctgcccaaggacaccgccctgctgctggaccccaacatctacagaaccatgccccagaagagactgaagagatag

SEQ ID NO: 7570 - DNA, 3681 bp, Artificial Sequence
  Description of Artificial Sequence: Synthetic coding sequence
atggacagcttcgacctggccctgctgcaggagtgggacctggagagcctgtgcgtgtacgagcccgacagaaacgccctgagaagaaaggagagagagagaagaaaccaggagacccagcaggacgacggcaccttcaacagcagctacagcctgttcagcgagccctacaagaccaacaagggcgacgagctgagcaacagaatccagaacaccctgggcaactacgacgagatgaaggacttcctgaccgacagaagcaaccagagccacctggtgggcgtgcccaagcccggcgtgccccagacccccgtgaacaagatcgacgagcacttcgtggccgacagcagagcccagaaccagcccagcagcatctgcagcaccaccaccagcacccccgccgccgtgcccgtgcagcagagcaagagaggcaccatgggctggcagaaggccggccacccccccagcgacggccagcagagagccacccagcagggcagcctgagaaccctgctgggcgacggcgtgggcagacagcagcccagagccaagcaggtgtgcaacgtggaggtgggcctgcagacccaggagagaccccccgccatggccgccaagcacagcagcagcggccactgcgtgcagaacttcccccccagcctggccagcaagcccagcctggtgcagcagaagcccaccgcctacgtgagacccatggacggccaggaccaggcccccgacgagagccccaagctgaagagcagcagcgagaccagcgtgcactgcaccagctacagaggcgtgcccgccagcaagcccgagcccgccagagccaaggccaagctgagcaagttcagcatccccaagcagggcgaggagagcagaagcggcgagaccaacagctgcgtggaggagatcatcagagagatgacctggctgccccccctgagcgccatccaggcccccggcaaggtggagcccaccaagttccccttccccaacaaggacagccagctggtgagcagcggccacaacaaccccaagaagggcgacgccgagcccgagagccccgacagcggcaccagcaacaccagcatgctggaggacgacctgaagctgagcagcgacgaggaggagaacgagcagcaggccgcccagagaaccgccctgagagccctgagcgacagcgccgtggtgcagcagcccaactgcagaaccagcgtgcccagcagcaagggcagcagcagcagcagcagcagcggcagcagcagcagcagcagcgacagcgagagcagcagcggcagcgacagcgagaccgagagcagcagcagcgagagcgagggcagcaagcccccccacttcagcagccccgaggccgagcccgccagcagcaacaagtggcagctggacaagtggctgaacaaggtgaacccccacaagccccccatcctgatccagaacgagagccacggcagcgagagcaaccagtactacaaccccgtgaaggaggacgtgcaggactgcggcaaggtgcccgacgtgtgccagcccagcctgagagagaaggagatcaagagcacctgcaaggaggagcagagacccagaaccgccaacaaggcccccggcagcaagggcgtgaagcagaagagcccccccgccgccgtggccgtggccgtgagcgccgccgcccccccccccgccgtgccctgcgcccccgccgagaacgcccccgcccccgccagaagaagcgccggcaagaagcccaccagaagaaccgagagaaccagcgccggcgacggcgccaactgccacagacccgaggagcccgccgccgccgacgccctgggcaccagcgtggtggtgccccccgagcccaccaagaccagaccctgcggcaacaacagagccagccacagaaaggagctgagaagcagcgtgacctgcgagaagagaagaaccagaggcctgagcagaatcgtgcccaagagcaaggagttcatcgagaccgagagcagcagcagcagcagcagcagcgacagcgacctggagagcgagcaggaggagtaccccctgagcaaggcccagaccgtggccgccagcgccagcagcggcaacgaccagagactgaaggaggccgccgccaacggcggcagcggccccagagcccccgtgggcagcatcaacgccagaaccaccagcgacatcgccaaggagctggaggagcagttctacaccctggtgcccttcggcagaaacgagctgctgagccccctgaaggacagcgacgagatcagaagcctgtgggtgaagatcgacctgaccctgctgagcagaatccccgagcacctgccccaggagcccggcgtgctgagcgcccccgccaccaaggacagcgagagcgccccccccagccacaccagcgacacccccgccgagaaggccctgcccaagagcaagagaaagagaaagtgcgacaacgaggacgactacagagagatcaagaagagccagggcgagaaggacagcagcagcagactggccaccagcaccagcaacaccctgagcgccaaccactgcaacatgaacatcaacagcgtggccatccccatcaacaagaacgagaagatgctgagaagccccatcagccccctgagcgacgccagcaagcacaagtacaccagcgaggacctgaccagcagcagcagacccaacggcaacagcctgttcaccagcgccagcagcagcaagaagcccaaggccgacagccagctgcagccccacggcggcgacctgaccaaggccgcccacaacaacagcgagaacatccccctgcacaagagcagaccccagaccaagccctggagccccggcagcaacggccacagagactgcaagagacagaagctggtgttcgacgacatgcccagaagcgccgactacttcatgcaggaggccaagagaatgaagcacaaggccgacgccatggtggagaagttcggcaaggccctgaactacgccgaggccgccctgagcttcatcgagtgcggcaacgccatggagcagggccccatggagagcaagagcccctacaccatgtacagcgagaccgtggagctgatcagatacgccatgagactgaagacccacagcggccccaacgccacccccgaggacaagcagctggccgccctgtgctacagatgcctggccctgctgtactggagaatgttcagactgaagagagaccacgccgtgaagtacagcaaggccctgatcgactacttcaagaacagcagcaaggccgcccaggcccccagcccctggggcgccagcggcaagagcaccggcacccccagccccatgagccccaaccccagccccgccagcagcgtgggcagccagggcagcctgagcaacgccagcgccctgagccccagcaccatcgtgagcatcccccagagaatccaccagatggccgccaaccacgtgagcatcaccaacagcatcctgcacagctacgactactgggagatggccgacaacctggccaaggagaacagagagttcttcaacgacctggacctgctgatgggccccgtgaccctgcacagcagcatggagcacctggtgcagtacagccagcagggcctgcactggctgagaaacagcgcccacctgagctag

SEQ ID NO: 7571 - DNA, 3756 bp, Artificial Sequence
  Description of Artificial Sequence: Synthetic coding sequence
atggacagcttcgacctggccctgctgcaggagtgggacctggagagcctgtggggcgaggacatcctgaaccagagaaacgacagcctggtggtggagttccagagcagcgccagcagatgcagaagcgtgtacgagcccgacagaaacgccctgagaagaaaggagagagagagaagaaaccaggagacccagcaggacgacggcaccttcaacagcagctacagcctgttcagcgagccctacaagaccaacaagggcgacgagctgagcaacagaatccagaacaccctgggcaactacgacgagatgaaggacttcctgaccgacagaagcaaccagagccacctggtgggcgtgcccaagcccggcgtgccccagacccccgtgaacaagatcgacgagcacttcgtggccgacagcagagcccagaaccagcccagcagcatctgcagcaccaccaccagcacccccgccgccgtgcccgtgcagcagagcaagagaggcaccatgggctggcagaaggccggccacccccccagcgacggccagcagagagccacccagcagggcagcctgagaaccctgctgggcgacggcgtgggcagacagcagcccagagccaagcaggtgtgcaacgtggaggtgggcctgcagacccaggagagaccccccgccatggccgccaagcacagcagcagcggccactgcgtgcagaacttcccccccagcctggccagcaagcccagcctggtgcagcagaagcccaccgcctacgtgagacccatggacggccaggaccaggcccccgacgagagccccaagctgaagagcagcagcgagaccagcgtgcactgcaccagctacagaggcgtgcccgccagcaagcccgagcccgccagagccaaggccaagctgagcaagttcagcatccccaagcagggcgaggagagcagaagcggcgagaccaacagctgcgtggaggagatcatcagagagatgacctggctgccccccctgagcgccatccaggcccccggcaaggtggagcccaccaagttccccttccccaacaaggacagccagctggtgagcagcggccacaacaaccccaagaagggcgacgccgagcccgagagccccgacagcggcaccagcaacaccagcatgctggaggacgacctgaagctgagcagcgacgaggaggagaacgagcagcaggccgcccagagaaccgccctgagagccctgagcgacagcgccgtggtgcagcagcccaactgcagaaccagcgtgcccagcagcaagggcagcagcagcagcagcagcagcggcagcagcagcagcagcagcgacagcgagagcagcagcggcagcgacagcgagaccgagagcagcagcagcgagagcgagggcagcaagcccccccacttcagcagccccgaggccgagcccgccagcagcaacaagtggcagctggacaagtggctgaacaaggtgaacccccacaagccccccatcctgatccagaacgagagccacggcagcgagagcaaccagtactacaaccccgtgaaggaggacgtgcaggactgcggcaaggtgcccgacgtgtgccagcccagcctgagagagaaggagatcaagagcacctgcaaggaggagcagagacccagaaccgccaacaaggcccccggcagcaagggcgtgaagcagaagagcccccccgccgccgtggccgtggccgtgagcgccgccgcccccccccccgccgtgccctgcgcccccgccgagaacgcccccgcccccgccagaagaagcgccggcaagaagcccaccagaagaaccgagagaaccagcgccggcgacggcgccaactgccacagacccgaggagcccgccgccgccgacgccctgggcaccagcgtggtggtgccccccgagcccaccaagaccagaccctgcggcaacaacagagccagccacagaaaggagctgagaagcagcgtgacctgcgagaagagaagaaccagaggcctgagcagaatcgtgcccaagagcaaggagttcatcgagaccgagagcagcagcagcagcagcagcagcgacagcgacctggagagcgagcaggaggagtaccccctgagcaaggcccagaccgtggccgccagcgccagcagcggcaacgaccagagactgaaggaggccgccgccaacggcggcagcggccccagagcccccgtgggcagcatcaacgccagaaccaccagcgacatcgccaaggagctggaggagcagttctacaccctggtgcccttcggcagaaacgagctgctgagccccctgaaggacagcgacgagatcagaagcctgtgggtgaagatcgacctgaccctgctgagcagaatccccgagcacctgccccaggagcccggcgtgctgagcgcccccgccaccaaggacagcgagagcgccccccccagccacaccagcgacacccccgccgagaaggccctgcccaagagcaagagaaagagaaagtgcgacaacgaggacgactacagagagatcaagaagagccagggcgagaaggacagcagcagcagactggccaccagcaccagcaacaccctgagcgccaaccactgcaacatgaacatcaacagcgtggccatccccatcaacaagaacgagaagatgctgagaagccccatcagccccctgagcgacgccagcaagcacaagtacaccagcgaggacctgaccagcagcagcagacccaacggcaacagcctgttcaccagcgccagcagcagcaagaagcccaaggccgacagccagctgcagccccacggcggcgacctgaccaaggccgcccacaacaacagcgagaacatccccctgcacaagagcagaccccagaccaagccctggagccccggcagcaacggccacagagactgcaagagacagaagctggtgttcgacgacatgcccagaagcgccgactacttcatgcaggaggccaagagaatgaagcacaaggccgacgccatggtggagaagttcggcaaggccctgaactacgccgaggccgccctgagcttcatcgagtgcggcaacgccatggagcagggccccatggagagcaagagcccctacaccatgtacagcgagaccgtggagctgatcagatacgccatgagactgaagacccacagcggccccaacgccacccccgaggacaagcagctggccgccctgtgctacagatgcctggccctgctgtactggagaatgttcagactgaagagagaccacgccgtgaagtacagcaaggccctgatcgactacttcaagaacagcagcaaggccgcccaggcccccagcccctggggcgccagcggcaagagcaccggcacccccagccccatgagccccaaccccagccccgccagcagcgtgggcagccagggcagcctgagcaacgccagcgccctgagccccagcaccatcgtgagcatcccccagagaatccaccagatggccgccaaccacgtgagcatcaccaacagcatcctgcacagctacgactactgggagatggccgacaacctggccaaggagaacagagagttcttcaacgacctggacctgctgatgggccccgtgaccctgcacagcagcatggagcacctggtgcagtacagccagcagggcctgcactggctgagaaacagcgcccacctgagctag

SEQ ID NO: 7572 - DNA, 3681 bp, Artificial Sequence; identical to SEQ ID NO: 7570
  Description of Artificial Sequence: Synthetic coding sequence

SEQ ID NO: 7573 - DNA, 300 bp, Artificial Sequence
  Description of Artificial Sequence: Synthetic coding sequence
atggacagcttcgacctggccctgctgcaggagtgggacctggagagcctgtgcgtgtacgagcccgacagaaacgccctgagaagaaaggagagagagagaagaaaccaggagacccagcaggacgacggcaccttcaacagcagctacagcctgttcagcgagccctacaagaccaacaagggcgacgagctgagcaacagaatccagaacaccctgggcaactacgacgagatgaaggacttcctgaccgacagaagcaaccagagccacctggtgggcgtgcccaagcccggctag

SEQ ID NO: 7574 - DNA, 468 bp, Artificial Sequence
  Description of Artificial Sequence: Synthetic coding sequence
atggacagcttcgacctggccctgctgcaggagtgggacctggagagcctgtgcgtgtacgagcccgacagaaacgccctgagaagaaaggagagagagagaagaaaccaggagacccagcaggacgacggcaccttcaacagcagctacagcctgttcagcgagccctacaagaccaacaagggcgacgagctgagcaacagaatccagaacaccctgggcaactacgacgagatgaaggacttcctgaccgacagaagcaaccagagccacctggtgggcgtgcccaagcccggcgtgccccagacccccgtgaacaagatcgacgagcacttcgtggccgacagcagagcccagaaccagcccagcagcatctgcagcaccaccaccagcacccccgccgccgtgcccgtgcagcagagcaagagaggcaccatgggctggcagaaggccggccaccccccctag

SEQ ID NO: 7575 - DNA, 345 bp, Artificial Sequence
  Description of Artificial Sequence: Synthetic coding sequence
atggacagcttcgacctggccctgctgcaggagtgggacctggagagcctgtgcgtgtacgagcccgacagaaacgccctgagaagaaaggagagagagagaagaaaccaggagacccagcaggacgacggcaccttcaacagcagctacagcctgttcagcgagccctacaagaccaacaagggcgacgagctgagcaacagaatccagaacaccctgggcaactacgacgagatgaaggacttcctgaccgacagaagcaaccagagccacctggtgggcgtgcccaagcccggcgtgccccagacccccgtgaacaagatcgacgagcacttcgtggcctag

SEQ ID NO: 7576 - DNA, 54 bp, Artificial Sequence
  Description of Artificial Sequence: Synthetic coding sequence
atggacagcttcgacctggccctgctgcaggagtgggacctggagagcctgtag

SEQ ID NO: 7577 - DNA, 486 bp, Artificial Sequence
  Description of Artificial Sequence: Synthetic coding sequence
atggacagcttcgacctggccctgctgcaggagtgggacctggagagcctgtgcgtgtacgagcccgacagaaacgccctgagaagaaaggagagagagagaagaaaccaggagacccagcaggacgacggcaccttcaacagcagctacagcctgttcagcgagccctacaagaccaacaagggcgacgagctgagcaacagaatccagaacaccctgggcaactacgacgagatgaaggacttcctgaccgacagaagcaaccagagccacctggtgggcgtgcccaagcccggcgtgccccagacccccgtgaacaagatcgacgagcacttcgtggccgacagcagagcccagaaccagcccagcagcatctgcagcaccaccaccagcacccccgccgccgtgcccgtgcagcagagcaagagaggcaccatgggctggcagaaggccggccacccccccagcgacggccagcagagatag

SEQ ID NO: 7578 - DNA, 2346 bp, Artificial Sequence
  Description of Artificial Sequence: Synthetic coding sequence
atggacagcttcgacctggccctgctgcaggagtgggacctggagagcctgtggggcgaggacatcctgaaccagagaaacgacagcctggtggtggagttccagagcagcgccagcagatgcagaagcgtgtacgagcccgacagaaacgccctgagaagaaaggagagagagagaagaaaccaggagacccagcaggacgacggcaccttcaacagcagctacagcctgttcagcgagccctacaagaccaacaagggcgacgagctgagcaacagaatccagaacaccctgggcaactacgacgagatgaaggacttcctgaccgacagaagcaaccagagccacctggtgggcgtgcccaagcccggcgtgccccagacccccgtgaacaagatcgacgagcacttcgtggccgacagcagagcccagaaccagcccagcagcatctgcagcaccaccaccagcacccccgccgccgtgcccgtgcagcagagcaagagaggcaccatgggctggcagaaggccggccacccccccagcgacggccagcagagagccacccagcagggcagcctgagaaccctgctgggcgacggcgtgggcagacagcagcccagagccaagcaggtgtgcaacgtggaggtgggcctgcagacccaggagagaccccccgccatggccgccaagcacagcagcagcggccactgcgtgcagaacttcccccccagcctggccagcaagcccagcctggtgcagcagaagcccaccgcctacgtgagacccatggacggccaggaccaggcccccgacgagagccccaagctgaagagcagcagcgagaccagcgtgcactgcaccagctacagaggcgtgcccgccagcaagcccgagcccgccagagccaaggccaagctgagcaagttcagcatccccaagcagggcgaggagagcagaagcggcgagaccaacagctgcgtggaggagatcatcagagagatgacctggctgccccccctgagcgccatccaggcccccggcaaggtggagcccaccaagttccccttccccaacaaggacagccagctggtgagcagcggccacaacaaccccaagaagggcgacgccgagcccgagagccccgacagcggcaccagcaacaccagcatgctggaggacgacctgaagctgagcagcgacgaggaggagaacgagcagcaggccgcccagagaaccgccctgagagccctgagcgacagcgccgtggtgcagcagcccaactgcagaaccagcgtgcccagcagcaagggcagcagcagcagcagcagcagcggcagcagcagcagcagcagcgacagcgagagcagcagcggcagcgacagcgagaccgagagcagcagcagcgagagcgagggcagcaagcccccccacttcagcagccccgaggccgagcccgccagcagcaacaagtggcagctggacaagtggctgaacaaggtgaacccccacaagccccccatcctgatccagaacgagagccacggcagcgagagcaaccagtactacaaccccgtgaaggaggacgtgcaggactgcggcaaggtgcccgacgtgtgccagcccagcctgagagagaaggagatcaagagcacctgcaaggaggagcagagacccagaaccgccaacaaggcccccggcagcaagggcgtgaagcagaagagcccccccgccgccgtggccgtggccgtgagcgccgccgcccccccccccgccgtgccctgcgcccccgccgagaacgcccccgcccccgccagaagaagcgccggcaagaagcccaccagaagaaccgagagaaccagcgccggcgacggcgccaactgccacagacccgaggagcccgccgccgccgacgccctgggcaccagcgtggtggtgccccccgagcccaccaagaccagaccctgcggcaacaacagagccagccacagaaaggagctgagaagcagcgtgacctgcgagaagagaagaaccagaggcctgagcagaatcgtgcccaagagcaaggagttcatcgagaccgagagcagcagcagcagcagcagcagcgacagcgacctggagagcgagcaggaggagtaccccctgagcaaggcccagaccgtggccgccagcgccagcagcggcaacgaccagagactgaaggaggccgccgccaacggcggcagcggccccagagcccccgtgggcagcatcaacgccagaaccaccagcgacatcgccaaggagctggaggagcagttctacaccctggtgcccctggccggcaccaacttcagccccctgtag

SEQ ID NO: 7579 - DNA, 2610 bp, Artificial Sequence
  Description of Artificial Sequence: Synthetic coding sequence
atggacagcttcgacctggccctgctgcaggagtgggacctggagagcctgtgcgtgtacgagcccgacagaaacgccctgagaagaaaggagagagagagaagaaaccaggagacccagcaggacgacggcaccttcaacagcagctacagcctgttcagcgagccctacaagaccaacaagggcgacgagctgagcaacagaatccagaacaccctgggcaactacgacgagatgaaggacttcctgaccgacagaagcaaccagagccacctggtgggcgtgcccaagcccggcgtgccccagacccccgtgaacaagatcgacgagcacttcgtggccgacagcagagcccagaaccagcccagcagcatctgcagcaccaccaccagcacccccgccgccgtgcccgtgcagcagagcaagagaggcaccatgggctggcagaaggccggccacccccccagcgacggccagcagagagccacccagcagggcagcctgagaaccctgctgggcgacggcgtgggcagacagcagcccagagccaagcaggtgtgcaacgtggaggtgggcctgcagacccaggagagaccccccgccatggccgccaagcacagcagcagcggccactgcgtgcagaacttcccccccagcctggccagcaagcccagcctggtgcagcagaagcccaccgcctacgtgagacccatggacggccaggaccaggcccccgacgagagccccaagctgaagagcagcagcgagaccagcgtgcactgcaccagctacagaggcgtgcccgccagcaagcccgagcccgccagagccaaggccaagctgagcaagttcagcatccccaagcagggcgaggagagcagaagcggcgagaccaacagctgcgtggaggagatcatcagagagatgacctggctgccccccctgagcgccatccaggcccccggcaaggtggagcccaccaagttccccttccccaacaaggacagccagctggtgagcagcggccacaacaaccccaagaagggcgacgccgagcccgagagccccgacagcggcaccagcaacaccagcatgctggaggacgacctgaagctgagcagcgacgaggaggagaacgagcagcaggccgcccagagaaccgccctgagagccctgagcgacagcgccgtggtgcagcagcccaactgcagaaccagcgtgcccagcagcaagggcagcagcagcagcagcagcagcggcagcagcagcagcagcagcgacagcgagagcagcagcggcagcgacagcgagaccgagagcagcagcagcgagagcgagggcagcaagcccccccacttcagcagccccgaggccgagcccgccagcagcaacaagtggcagctggacaagtggctgaacaaggtgaacccccacaagccccccatcctgatccagaacgagagccacggcagcgagagcaaccagtactacaaccccgtgaaggaggacgtgcaggactgcggcaaggtgcccgacgtgtgccagcccagcctgagagagaaggagatcaagagcacctgcaaggaggagcagagacccagaaccgccaacaaggcccccggcagcaagggcgtgaagcagaagagcccccccgccgccgtggccgtggccgtgagcgccgccgcccccccccccgccgtgccctgcgcccccgccgagaacgcccccgcccccgccagaagaagcgccggcaagaagcccaccagaagaaccgagagaaccagcgccggcgacggcgccaactgccacagacccgaggagcccgccgccgccgacgccctgggcaccagcgtggtggtgccccccgagcccaccaagaccagaccctgcggcaacaacagagccagccacagaaaggagctgagaagcagcgtgacctgcgagaagagaagaaccagaggcctgagcagaatcgtgcccaagagcaaggagttcatcgagaccgagagcagcagcagcagcagcagcagcgacagcgacctggagagcgagcaggaggagtaccccctgagcaaggcccagaccgtggccgccagcgccagcagcggcaacgaccagagactgaaggaggccgccgccaacggcggcagcggccccagagcccccgtgggcagcatcaacgccagaaccaccagcgacatcgccaaggagctggaggagcagttctacaccctggtgcccttcggcagaaacgagctgctgagccccctgaaggacagcgacgagatcagaagcctgtgggtgaagatcgacctgaccctgctgagcagaatccccgagcacctgccccaggagcccggcgtgctgagcgcccccgccaccaaggacagcgagagcgccccccccagccacaccagcgacacccccgccgagaaggccctgcccaagagcaagagaaagagaaagtgcgacaacgaggacgactacagagagatcaagaagagccagggcgagaaggacagcagcagcagactggccaccagcaccagcaacaccctgagcgccaaccactgcaacatgaacatcaacagcatgcagctgcccatctag

SEQ ID NO: 7580 - DNA, 390 bp, Artificial Sequence
  Description of Artificial Sequence: Synthetic coding sequence
atggacagcttcgacctggccctgctgcaggagtgggacctggagagcctgtgcgtgtacgagcccgacagaaacgccctgagaagaaaggagagagagagaagaaaccaggagacccagcaggacgacggcaccttcaacagcagctacagcctgttcagcgagccctacaagaccaacaagggcgacgagctgagcaacagaatccagaacaccctgggcaactacgacgagatgaaggacttcctgaccgacagaagcaaccagagccacctggtgggcgtgcccaagcccggcgtgccccagacccccgtgaacaagatcgacgagcacttcgtggccgacagcagagcccagaaccagcccagcagcatctgcagcaccacctag

SEQ ID NO: 7581 - DNA, 3066 bp, Artificial Sequence
  Description of Artificial Sequence: Synthetic coding sequence
atgaccctgagactggacgccggcggcatccccagcctggcccccagagtgtacatcagcggcagccccagccagagattcctgcccagaaagagaaacaagggcgagagcgccggcagagacagcctgctggccggcagcgccagattcggcagcagaggcgaggcccagctgcagggcagcgagctgctgagcagaaacagcggcgagagcctggtgagaatcagaagctgcggccaggagctgatcacctgcctgagcagacccgagaccggcggcaagttcgaggtggacacccagagacccgtgtgcccccccagcagagccagagccgccagagccagcgccgccgccgtggccgccgccgccaccctgaccccccccaccatggacagcttcgacctggccctgctgcaggagtgggacctggagagcctgtggggcgaggacatcctgaaccagagaaacgacagcctggtggtggagttccagagcagcgccagcagatgcagaagcgtgtacgagcccgacagaaacgccctgagaagaaaggagagagagagaagaaaccaggagacccagcaggacgacggcaccttcaacagcagctacagcctgttcagcgagccctacaagaccaacaagggcgacgagctgagcaacagaatccagaacaccctgggcaactacgacgagatgaaggacttcctgaccgacagaagcaaccagagccacctggtgggcgtgcccaagcccggcgtgccccagacccccgtgaacaagatcgacgagcacttcgtggccgacagcagagcccagaaccagcccagcagcatctgcagcaccaccaccagcacccccgccgccgtgcccgtgcagcagagcaagagaggcaccatgggctggcagaaggccggccacccccccagcgacggccagcagagagccacccagcagggcagcctgagaaccctgctgggcgacggcgtgggcagacagcagcccagagccaagcaggtgtgcaacgtggaggtgggcctgcagacccaggagagaccccccgccatggccgccaagcacagcagcagcggccactgcgtgcagaacttcccccccagcctggccagcaagcccagcctggtgcagcagaagcccaccgcctacgtgagacccatggacggccaggaccaggcccccgacgagagccccaagctgaagagcagcagcgagaccagcgtgcactgcaccagctacagaggcgtgcccgccagcaagcccgagcccgccagagccaaggccaagctgagcaagttcagcatccccaagcagggcgaggagagcagaagcggcgagaccaacagctgcgtggaggagatcatcagagagatgacctggctgccccccctgagcgccatccaggcccccggcaaggtggagcccaccaagttccccttccccaacaaggacagccagctggtgagcagcggccacaacaaccccaagaagggcgacgccgagcccgagagccccgacagcggcaccagcaacaccagcatgctggaggacgacctgaagctgagcagcgacgaggaggagaacgagcaggccgcccagagaaccgccctgagagccctgagcgacagcgccgtggtgcagcagcccaactgcagaaccagcgtgcccagcagcaagggcagcagcagcagcagcagcagcggcagcagcagcagcagcagcgacagcgagagcagcagcggcagcgacagcgagaccgagagcagcagcagcgagagcgagggcagcaagcccccccacttcagcagccccgaggccgagcccgccagcagcaacaagtggcagctggacaagtggctgaacaaggtgaacccccacaagccccccatcctgatccagaacgagagccacggcagcgagagcaaccagtactacaaccccgtgaaggaggacgtgcaggactgcggcaaggtgcccgacgtgtgccagcccagcctgagagagaaggagatcaagagcacctgcaaggaggagcagagacccagaaccgccaacaaggcccccggcagcaagggcgtgaagcagaagagcccccccgccgccgtggccgtggccgtgagcgccgccgcccccccccccgccgtgccctgcgcccccgccgagaacgcccccgcccccgccagaagaagcgccggcaagaagcccaccagaagaaccgagagaaccagcgccggcgacggcgccaactgccacagacccgaggagcccgccgccgccgacgccctgggcaccagcgtggtggtgccccccgagcccaccaagaccagaccctgcggcaacaacagagccagccacagaaaggagctgagaagcagcgtgacctgcgagaagagaagaaccagaggcctgagcagaatcgtgcccaagagcaaggagttcatcgagaccgagagcagcagcagcagcagcagcagcgacagcgacctggagagcgagcaggaggagtaccccctgagcaaggcccagaccgtggccgccagcgccagcagcggcaacgaccagagactgaaggaggccgccgccaacggcggcagcggccccagagcccccgtgggcagcatcaacgccagaaccaccagcgacatcgccaaggagctggaggagcagttctacaccctggtgcccttcggcagaaacgagctgctgagccccctgaaggacagcgacgagatcagaagcctgtgggtgaagatcgacctgaccctgctgagcagaatccccgagcacctgccccaggagcccggcgtgctgagcgcccccgccaccaaggacagcgagagcgccccccccagccacaccagcgacacccccgccgagaaggccctgcccaagagcaagagaaagagaaagtgcgacaacgaggacgactacagagagatcaagaagagccagggcgagaaggacagcagcagcagactggccaccagcaccagcaacaccctgagcgccaaccactgcaacatgaacatcaacagcctgagcctgccctag

SEQ ID NO: 7582 - DNA, 17388 bp, Artificial Sequence
  Description of Artificial Sequence: Synthetic coding sequence
atgtgcgactgcttccacatggtgctgcccacctggcccggcacccccggcagcgtgagcggcagacagctgcagcccggcgagcccggcgccgagaccgaggacgaccacagcgtgaccgagggccccgccgacgagggcatcagacccagaccccagggcagcagccccgtgtacgagtacaccaccgaggccgccgacttcggcctgcaggaggacgcccccggcagacagggcagcgccggcagaagaagaagctggtggaagagagacagcggcgacagcagaaccttcttcagaatgagcagacccgaggccgtgcaggaggccaccgaggtgaccctgaagaccgaggtggaggccggcgccagcggctacagcgtgaccggcggcggcgaccagggcatcttcgtgaagcaggtgctgaaggacagcagcgccgccaagctgttcaacctgagagagggcgaccagctgctgagcaccaccgtgttcttcgagaacatcaagtacgaggacgccctgaagatcctgcagtacagcgagccctacaaggtgcagttcaagatcagaagacagctgcccgccccccaggacgaggagtgggccagcagcgacgcccagcacggcccccagggcaaggagaaggaggacaccgacgtggccgacggctgcagagagacccccaccaagaccctggagggcgacggcgaccaggagagactgatcagcaagcccagagtgggcagaggcagacagagccagagagagagactgagctggcccaagttccagagcatcaagagcaagagaggccccggcccccagagaagccacagcagcagcgaggcctacgagcccagagacgcccacgacgtgagccccaccagcaccgacaccgaggcccagctgaccgtggagagacaggagcagaaggccggccccggcagccagagaagaagaaagttcctgaacctgagattcagaaccggcagcggccagggccccagcagcaccggccagcccggcagaggcttccagagcggcgtgggcagagccggcgtgctggaggagctgggcccctggggcgacagcctggaggagaccggcgccgccaccggcagcagaagagaggagagagccgagcaggacagagaggtgatgcccgcccagagcatgcccctgcccaccgagctgggcgaccccagactgtgcgagggcaccccccaggagggcggcctgagagccgccagactgcacggcaagaccctggagggccaggcccaggagaccgccgtggcccagagaaagcccagagcccagcccacccccggcatgagcagagagggcgagggcgagggcctgcagagcctggagatcggcatcgccagactgagcctgagagacaccaccgagggcggcacccagatcggcccccccgagatcagagtgagagtgcacgacctgaagacccccaagttcgccttcagcaccgagaaggagcccgagagagagagaagactgagcaccccccagagaggcaagagacaggacgccagcagcaaggccggcaccggcctgaagggcgaggaggtggagggcgccggctggatgcccggcagagagcccaccacccacgccgaggcccagggcgacgagggcgacggcgaggagggcctgcagagaaccagaatcaccgaggagcaggacaagggcagagaggacaccgagggccagatcagaatgcccaagttcaagatccccagcctgggctggagccccagcaagcacaccaagaccggcagagagaaggccaccgaggacaccgagcagggcagagagggcgaggccaccgccaccgccgacagaagagagcagagaagaaccgaggagggcctgaaggacaaggaggacagcgacagcatgaccaacaccaccaagatccagctgatccacgacgagaagagactgaagaaggagcagatcctgaccgagaaggaggtggccaccaaggacagcaagttcaagatgcccaagttcaagatgcccctgttcggcgccagcgcccccggcaagagcatggaggccagcgtggacgtgagcgcccccaaggtggaggccgacgtgagcctgctgagcatgcagggcgacctgaagaccaccgacctgagcgtgcagacccccagcgccgacctggaggtgcaggacggccaggtggacgtgaagctgcccgagggccccctgcccgagggcgccagcctgaagggccacctgcccaaggtgcagagacccagcctgaagatgcccaaggtggacctgaagggccccaagctggacctgaagggccccaaggccgaggtgaccgcccccgacgtgaagatgagcctgagcagcatggaggtggacgtgcaggcccccagagccaagctggacggcgccagactggagggcgacctgagcctggccgacaaggaggtgaccgccaaggacagcaagttcaagatgcccaagttcaagatgcccagcttcggcgtgagcgcccccggcaagagcatggaggacagcgtggacgtgagcgcccccaaggtggaggccgacgtgagcctgagcagcatgcagggcgacctgaaggccaccgacctgagcatccagccccccagcgccgacctggaggtgcaggccggccaggtggacgtgaagctgcccgagggccccgtgcccgagggcgccggccccaaggtgcacctgcccaaggtggagatgcccagcttcaagatgcccaaggtggacctgaagggcccccagatcgacgtgaagggccccaagctggacctgaagggccccaaggccgaggtgaccgcccccgacggcgaggtgagcctgcccagcatggaggtggacgtgcaggcccagaaggccaagctggacggcgcctggctggagggcgacctgagcctggccgacaaggacgtgaccgccaaggacagcaagttcaagatgcccaagttcaagatgcccagcttcggcgtgagcgcccccggcaagagcatcaaggccctggtggacgtgagcgcccccaaggtggaggccgacctgagcctgcccagcatgcagggcgacctgaagaccaccgacctgagcatccagcccgccagcaccgacctgaaggtgcaggccgaccaggtggacgtgaagctgcccgagggccacctgcccgagggcgccggcctgaagggccacctgcccaaggtggagatgcccagcttcaagatgcccaaggtggccctgaagggcccccaggtggacgtgaagggccccaagctggacctgaagagccccaaggccgaggtgaccgcccccgacgtggaggtgagcctgcccagcgtggaggtggacgtggaggcccccggcgccaagctggacagcgccagactggagggcgagctgagcctggccgacaaggacgtgaccgccaaggacagcagattcaagatgcccaagttcaagatgcccagcttcggcgccagcgcccccggcaagagcatcgaggccagcgtggacgtgagcgcccccaaggtggaggccgacgtgagcctgcccagcatgcagggcgacctgaagaccaccgacctgagcatccagccccccagcgccgacctggaggtgcacgccggccaggtggacgtgaagctgctggagggccacgtgcccgagggcgccggcttcaagggccacctgcccaaggtgcagatgcccagcctgaagatgcccaaggtggacctgaagggcccccaggtggaggtgagaggccccaagctggacctgaagggccacaaggccgaggtgaccgcccacgaggtggccgtgagcctgcccagcgtggaggtggacatgcaggcccccggcgccaagctggacggcgcccagctggacggcgacctgagcctggccgacaaggacgtgaccgccaaggacagcaagttcaagatgcccaagttcaagatgcccagcttcggcgtgagcgcccccggcaagagcatcgaggccagcgtggacctgagcgcccccaaggtggaggccgacatgagcctgcccagcatgcagggcgacctgaagaccaccgacctgagcatccagccccccagcaccgacctggagctgcaggccggccagctggacgtgaagctgcccgagggccccgtgcccgagggcgccggcctgaagggccacctgcccaagctgcagatgcccagcttcaaggtgcccaaggtggacctgaagggccccgagatcgacatcaagggccccaagctggacctgaaggaccccaaggtggaggtgaccgcccccgacgtggaggtgagcctgcccagcgtggaggtggacgtggaggcccccggcgccaagctggacggcggcagactggaggaggacatgagcctggccgacaaggacctgaccaccaaggacagcaagttcaagatgcccaagttcaagatgcccagcttcggcgtgagcgcccccggcaagagcatcgaggccagcgtggacgtgagcgcccccaaggtggaggccgacgtgagcctgcccagcatgcagggcgacctgaaggccaccgacctgagcatccagccccccagcgccgacctggaggtgcaggccggccaggtggacgtgaagctgcccgagggccccgtgagcgagggcgccggcctgaagggccacctgcccaaggtgcagatgcccagcttcaagatgcccaaggtggacctgaagggcccccagatcgacgtgaagggccccaagctggacctgaagggccccaaggtggaggtgaccgcccccgacgtgaagatgagcctgagcagcatggaggtggacgtgcaggcccccagagccaagctggacggcgcccagctggagggcgacctgagcctggccgacaaggccgtgaccgccaaggacagcaagttcaagatgcccaagttcaagatgcccagcttcggcgtgagcgcccccggcaagagcatcgaggccagcgtggacgtgagcgagcccaaggtggaggccgacgtgagcctgcccagcatgcagggcgacctgaagaccaccgacctgagcatccagagccccagcgccgacctggaggtgcaggccggccaggtgaacgtgaagctgcccgagggccccctgcccgagggcgccggcttcaagggccacctgcccaaggtgcagatgcccagcctgaagatgcccaaggtggccctgaagggcccccagatggacgtgaagggccccaagctggacctgaagggccccaaggccgaggtgatggcccccgacgtggaggtgagcctgcccagcgtggaggtggacgtggaggcccccggcgccaagctggacagcgtgagactggagggcgacctgagcctggccgacaaggacgtgaccgccaaggacagcaagttcaagatgcccaagttcaagatgcccagcttcggcgtgagcgcccccggcaagagcatcgaggccagcgtggacgtgagcgcccccaaggtggaggccgaggtgagcctgcccagcatgcagggcgacctgaagaccaccgacctgtgcatccccctgcccagcgccgacctggtggtgcaggccggccaggtggacatgaagctgcccgagggccaggtgcccgagggcgccggcctgaagggccacctgcccaaggtggacatgcccagcttcaagatgcccaaggtggacctgaagggcccccagaccgacgtgaagggcgccaagctggacctgaagggccccaaggccgaggtgaccgcccccgacgtggaggtgagcctgcccagcatggaggtggacgtgcaggcccagaaggccaagctggacggcgccagactggagggcgacctgagcctggccgacaaggacatgaccgccaaggacagcaagttcaagatgcccaagttcaagatgcccagcttcggcgtgagcgcccccggcagaagcatcgaggccagcgtggacgtgcccgcccccaaggtggaggccgacgtgagcctgcccagcatgcagggcgacctgaagaccaccgacctgagcatccagccccccagcgccgacctgaaggtgcagaccggccaggtggacgtgaagctgcccgagggccacgtgcccgagggcgccggcctgaagggccacctgcccaaggtggagatgcccagcctgaagatgcccaaggtggacctgaagggcccccaggtggacatcaagggccccaagctggacctgaaggaccccaaggtggagatgagagtgcccgacgtggaggtgagcctgcccagcatggaggtggacgtgcaggcccccagagccaagctggacagcgcccacctgcagggcgacctgaccctggccaacaaggacctgaccaccaaggacagcaagttcaagatgcccaagttcaagatgcccagcttcggcgtgagcgcccccggcaagagcatcgaggccagcgtggacgtgagcccccccaaggtggaggccgacatgagcctgcccagcatgcagggcgacctgaagaccaccgacctgagcatccagcccctgagcgccgacgtgaaggtgcaggccggccaggtggacgtgaagctgctggagggccccgtgcccgaggaggtgggcctgaagggccacctgcccaagctgcagatgcccagcttcaaggtgcccaaggtggacctgaagggccccgagatcgacatcaagggccccaagctggacctgaaggaccccaaggtggaggtgaccgcccccgacgtggaggtgagcctgcccagcgtggaggtggacgtgaaggcccccggcgccaagctggacggcgccagactggagggcgacatgagcctggccgacaaggacgtgaccgccaaggacagcaagttcaagatgcccaagttcaagatgctgagcttcggcgtgagcgccctgggcaagagcatcgaggccagcgccgacgtgagcgccctgaaggtggaggccgacgtgagcctgcccagcatgcagggcgacctgaagaccaccgacctgagcgtgcagccccccagcgccgacctggaggtgcaggccggccaggtggacgtgaagctgcccgagggccccgtgcccgagggcgccggcctgaagggccacctgcccaagctgcagatgcccagcttcaagatgcccaaggtggacctgaagggcccccagatcgacgtgaagggccccaagctggacctgaagggccccaagaccgacgtgatggcccccgacgtggaggtgagccagcccagcgtggaggtggacgtggaggcccccggcgccaagctggacggcgcctggctggagggcgacctgagcgtggccgacaaggacgtgaccaccaaggacagcagattcaagatccccaagttcaagatgcccagcttcggcgtgagcgcccccggcaagagcatcgaggccagcgtggacgtgagcgcccccaaggtggaggccgacggcagcctgagcagcatgcagggcgacctgaaggccaccgacctgagcatccagccccccagcgccgacctggaggtgcaggccggccaggtggacgtgaagctgcccgagggccccgtgcccgagggcgccggcctgaagggccacctgcccaaggtgcagatgcccagcttcaagatgcccgagatggacctgaagggcccccagctggacgtgaagggccccaagctggacctgaagggccccaaggccgaggtgaccgcccccgacgtggagatgagcctgagcagcatggaggtggacgtgcaggcccccagagccaagctggacggcgccagactggagggcgacctgagcctggccgacaagggcgtgaccgccaaggacagcaagttcaagatgcccaagttcaagatgcccagcttcagagtgagcgcccccggcgagagcatcgaggccctggtggacgtgagcgagctgaaggtggaggccgacatgagcctgcccagcatgcagggcgacctgaagaccaccgacatcagcatccagccccccagcgcccagctggaggtgcaggccggccaggtggacgtgaagctgcccgagggccacgtgcccgagggcgccggcctgaagggccacctgcccaagctgcagatgcccagcttcaagatgcccgaggtggacctgaagggcccccagatcgacgtgaagggccccaacgtggacctgaagggccccaaggccgaggtgaccgcccccgacgtgaagatgagcctgagcagcatggaggtggacgtgcaggcccccagagccaagctggacggcgccagactggagggcgacctgagcctggccgacaagggcatgaccgccaaggacagcaagttcaagatgcccaagttcaagatgcccagcttcggcgtgagcgcccccggcaagagcatcgaggccagcgtggacgtgagcgagctgaaggtggaggccgacggcagcttccccagcatgcagggcgacctgaagaccaccgacatcagaatccagccccccagcgcccagctggaggtgcaggccggccaggtggacgtgaagctgcccgagggccacgtgcccgagggcgccggcctgaagggccacctgcccaaggtgcagatgcccagcttcaagatgcccaaggtggacctgaagggcccccagatcgacgtgaagggccccaagctggacctgaagggccccaaggccgaggtgaccgcccccgacgtggaggtgagcctgcccagcgtggaggtggacgtggaggcccccagagccaagctggacggcgccagactggagggcgacctgagcctggccgacaaggacgtgaccgccaaggacagcaagttcaagatgcccaagttcaagatgcccagcttcggcgtgagcgcccccggcaagagcatcgaggtgagcgtggacgtgagcgcccccaaggtggaggccgaggtgagcctgcccagcatgcagggcgacctgaagaccaccgacatcagcatcgagccccccagcgcccagctggaggtgcaggccggccaggtggacctgaagctgcccgagggccacgtgcccgagggcgccggcctgaagggccacctgcccaagctgcagatgcccagcttcaagatgcccaaggtggacagaaagggcccccagatcgacgtgaagggccccaagctggacctgaagggccccaagaccgacgtgaccgcccccgacgtggaggtgagccagcccggcatggaggtggacgtggaggcccccggcgccaagctggacggcgccagactggagggcgacctgagcctggccgacaaggacgtgaccgccaaggacagcaagttcaagatgcccaagttcaagatgcccagcttcggcgtgagcgcccccggcaagagcatcgaggtgctggtggacgtgagcgcccccaaggtggaggccgacctgagcctgcccagcatgcagggcgacctgaagaacaccgacatcagcatcgagccccccagcgcccagctggaggtgcaggccggccaggtggacgtgaagctgcccgagggccacgtgctggagggcgccggcctgaagggccacctgcccaagctgcagatgcccagcttcaagatgcccaaggtggacagaaagggcccccagatcgacatcaagggccccaagctggacctgaagggccccaagatggacgtgaccgcccccgacgtggaggtgagccagcccagcatggaggtggacgtggaggcccccggcgccaagctggacggcgccagactggagggcgacctgagcctggccgacaaggacgtgaccgccaaggacagcaagttcaagatgcccaagttcaagatgcccagctacagagccagcgcccccggcaagagcatccaggccagcgtggacgtgagcgcccccaaggccgaggccgacgtgagcctgcccagcatgcagggcgacctgaagaccaccgacctgagcatccagctgcccagcgtggacctggaggtgcaggccggccaggtggacgtgaagctgcccgagggccacgtgcccgagggcgccggcctgaagggccacctgcccaaggtggagatgcccagcttcaagatgcccaaggtggacctgaagagcccccaggtggacatcaagggccccaagctggacctgaaggtgcccaaggccgaggtgaccgtgcccgacgtggaggtgagcctgcccagcgtggaggtggacgtgcaggcccccagagccaagctggacggcgccagactggagggcgacctgagcctggccgagaaggacgtgaccgccaaggacagcaagttcaagatgcccaagttcaagatgcccagcttcggcgtgagcgcccccggcagaagcatcgaggccagcctggacgtgagcgcccccaaggtggaggccgacgtgagcctgagcagcatgcagggcgacctgaaggccaccgacctgagcatccagccccccagcgccgacctggaggtgcaggccgtgcaggtggacgtggagctgctggagggccccgtgcccgagggcgccggcctgaagggccacctgcccaaggtggagatgcccagcctgaagacccccaaggtggacctgaagggcccccagatcgacgtgaagggccccaagctggacctgaagggccccaaggccgaggtgagagtgcccgacgtggaggtgagcctgcccagcgtggaggtggacgtgcaggcccccaaggccaagctggacgccggcagactggagggcgacctgagcctggccgacaaggacgtgaccgccaaggacagcaagttcaagatgcccaagttcaagatgcccagcttcagagtgagcgcccccggcaagagcatggaggccagcgtggacgtgagcgcccccaaggtggaggccgacgtgagcctgcccagcatgcagggcgacctgaagaccaccgacctgagcatccagccccccagcgccgacctgaaggtgcaggccggccagatggacgtgaagctgcccgagggccaggtgcccgagggcgccggcctgaaggagcacctgcccaaggtggagatgcccagcctgaagatgcccaaggtggacctgaagggcccccaggtggacatcaagggccccaagctggacctgaaggtgagcaaggccgaggtgaccgcccccgacgtggaggtgagcctgcccagcgtggaggtggacgtgcaggcccccagagccaagctggacagcgcccagctggagggcgacctgagcctggccgacaaggacgtgaccgccaaggacagcaagttcaagatgcccaagttcaagatgcccagcttcggcgtgagcgcccccggcaagagcatcgaggccagcgtgcacgtgagcgcccccaaggtggaggccgacgtgagcctgcccagcatgcagggcgacctgaagaccaccgacctgagcatccagccccacagcgccgacctgaccgtgcaggccagacaggtggacatgaagctgctggagggccacgtgcccgaggaggccggcctgaagggccacctgcccaaggtgcagatgcccagcttcaagatgcccaaggtggacctgaagggccccgagatcgacatcaagggccccaagctggacctgaaggaccccaaggtggaggtgaccgcccccgacgtggaggtgagcctgcccagcgtggaggtggacgtggaggcccccggcgccaagctggacggcgccagactggagggcgacctgagcctggccgacaaggacatgaccgccaaggacagcaagttcaagatgcccaagttcaagatgcccagcttcggcgtgagcgcccccggcaagagcatggaggccagcgtggacgtgaccgcccccaaggtggaggccgacgtgagcctgcccagcatgcagggcgacctgaaggccaccgacctgagcgtgcagccccccagcgccgacctggaggtgcaggccggccaggtggacgtgaagctgcccgagggccccgtgcccgagggcgccagcctgaagggccacctgcccaaggtgcagatgcccagcttcaagatgcccaaggtggacctgaagggcccccagatcgacgtgaagggccccaagctggacctgaagggccccaaggccgaggtgaccgcccccgacgtgaagatgagcctgagcagcatggaggtggacgtgcaggcccccagagccaagctggacggcgtgcagctggagggcgacctgagcctggccgacaaggacgtgaccgccaaggacagcaagttcaagatgcccaagttcaagatgcccagcttcggcgtgagcgcccccggcaagagcatggaggccagcgtggacgtgagcgagctgaaggccaaggccgacgtgagcctgcccagcatgcagggcgacctgaagaccaccgacctgagcatccagagccccagcgccgacctggaggtgcaggccggccaggtggacgtgaagctgcccgagggccccctgcccaagggcgccggcctgaagggccacctgcccaaggtgcagatgccctgcctgaagatgcccaaggtggccctgaagggcccccaggtggacgtgaagggccccaagctggacctgaagggccccaaggccgacgtgatgacccccgtggtggaggtgagcctgcccagcatggaggtggacgtggaggcccccggcgccaagctggacagcgtgagactggagggcgacctgagcctggccgacaaggacatgaccgccaaggacagcaagttcaagatgcccaagttcaagatgcccagcttcggcgtgagcgcccccggcaagagcatcgaggccagcctggacgtgagcgccctgaaggtggaggccgacgtgagcctgcccagcatgcagggcgacctgaagaccacccacctgagcatccagccccccagcgccgacctggaggtgcaggccggccaggaggacgtgaagctgcccgagggccccgtgcacgagggcgccggcctgaagggccacctgcccaagctgcagatgcccagcttcaaggtgcccaaggtggacctgaagggcccccagatcgacgtgaacgtgcccaagctggacctgaagggccccaaggtggaggtgaccagccccaacctggacgtgagcctgcccagcatggaggtggacatccaggcccccggcgccaagctggacagcaccagactggagggcgacctgagcctggccgacaaggacgtgaccgccaaggacagcaagttcaagatgcccaagttcaagatgcccagcttcggcatgctgagccccggcaagagcatcgaggtgagcgtggacgtgagcgcccccaagatggaggccgacatgagcatccccagcatgcagggcgacctgaagaccaccgacctgagaatccaggcccccagcgccgacctggaggtgcaggccggccaggtggacctgaagctgcccgagggccacatgcccgaggtggccggcctgaagggccacctgcccaaggtggagatgcccagcttcaagatgcccaaggtggacctgaagggcccccaggtggacgtgaagggccccaagctggacctgaagggccccaaggccgaggtgatggcccccgacgtggaggtgagcctgcccagcgtggagaccgacgtgcaggcccccggcagcatgctggacggcgccagactggagggcgacctgagcctggcccacgaggacgtggccggcaaggacagcaagttccagggccccaagctgagcaccagcggcttcgagtggagcagcaagaaggtgagcatgagcagcagcgagatcgagggcaacgtgaccttccacgagaagaccagcaccttccccatcgtggagagcgtggtgcacgagggcgacctgcacgaccccagcagagacggcaacctgggcctggccgtgggcgaggtgggcatggacagcaagttcaagaagctgcacttcaaggtgcccaaggtgagcttcagcagcaccaagacccccaaggacagcctggtgcccggcgccaagagcagcatcggcctgagcaccatccccctgagcagcagcgagtgcagcagcttcgagctgcagcaggtgagcgcctgcagcgagcccagcatgcagatgcccaaggtgggcttcgccggcttccccagcagcagactggacctgaccggcccccacttcgagagcagcatcctgagcccctgcgaggacgtgaccctgaccaagtaccaggtgaccgtgcccagagccgccctggcccccgagctggccctggagatccccagcggcagccaggccgacatccccctgcccaagaccgagtgcagcaccgacctgcagccccccgagggcgtgcccaccagccaggccgagagccacagcggccccctgaacagcatgatccccgtgagcctgggccaggtgagcttccccaagttctacaagcccaagttcgtgttcagcgtgccccagatggccgtgcccgagggcgacctgcacgccgccgtgggcgcccccgtgatgagccccctgagccccggcgagagagtgcagtgccccctgcccagcacccagctgcccagccccggcacctgcgtgagccagggccccgaggagctggtggccagcctgcagaccagcgtggtggcccccggcgaggcccccagcgaggacgccgaccacgagggcaagggcagccccctgaagatgcccaagatcaagctgcccagcttcagatggagccccaagaaggagaccggccccaaggtggaccccgagtgcagcgtggaggacagcaagctgagcctggtgctggacaaggacgaggtggccccccagagcgccatccacatggacctgccccccgagagagacggcgagaagggcagaagcaccaagcccggcttcgccatgcccaagctggccctgcccaagatgaaggccagcaagagcggcgtgagcctgccccagagagacgtggaccccagcctgagcagcgccaccgccggcggcagcttccaggacaccgagaaggccagcagcgacggcggcagaggcggcctgggcgccaccgccagcgccaccggcagcgagggcgtgaacctgcacagaccccaggtgcacatccccagcctgggcttcgccaagcccgacctgagaagcagcaaggccaaggtggaggtgagccagcccgaggccgacctgcccctgcccaagcacgacctgagcaccgagggcgacagcagaggctgcggcctgggcgacgtgcccgtgagccagccctgcggcgagggcatcgcccccacccccgaggaccccctgcagcccagctgcagaaagcccgacgccgaggtgctgaccgtggagagccccgaggaggaggccatgaccaagtacagccaggagagctggttcaagatgcccaagttcagaatgcccagcctgagaagaagcttcagagacagaggcggcgccggcaagctggaggtggcccagacccaggcccccgccgccaccggcggcgaggccgccgccaaggtgaaggagttcctggtgagcggcagcaacgtggaggccgccatgagcctgcagctgcccgaggccgacgccgaggtgaccgccagcgagagcaagagcagcaccgacatcctgagatgcgacctggacagcaccggcctgaagctgcacctgagcaccgccggcatgaccggcgacgagctgagcaccagcgaggtgagaatccaccccagcaagggccccctgcccttccagatgcccggcatgagactgcccgagacccaggtgctgcccggcgagatcgacgagacccccctgagcaagcccggccacgacctggccagcatggaggacaagaccgagaagtggagcagccagcccgagggccccctgaagctgaaggccagcagcaccgacatgcccagccagatcagcgtggtgaacgtggaccagctgtgggaggacagcgtgctgaccgtgaagttccccaagctgatggtgcccagattcagcttccccgcccccagcagcgaggacgacgtgttcatccccaccgtgagagaggtgcagtgccccgaggccaacatcgacaccgccctgtgcaaggagagccccggcctgtggggcgccagcatcctgaaggccggcgccggcgtgcccggcgagcagcccgtggacctgaacctgcccctggaggccccccccatcagcaaggtgagagtgcacatccagggcgcccaggtggagagccaggaggtgaccatccacagcatcgtgacccccgagttcgtggacctgagcgtgcccagaaccttcagcacccagatcgtgagagagagcgagatccccaccagcgagatccagacccccagctacggcttcagcctgctgaaggtgaagatccccgagccccacacccaggccagagtgtacaccaccatgacccagcacagcagaacccaggagggcaccgaggaggcccccatccaggccacccccggcgtggacagcatcagcggcgacctgcagcccgacaccggcgagcccttcgagatgatcagcagcagcgtgaacgtgctgggccagcagaccctgaccttcgaggtgcccagcggccaccagctggccgacagctgcagcgacgaggagcccgccgagatcctggagttcccccccgacgacagccaggaggccaccacccccctggccgacgagggcagagcccccaaggacaagcccgagagcaagaagagcggcctgctgtggttctggctgcccaacatcggcttcagcagcagcgtggacgagaccggcgtggacagcaagaacgacgtgcagagaagcgcccccatccagacccagcccgaggccagacccgaggccgagctgcccaagaagcaggagaaggccggctggttcagattccccaagctgggcttcagcagcagccccaccaagaagagcaagagcaccgaggacggcgccgagctggaggagcagaagctgcaggaggagaccatcaccttcttcgacgccagagagagcttcagccccgaggagaaggaggagggcgagctgatcggccccgtgggcaccggcctggacagcagagtgatggtgaccagcgccgccagaaccgagctgatcctgcccgagcaggacagaaaggccgacgacgagagcaagggcagcggcctgggccccaacgagggctag

SEQ ID NO: 7583 - DNA, 237 bp, Artificial Sequence
  Description of Artificial Sequence: Synthetic coding sequence
atgggccagggccagcaggccatgtgccacgaggccctgagccacatctgggtgcccttcgacctgaagagatggctgctgtacaccttctgcaactggttcgacgtgaccttccagctgcagctgtgcatcctgagaaccctgaagagattctgcagaagcatcctgtacaacctgaaggacagaaagaccttctggctgccccaggcctacctgagcttcctgctgatccagtag

SEQ ID NO: 7584 - DNA, 579 bp, Artificial Sequence
  Description of Artificial Sequence: Synthetic coding sequence
atggcctgcggcgccaccctgaagagacccatggagttcgaggccgccctgctgagccccggcagccccaagagaagaagatgcgcccccctgcccggccccacccccggcctgagaccccccgacgccgagccccccccccccttccagacccagacccccccccagagcctgcagcagcccgccccccccggcagcgagagaagactgcccacccccgagcagatcttccagaacatcaagcaggagtacagcagataccagagatggagacacctggaggtggtgctgaaccagagcgaggcctgcgccagcgagagccagccccacagcagcgccctgaccgcccccagcagccccggcagcagctggatgaagaaggaccagcccaccttcaccctgagacaggtgggcatcatctgcgagagactgctgaaggactacgaggacaagatcagagaggagtacgagcagatcctgaacaccaagctggccgagcagtacgagagcttcgtgaagttcacccacgaccagatcatgagaagatacggcaccagacccaccagctacgtgagctag

SEQ ID NO: 7585 - DNA, 444 bp, Artificial Sequence
  Description of Artificial Sequence: Synthetic coding sequence
atggcctgcggcgccaccctgaagagacccatggagttcgaggccgccctgctgagccccggcagccccaagagaagaagatgcgcccccctgcccggccccacccccggcctgagaccccccgacgccgagccccccccccccttccagacccagacccccccccagagcctgcagcagcccgccccccccggcagcgagagaagactgcccacccccgagcagatcttccagaacatcaagcaggagtacagcagataccagagatggagacacctggaggtggtgctgaaccagagcgaggcctgcgccagcgagagccagccccacagcagcgccctgaccgcccccagcagccccgagcagtacgagagcttcgtgaagttcacccacgaccagatcatgagaagatacggcaccagacccaccagctacgtgagctag

SEQ ID NO: 7586 - DNA, 612 bp, Artificial Sequence
  Description of Artificial Sequence: Synthetic coding sequence
atggcctgcggcgccaccctgaagagaaccctggacttcgaccccctgctgagccccgccagccccaagagaagaagatgcgcccccctgagcgcccccaccagcgccgccgccagccccctgagcgccgccgccgccaccgccgccagcttcagcgccgccgccgccagcccccagaagtacctgagaatggagcccagccccttcggcgacgtgagcagcagactgaccaccgagcagatcctgtacaacatcaagcaggagtacaagagaatgcagaagagaagacacctggagaccagcttccagcagaccgacccctgctgcaccagcgacgcccagccccacgccttcctgctgagcggccccgccagccccggcaccagcagcgccgccagcagccccctgaagaaggagcagcccctgttcaccctgagacaggtgggcatgatctgcgagagactgctgaaggagagagaggagaaggtgagagaggagtacgaggagatcctgaacaccaagctggccgagcagtacgacgccttcgtgaagttcacccacgaccagatcatgagaagatacggcgagcagcccgccagctacgtgagctag

SEQ ID NO: 7587 - DNA, 5724 bp, Artificial Sequence
  Description of Artificial Sequence: Synthetic coding sequence
atggaggtggcctggctggtgtacgtgctgggccagcagcccctggccagacagggcgagggccagagcagactggtgcccggcagaggcctggtgctgtggctgcccggcctgcccagaagcagccccagctggcccgccgtggacctggcccccctggcccccgccagacccagaggccccctgatctgccacaccggccacgagcaggccggcagagagcccggccccggcagcagcaccaagggccccgtgctgcacgaccaggacaccagatgcgccttcctgcccagaccccccggccccctgcagaccagaagatactgcagacaccagggcagacagggcagcggcctgggcgccggccccggcgccggcacctgggcccccgccccccccggcgtgagcaagcccagatgccccggcagagccagacccggcgagggccagcagcaggtgaccaccgccagaccccccgccatcaacagaggcgccagacagcccagagccggcgccgccgccgccggcagaggccccggcgccggcgcctggagaaccggcgaggccgccgccagcgccggccccgccgtgggcgagggcggcgccatgggcagcagaagagcccccagcagaggctggggcgccggcggcagaagcggcgccggcggcgacggcgaggacgacggccccgtgtggatccccagccccgccagcagaagctacctgctgagcgtgagacccgagaccagcctgagcagcaacagactgagccaccccagcagcggcagaagcaccttctgcagcatcatcgcccagctgaccgaggagacccagcccctgttcgagaccaccctgaagagcagaagcgtgagcgaggacagcgacgtgagattcacctgcatcgtgaccggctaccccgagcccgaggtgacctggtacaaggacgacaccgagctggacagatactgcggcctgcccaagtacgagatcacccaccagggcaacagacacaccctgcagctgtacagatgcagagaggaggacgccgccatctaccaggccagcgcccagaacagcaagggcatcgtgagctgcagcggcgtgctggaggtgggcaccatgaccgagtacaagatccaccagagatggttcgccaagctgaagagaaaggccgccgccaagctgagagagatcgagcagagctggaagcacgagaaggccgtgcccggcgaggtggacaccctgagaaagctgagccccgacagattccagagaaagagaagactgagcggcgcccaggcccccggccccagcgtgcccaccagagagcccgagggcggcaccctggccgcctggcaggagggcgagaccgagaccgcccagcacagcggcctgggcctgatcaacagcttcgccagcggcgaggtgaccaccaacggcgaggccgcccccgagaacggcgaggacggcgagcacggcctgctgacctacatctgcgacgccatggagctgggcccccagagagccctgaaggaggagagcggcgccaagaagaagaagaaggacgaggagagcaagcagggcctgagaaagcccgagctggagaaggccgcccagagcagaagaagcagcgagaactgcatccccagcagcgacgagcccgacagctgcggcacccagggccccgtgggcgtggagcaggtgcagacccagcccagaggcagagccgccagaggccccggcagcagcggcaccgacagcaccagaaagcccgccagcgccgtgggcacccccgacaaggcccagaaggcccccggccccggccccggccaggaggtgtacttcagcctgaaggacatgtacctggagaacacccaggccgtgagacccctgggcgaggagggcccccagaccctgagcgtgagagcccccggcgagagccccaagggcaaggcccccctgagagccagaagcgagggcgtgcccggcgcccccggccagcccacccacagcctgaccccccagcccaccagacccttcaacagaaagagattcgccccccccaagcccaagggcgaggccaccaccgacagcaagcccatcagcagcctgagccaggcccccgagtgcggcgcccagagcctgggcaaggcccccccccaggccagcgtgcaggtgcccaccccccccgccagaagaagacacggcaccagagacagcaccctgcagggccaggccggccacagaacccccggcgaggtgctggagtgccagaccaccaccgcccccaccatgagcgccagcagcagcagcgacgtggccagcatcggcgtgagcaccagcggcagccagggcatcatcgagcccatggacatggagacccaggaggacggcagaaccagcgccaaccagagaaccggcagcaagaagaacgtgcaggccgacggcaagatccaggtggacggcagaaccagaggcgacggcacccagaccgcccagagaaccagagccgacagaaagacccaggtggacgccggcacccaggagagcaagagaccccagagcgacagaagcgcccagaagggcatgatgacccagggcagagccgagacccagctggagaccacccaggccggcgagaagatccaggaggacagaaaggcccaggccgacaagggcacccaggaggacagaagaatgcagggcgagaagggcatgcagggcgagaagggcacccagagcgagggcagcgcccccaccgccatggagggccagagcgagcaggaggtggccaccagcctgggcccccccagcagaacccccaagctgccccccaccgccggccccagagcccccctgaacatcgagtgcttcgtgcagacccccgagggcagctgcttccccaagaagcccggctgcctgcccagaagcgaggaggccgtggtgaccgccagcagaaaccacgagcagaccgtgctgggccccctgagcggcaacctgatgctgcccgcccagcccccccacgagggcagcgtggagcaggtgggcggcgagagatgcagaggcccccagagcagcggccccgtggaggccaagcaggaggacagccccttccagtgccccaaggaggagagacccggcggcgtgccctgcatggaccagggcggctgccccctggccggcctgagccaggaggtgcccaccatgcccagcctgcccggcaccggcctgaccgccagccccaaggccggcccctgcagcacccccaccagccagcacggcagcaccgccaccttcctgcccagcgaggaccaggtgctgatgagcagcgcccccaccctgcacctgggcctgggcacccccacccagagccacccccccgagaccatggccaccagcagcgagggcgcctgcgcccaggtgcccgacgtggagggcagaacccccggccccagaagctgcgaccccggcctgatcgacagcctgaagaactacctgctgctgctgctgaagctgagcagcaccgagaccagcggcgccggcggcgagagccaggtgggcgccgccaccggcggcctggtgcccagcgccaccctgacccccaccgtggaggtggccggcctgagccccagaaccagcagaagaatcctggagagagtggagaacaaccacctggtgcagagcgcccagaccctgctgctgagcccctgcaccagcagaagactgaccggcctgctggacagagaggtgcaggccggcagacaggccctggccgccgccagaggcagctggggccccggccccagcagcctgaccgtgcccgccatcgtggtggacgaggaggaccccggcctggccagcgagggcgccagcgagggcgagggcgaggtgagccccgagggccccggcctgctgggcgccagccaggagagcagcatggccggcagactgggcgaggccggcggccaggccgcccccggccagggccccagcgccgagagcatcgcccaggagcccagccaggaggagaagttccccggcgaggccctgaccggcctgcccgccgccacccccgaggagctggccctgggcgccagaagaaagagattcctgcccaaggtgagagccgccggcgacggcgaggccaccacccccgaggagagagagagccccaccgtgagccccagaggccccagaaagagcctggtgcccggcagccccggcacccccggcagagagagaagaagccccacccagggcagaaaggccagcatgctggaggtgcccagagccgaggaggagctggccgccggcgacctgggccccagccccaaggccggcggcctggacaccgaggtggccctggacgagggcaagcaggagaccctggccaagcccagaaaggccaaggacctgctgaaggccccccaggtgatcagaaagatcagagtggagcagttccccgacgccagcggcagcctgaagctgtggtgccagttcttcaacatcctgagcgacagcgtgctgacctgggccaaggaccagagacccgtgggcgaggtgggcagaagcgccggcgacgagggccccgccgccctggccatcgtgcaggccagccccgtggactgcggcgtgtacagatgcaccatccacaacgagcacggcagcgccagcaccgacttctgcctgagccccgaggtgctgagcggcttcatcagcagagaggagggcgaggtgggcgaggagatcgagatgacccccatggtgttcgccaagggcctggccgacagcggctgctggggcgacaagctgttcggcagactggtgagcgaggagctgagaggcggcggctacggctgcggcctgagaaaggccagccaggccaaggtgatctacggcctggagcccatcttcgagagcggcagaacctgcatcatcaaggtgagcagcctgctggtgttcggccccagcagcgagaccagcctggtgggcagaaactacgacgtgaccatccagggctgcaagatccagaacatgagcagagagtactgcaagatcttcgccgccgaggccagagccgcccccggcttcggcgaggtgcccgagatcatccccctgtacctgatctacagacccgccaacaacatcccctacgccaccctggaggaggacctgggcaagcccctggagagctactgcagcagagagtggggctgcgccgaggcccccaccgccagcggcagcagcgaggccatgcagaagtgccagaccttccagcactggctgtaccagtggaccaacggcagcttcctggtgaccgacctggccggcgtggactggaagatgaccgacgtgcagatcgccaccaagctgagaggctaccagggcctgaaggagagctgcttccccgccctgctggacagattcgccagcagccaccagtgcaacgcctactgcgagctgctgggcctgacccccctgaagggccccgaggccgcccacccccaggccaaggccaagggcagcaagagccccagcgccggcagaaagggcagccagctgagcccccagccccagaagaagggcctgcccagcccccagggcaccagaaagagcgcccccagcagcaaggccaccccccaggccagcgagcccgtgaccacccagctgctgggccagccccccacccaggaggagggcagcaaggcccagggcatgagatag

SEQ ID NO: 7588 - DNA, 225 bp, Artificial Sequence
  Description of Artificial Sequence: Synthetic coding sequence
atggacagcgaggtgcagagagacggcagaatcctggacctgatcgacgacgcctggagagaggacaagctgccctacgaggacgtggccatccccctgaacgagctgcccgagcccgagcaggacaacggcggcaccaccgagagcgtgaaggagcaggagatgaagtggaccgacctggccctgcagtacctgcacgagaacgtgccccccatcggcaactag

SEQ ID NO: 7589 - DNA, 225 bp, Artificial Sequence; identical to SEQ ID NO: 7588
  Description of Artificial Sequence: Synthetic coding sequence

SEQ ID NO: 7590 - DNA, 225 bp, Artificial Sequence; identical to SEQ ID NO: 7588
  Description of Artificial Sequence: Synthetic coding sequence

SEQ ID NO: 7591 - DNA, 225 bp, Artificial Sequence; identical to SEQ ID NO: 7588
  Description of Artificial Sequence: Synthetic coding sequence

SEQ ID NO: 7592 - DNA, 1848 bp, Artificial Sequence
  Description of Artificial Sequence: Synthetic coding sequence
atgtgcagcgaggccagactggccagaagactgagagacgccctgagagaggaggagccctgggccgtggaggagctgctgagatgcggcgccgaccccaacctggtgctggaggacggcgccgccgccgtgcacctggccgccggcgccagacaccccagaggcctgagatgcctgggcgccctgctgagacagggcggcgaccccaacgccagaagcgtggaggccctgacccccctgcacgtggccgccgcctggggctgcagaagaggcctggagctgctgctgagccagggcgccgaccccgccctgagagaccaggacggcctgagacccctggacctggccctgcagcagggccacctggagtgcgccagagtgctgcaggacctggacaccagaaccagaaccagaaccagaatcggcgccgagacccaggagcccgagcccgcccccggcacccccggcctgagcggccccaccgacgagaccctggacagcatcgccctgcagaagcagccctgcagaggcgacaacagagacatcggcctggaggccgaccccggcccccccagcctgcccgtgcccctggagaccgtggacaagcacggcagcagcgccagcccccccggccactgggactacagcagcgacgccagcttcgtgaccgccgtggaggtgagcggcgccgaggaccccgccagcgacacccccccctgggccggcagcctgccccccaccagacagggcctgctgcacgtggtgcacgccaaccagagagtgcccagaagccagggcaccgaggccgagctgaacgccagactgcaggccctgaccctgaccccccccaacgccgccggcttccagagcagccccagcagcatgcccctgctggacagaagccccgcccacagcccccccagaacccccacccccggcgccagcgactgccactgcctgtgggagcaccagaccagcatcgacagcgacatggccaccctgtggctgaccgaggacgaggccagcagcaccggcggcagagagcccgtgggcccctgcagacacctgcccgtgagcaccgtgagcgacctggagctgctgaagggcctgagagccctgggcgagaacccccaccccatcacccccttcaccagacagctgtaccaccagcagctggaggaggcccagatcgcccccggccccgagttcagcggccacagcctggagctggccgccgccctgagaaccggctgcatccccgacgtgcaggccgacgaggacgccctggcccagcagttcgagcagcccgaccccgccagaagatggagagagggcgtggtgaagagcagcttcacctacctgctgctggaccccagagagacccaggacctgcccgccagagccttcagcctgacccccgccgagagactgcagaccttcatcagagccatcttctacgtgggcaagggcaccagagccagaccctacgtgcacctgtgggaggccctgggccaccacggcagaagcagaaagcagccccaccaggcctgccccaaggtgagacagatcctggacatctgggccagcggctgcggcgtggtgagcctgcactgcttccagcacgtggtggccgtggaggcctacaccagagaggcctgcatcgtggaggccctgggcatccagaccctgaccaaccagaagcagggccactgctacggcgtggtggccggctggccccccgccagaagaagaagactgggcgtgcacctgctgcacagagccctgctggtgttcctggccgagggcgagagacagctgcacccccaggacatccaggccagaggctag

SEQ ID NO: 7593 - DNA, 1320 bp, Artificial Sequence
  Description of Artificial Sequence: Synthetic coding sequence
atgtggacccccgtgagaagaggcgccgcctggctgggcaccctgctgggccccggcgagggcccccccgagcccagaggcggcgccgcccacgcccacaagccccccgccggcagcagaaagagcaccgaccaggccgtgagattcggccccagccagggcatgtgcagcgaggccagactggccagaagactgagagacgccctgagagaggaggagccctgggccgtggaggagctgctgagatgcggcgccgaccccaacctggtgctggaggacggcgccgccgccgtgcacctggccgccggcgccagacaccccagaggcctgagatgcctgggcgccctgctgagacagggcggcgaccccaacgccagaagcgtggaggccctgacccccctgcacgtggccgccgcctggggctgcagaagaggcctggagctgctgctgagccagggcgccgaccccgccctgagagaccaggacggcctgagacccctggacctggccctgcagcagggccacctggagtgcgccagagtgctgcaggacctggacaccagaaccagaaccagaaccagaatcggcgccgagacccaggagcccgagcccgcccccggcacccccggcctgagcggccccaccgacgagaccctggacagcatcgccctgcagaagcagccctgcagaggcgacaacagagacatcggcctggaggccgaccccggcccccccagcctgcccgtgcccctggagaccgtggacaagcacggcagcagcgccagcccccccggccactgggactacagcagcgacgccagcttcgtgaccgccgtggaggtgagcggcgccgaggaccccgccagcgacacccccccctgggccggcagcctgccccccaccagacagggcctgctgcacgtggtgcacgccaaccagagagtgcccagaagccagggcaccgaggccgagctgaacgccagactgcaggccctgaccctgaccccccccaacgccgccggcttccagagcagccccagcagcatgcccctgctggacagaagccccgcccacagcccccccagaacccccacccccggcgccagcgactgccactgcctgtgggagcaccagaccagcatcgacagcgacatggccaccctgtggctgaccgaggacgaggccagcagcaccggcggcagagagcccgtgggcccctgcagacacctgcccgtgagcaccgtgagcgacctggagctgctgaagggcctgagagccctgggcagactgagaacctgccagcccgagcccagccactag

SEQ ID NO: 7594 - DNA, 1821 bp, Artificial Sequence
  Description of Artificial Sequence: Synthetic coding sequence
atgtgcagcgaggccagactggccagaagactgagagacgccctgagagaggaggagccctgggccgtggaggagctgctgagatgcggcgccgaccccaacctggtgctggaggacggcgccgccgccgtgcacctggccgccggcgccagacaccccagaggcctgagatgcctgggcgccctgctgagacagggcggcgaccccaacgccagaagcgtggaggccctgacccccctgcacgtggccgccgcctggggctgcagaagaggcctggagctgctgctgagccagggcgccgaccccgccctgagagaccaggacggcctgagacccctggacctggccctgcagcagggccacctggagtgcgccagagtgctgcaggacctggacaccagaaccagaaccagaaccagaatcggcgccgagacccaggagcccgagcccgcccccggcacccccggcctgagcggccccaccgacgagaccctggacagcatcgccctgcagaagcagccctgcagaggcgacaacagagacatcggcctggaggccgaccccggcccccccagcctgcccgtgcccctggagaccgtggacaagcacggcagcagcgccagcccccccggccactgggactacagcagcgacgccagcttcgtgaccgccgtggaggtgagcggcgccgaggaccccgccagcgacacccccccctgggccggcagcctgccccccaccagacagggcctgctgcacgtggtgcacgccaaccagagagtgcccagaagccagggcaccgaggccgagctgaacgccagactgcaggccctgaccctgaccccccccaacgccgccggcttccagagcagccccagcagcatgcccctgctggacagaagccccgcccacagcccccccagaacccccacccccggcgccagcgactgccactgcctgtgggagcaccagaccagcatcgacagcgacatggccaccctgtggctgaccgaggacgaggccagcagcaccggcggcagagagcccgtgggcccctgcagacacctgcccgtgagcaccgtgagcgacctggagctgctgaagggcctgagagccctgggccccgagttcagcggccacagcctggagctggccgccgccctgagaaccggctgcatccccgacgtgcaggccgacgaggacgccctggcccagcagttcgagcagcccgaccccgccagaagatggagagagggcgtggtgaagagcagcttcacctacctgctgctggaccccagagagacccaggacctgcccgccagagccttcagcctgacccccgccgagagactgcagaccttcatcagagccatcttctacgtgggcaagggcaccagagccagaccctacgtgcacctgtgggaggccctgggccaccacggcagaagcagaaagcagggcagcagaagaagccccaccagaagcaagggcaccgccatggagtggtggcaggccggccacctgctggtggccggcgcctggggctgcacctgctgcaccgtgcccagcctgagcagctggctgaaggccagcgacagcttcatccccagaaccagcagacccggcgccgagtgctggggcgtgggccaccccgcctggggcgagatgttcgagtgcagcagctgccccatgctgaccgccgcccccatcagcggcttcagaagaggcgtgtgcgtgtgcgtgtgcgtgtgcgtgtgcgtgtgcgtgtgcgtgtgcgtgtgcgtgtgcagagagcaccccggcagaagcccccccggctag

SEQ ID NO: 7595 - DNA, 1848 bp, Artificial Sequence; identical to SEQ ID NO: 7592
  Description of Artificial Sequence: Synthetic coding sequence

SEQ ID NO: 7596 - DNA, 720 bp, Artificial Sequence
  Description of Artificial Sequence: Synthetic coding sequence
atggagaaggagaagggcaacgacgacggcatccccgaccaggagaacagcctggacttcagcgagcacttcaaccagctggagctgctggagacccacggccacctgatccccaccggcacccagagcctgtgggtgggcaacagcgacgaggacgaggagcaggacgacaagaacgaggagtggtacagactgcaggagaagaagatggagaaggaccccagcagactgctgctgtgggccgccgagaagaacagactgaccaccgtgagaagactgctgagcgagaaggccacccacgtgaacaccagagacgaggacgagtacacccccctgcacagagccgcctacagcggccacctggacatcgtgcaggagctgatcgcccagggcgccgacgtgcacgccgtgaccgtggacggctggacccccctgcacagcgcctgcaagtggaacaacaccagagtggccagcttcctgctgcagcacgacgccgacatcaacgcccagaccaagggcctgctgacccccctgcacctggccgccggcaacagagacagcaaggacaccctggagctgctgctgatgaacagatacgtgaagcccggcctgaagaacaacctggaggagaccgccttcgacatcgccagaagaaccagcatctaccactacctgttcgagatcgtggagggctgcaccaacagcagcccccagagctag

SEQ ID NO: 7597 - DNA, 720 bp, Artificial Sequence; identical to SEQ ID NO: 7596
  Description of Artificial Sequence: Synthetic coding sequence

SEQ ID NO: 7598 - DNA, 4458 bp, Artificial Sequence
  Description of Artificial Sequence: Synthetic coding sequence
atggccgcccccgcccagcccaagaagatcgtggcccccaccgtgagccagatcaacgccgagttcgtgacccagctggcctgcaagtactgggccccccacatcaagaagaagagccccttcgacatcaaggtgatcgaggacatctacgagaaggagatcgtgaagagcagattcgccatcagaaagatcatgctgctggagttcagccagtacctggagaactacctgtggatgaactacagccccgaggtgagcagcaaggcctacctgatgagcatctgctgcatggtgaacgagaagttcagagagaacgtgcccgcctgggagatcttcaagaagaagcccgaccacttccccttcttcttcaagcacatcctgaaggccgccctggccgagaccgacggcgagttcagcctgcacgagcagaccgtgctgctgctgttcctggaccactgcttcaacagcctggaggtggacctgatcagaagccaggtgcagcagctgatcagcctgcccatgtggatgggcctgcagctggccagactggagctggagctgaagaagacccccaagctgagaaagttctggaacctgatcaagaagaacgacgagaagatggaccccgaggccagagagcaggcctaccaggagagaagattcctgagccagctgatccagaagttcatcagcgtgctgaagagcgtgcccctgagcgagcccgtgaccatggacaaggtgcactactgcgagagattcatcgagctgatgatcgacctggaggccctgctgcccaccagaagatggttcaacaccatcctggacgacagccacctgctggtgcactgctacctgagcaacctggtgagaagagaggaggacggccacctgttcagccagctgctggacatgctgaagttctacaccggcttcgagatcaacgaccagaccggcaacgccctgaccgagaacgagatgaccaccatccactacgacagaatcaccagcctgcagagagccgccttcgcccacttccccgagctgtacgacttcgccctgagcaacgtggccgaggtggacaccagagagagcctggtgaagttcttcggccccctgagcagcaacaccctgcaccaggtggccagctacctgtgcctgctgcccaccctgcccaagaacgaggacaccaccttcgacaaggagttcctgctggagctgctggtgagcagacacgagagaagaatcagccagatccagcagctgaaccagatgcccctgtaccccaccgagaagatcatctgggacgagaacatcgtgcccaccgagtactacagcggcgagggctgcctggccctgcccaagctgaacctgcagttcctgaccctgcacgactacctgctgagaaacttcaacctgttcagactggagagcacctacgagatcagacaggacatcgaggacagcgtgagcagaatgaagccctggcagagcgagtacggcggcgtggtgttcggcggctgggccagaatggcccagcccatcgtggccttcaccgtggtggaggtggccaagcccaacatcggcgagaactggcccaccagagtgagagccgacgtgaccatcaacctgaacgtgagagaccacatcaaggacgagtgggagggcctgagaaagcacgacgtgtgcttcctgatcaccgtgagacccaccaagccctacggcaccaagttcgacagaagaagacccttcatcgagcaggtgggcctggtgtacgtgagaggctgcgagatccagggcatgctggacgacaagggcagagtgatcgaggacggccccgagcccagacccaacctgagaggcgagagcagaaccttcagagtgttcctggaccccaaccagtaccagcaggacatgaccaacaccatccagaacggcgccgaggacgtgtacgagaccttcaacatcatcatgagaagaaagcccaaggagaacaacttcaaggccgtgctggagaccatcagaaacctgatgaacaccgactgcgtggtgcccgactggctgcacgacatcatcctgggctacggcgaccccagcagcgcccactacagcaagatgcccaaccagatcgccaccctggacttcaacgacaccttcctgagcatcgagcacctgaaggccagcttccccggccacaacgtgaaggtgaccgtggaggaccccgccctgcagatcccccccttcagaatcaccttccccgtgagaagcggcaagggcaagaagagaaaggacgccgacgtggaggacgaggacaccgaggaggccaagaccctgatcgtggagccccacgtgatccccaacagaggcccctacccctacaaccagcccaagagaaacaccatccagttcacccacacccagatcgaggccatcagagccggcatgcagcccggcctgaccatggtggtgggcccccccggcaccggcaagaccgacgtggccgtgcagatcatcagcaacatctaccacaacttccccgagcagagaaccctgatcgtgacccacagcaaccaggccctgaaccagctgttcgagaagatcatggccctggacatcgacgagagacacctgctgagactgggccacggcgaggaggagctggagaccgagaaggacttcagcagatacggcagagtgaactacgtgctggccagaagaatcgagctgctggaggaggtgaagagactgcagaagagcctgggcgtgcccggcgacgccagctacacctgcgagaccgccggctacttcttcctgtaccaggtgatgagcagatgggaggagtacatcagcaaggtgaagaacaagggcagcaccctgcccgacgtgaccgaggtgagcaccttcttccccttccacgagtacttcgccaacgccccccagcccatcttcaagggcagaagctacgaggaggacatggagatcgccgagggctgcttcagacacatcaagaagatcttcacccagctggaggagttcagagccagcgagctgctgagaagcggcctggacagaagcaagtacctgctggtgaaggaggccaagatcatcgccatgacctgcacccacgccgccctgaagagacacgacctggtgaagctgggcttcaagtacgacaacatcctgatggaggaggccgcccagatcctggagatcgagaccttcatccccctgctgctgcagaacccccaggacggcttcagcagactgaagagatggatcatgatcggcgaccaccaccagctgccccccgtgatcaagaacatggccttccagaagtacagcaacatggagcagagcctgttcaccagattcgtgagagtgggcgtgcccaccgtggacctggacgcccagggcagagccagagccagcctgtgcaacctgtacaactggagatacaagaacctgggcaacctgccccacgtgcagctgctgcccgagttcagcaccgccaacgccggcctgctgtacgacttccagctgatcaacgtggaggacttccagggcgtgggcgagagcgagcccaacccctacttctaccagaacctgggcgaggccgagtacgtggtggccctgttcatgtacatgtgcctgctgggctaccccgccgacaagatcagcatcctgaccacctacaacggccagaagcacctgatcagagacatcatcaacagaagatgcggcaacaaccccctgatcggcagacccaacaaggtgaccaccgtggacagattccagggccagcagaacgactacatcctgctgagcctggtgagaaccagagccgtgggccacctgagagacgtgagaagactggtggtggccatgagcagagccagactgggcctgtacatcttcgccagagtgagcctgttccagaactgcttcgagctgacccccgccttcagccagctgaccgccagacccctgcacctgcacatcatccccaccgagcccttccccaccaccagaaagaacggcgagagacccagccacgaggtgcagatcatcaagaacatgccccagatggccaacttcgtgtacaacatgtacatgcacctgatccagaccacccaccactaccaccagaccctgctgcagctgccccccgccatggtggaggagggcgaggaggtgcagaaccaggagaccgagctggagaccgaggaggaggccatgaccgtgcaggccgacatcatccccagccccaccgacaccagctgcagacaggagacccccgccttccagaccgacaccacccccagcgagaccggcgccaccagcacccccgaggccatccccgccctgagcgagaccacccccaccgtggtgggcgccgtgagcgcccccgccgaggccaacaccccccaggacgccaccagcgcccccgaggagaccaagtag

SEQ ID NO: 7599 - DNA, 1083 bp, Artificial Sequence
  Description of Artificial Sequence: Synthetic coding sequence
atgcagatcatcagacacagcgagcagaccctgaagaccgccctgatcagcaagaaccccgtgctggtgagccagtacgagaagctgaacgccggcgagcagagactgatgaacgaggccttccagcccgccagcgacctgttcggccccatcaccctgcacagccccagcgactggatcaccagccaccccgaggccccccaggacttcgagcagttcttcagcgacccctacagaaagacccccagccccaacaagagaagcatctacatccagagcatcggcagcctgggcaacaccagaatcatcagcgaggagtacatcaagtggctgaccggctactgcaaggcctacttctacggcctgagagtgaagctgctggagcccgtgcccgtgagcgtgaccagatgcagcttcagagtgaacgagaacacccacaacctgcagatccacgccggcgacatcctgaagttcctgaagaagaagaagcccgaggacgccttctgcgtggtgggcatcaccatgatcgacctgtaccccagagacagctggaacttcgtgttcggccaggccagcctgaccgacggcgtgggcatcttcagcttcgccagatacggcagcgacttctacagcatgcactacaagggcaaggtgaagaagctgaagaagaccagcagcagcgactacagcatcttcgacaactactacatccccgagatcaccagcgtgctgctgctgagaagctgcaagaccctgacccacgagatcggccacatcttcggcctgagacactgccagtggctggcctgcctgatgcagggcagcaaccacctggaggaggccgacagaagacccctgaacctgtgccccatctgcctgcacaagctgcagtgcgccgtgggcttcagcatcgtggagagatacaaggccctggtgagatggatcgacgacgagagcagcgacacccccggcgccacccccgagcacagccacgaggacaacggcaacctgcccaagcccgtggaggccttcaaggagtggaaggagtggatcatcaagtgcctggccgtgctgcagaagtag

SEQ ID NO: 7600 - DNA, 2172 bp, Artificial Sequence
  Description of Artificial Sequence: Synthetic coding sequence
atggccgagtacaccagactgcacaacgccctggccctgatcagactgagaaacccccccgtgaacgccatcagcaccaccctgctgagagacatcaaggagggcctgcagaaggccgtgatcgaccacaccatcaaggccatcgtgatctgcggcgccgagggcaagttcagcgccggcgccgacatcagaggcttcagcgcccccagaaccttcggcctgaccctgggccacgtggtggacgagatccagagaaacgagaagcccgtggtggccgccatccagggcatggccttcggcggcggcctggagctggccctgggctgccactacagaatcgcccacgccgaggcccaggtgggcctgcccgaggtgaccctgggcctgctgcccggcgccagaggcacccagctgctgcccagactgaccggcgtgcccgccgccctggacctgatcaccagcggcagaagaatcctggccgacgaggccctgaagctgggcatcctggacaaggtggtgaacagcgaccccgtggaggaggccatcagattcgcccagagagtgagcgaccagcccctggagagcagaagactgtgcaacaagcccatccagagcctgcccaacatggacagcatcttcagcgaggccctgctgaagatgagaagacagcaccccggctgcctggcccaggaggcctgcgtgagagccgtgcaggccgccgtgcagtacccctacgaggtgggcatcaagaaggaggaggagctgttcctgtacctgctgcagagcggccaggccagagccctgcagtacgccttcttcgccgagagaaaggccaacaagtggagcacccccagcggcgccagctggaagaccgccagcgccagacccgtgagcagcgtgggcgtggtgggcctgggcaccatgggcagaggcatcgtgatcagcttcgccagagccagaatccccgtgatcgccgtggacagcgacaagaaccagctggccaccgccaacaagatgatcaccagcgtgctggagaaggaggccagcaagatgcagcagagcggccacccctggagcggccccaagcccagactgaccagcagcgtgaaggagctgggcggcgtggacctggtgatcgaggccgtgttcgaggagatgagcctgaagaagcaggtgttcgccgagctgagcgccgtgtgcaagcccgaggccttcctgtgcaccaacaccagcgccctggacgtggacgagatcgccagcagcaccgacagaccccacctggtgatcggcacccacttcttcagccccgcccacgtgatgaagctgctggaggtgatccccagccagtacagcagccccaccaccatcgccaccgtgatgaacctgagcaagaagatcaagaagatcggcgtggtggtgggcaactgcttcggcttcgtgggcaacagaatgctgaacccctactacaaccaggcctacttcctgctggaggagggcagcaagcccgaggaggtggaccaggtgctggaggagttcggcttcaagatgggccccttcagagtgagcgacctggccggcctggacgtgggctggaagagcagaaagggccagggcctgaccggccccaccctgctgcccggcacccccgccagaaagagaggcaacagaagatactgccccatccccgacgtgctgtgcgagctgggcagattcggccagaagaccggcaagggctggtaccagtacgacaagcccctgggcagaatccacaagcccgacccctggctgagcaagttcctgagcagatacagaaagacccaccacatcgagcccagaaccatcagccaggacgagatcctggagagatgcctgtacagcctgatcaacgaggccttcagaatcctgggcgagggcatcgccgccagccccgagcacatcgacgtggtgtacctgcacggctacggctggcccagacacaagggcggccccatgttctacgccagcaccgtgggcctgcccaccgtgctggagaagctgcagaagtactacagacagaaccccgacatcccccagctggagcccagcgactacctgaagaagctggccagccagggcaacccccccctgaaggagtggcagagcctggccggcagccccagcagcaagctgtag

SEQ ID NO: 7601 - DNA, 1875 bp, Artificial Sequence
  Description of Artificial Sequence: Synthetic coding sequence
atgacccaggccgagaagggcgacaccgagaacggcaaggagaagggcggcgagaaggagaaggagcagagaggcgtgaagagacccatcgtgcccgccctggtgcccgagagcctgcaggagcagatccagagcaacttcatcatcgtgatccaccccggcagcaccaccctgagaatcggcagagccaccgacaccctgcccgccagcatcccccacgtgatcgccagaagacacaagcagcagggccagcccctgtacaaggacagctggctgctgagagagggcctgaacaagcccgagagcaacgagcagagacagaacggcctgaagatggtggaccaggccatctggagcaagaagatgagcaacggcaccagaagaatccccgtgagccccgagcaggccagaagctacaacaagcagatgagacccgccatcctggaccactgcagcggcaacaagtggaccaacaccagccaccaccccgagtacctggtgggcgaggaggccctgtacgtgaaccccctggactgctacaacatccactggcccatcagaagaggccagctgaacatccaccccggccccggcggcagcctgaccgccgtgctggccgacatcgaggtgatctggagccacgccatccagaagtacctggagatccccctgaaggacctgaagtactacagatgcatcctgctgatccccgacatctacaacaagcagcacgtgaaggagctggtgaacatgatcctgatgaagatgggcttcagcggcatcgtggtgcaccaggagagcgtgtgcgccacctacggcagcggcctgagcagcacctgcatcgtggacgtgggcgaccagaagaccagcgtgtgctgcgtggaggacggcgtgagccacagaaacaccagactgtgcctggcctacggcggcagcgacgtgagcagatgcttctactggctgatgcagagagccggcttcccctacagagagtgccagctgaccaacaagatggactgcctgctgctgcagcacctgaaggagaccttctgccacctggaccaggacatcagcggcctgcaggaccacgagttccagatcagacaccccgacagccccgccctgctgtaccagttcagactgggcgacgagaagctgcaggcccccatggccctgttctaccccgccaccttcggcatcgtgggccagaagatgaccaccctgcagcacagaagccagggcgaccccgaggacccccacgacgagcactacctgctggccacccagagcaagcaggagcagagcgccaaggccaccgccgacagaaagagcgccagcaagcccatcggcttcgagggcgacctgagaggccagagcagcgacctgcccgagagactgcacagccaggaggtggacctgggcagcgcccagggcgacggcctgatggccggcaacgacagcgaggaggccctgaccgccctgatgagcagaaagaccgccatcagcctgttcgagggcaaggccctgggcctggacaaggccatcctgcacagcatcgactgctgcagcagcgacgacaccaagaagaagatgtacagcagcatcctggtggtgggcggcggcctgatgttccacaaggcccaggagttcctgcagcacagaatcctgaacaagatgccccccagcttcagaagaatcatcgagaacgtggacgtgatcaccagacccaaggacatggaccccagactgatcgcctggaagggcggcgccgtgctggcctgcctggacaccacccaggagctgtggatctaccagagagagtggcagagattcggcgtgagaatgctgagagagagagccgccttcgtgtggtag

SEQ ID NO: 7602 - DNA, 2364 bp, Artificial Sequence
  Description of Artificial Sequence: Synthetic coding sequence
atggccgccaccaccgccaaccccgagatgaccagcgacgtgcccagcctgggccccgccatcgccagcggcaacagcggccccggcatccagggcggcggcgccatcgtgcagagagccatcaagagaagacccggcctggacttcgacgacgacggcgagggcaacagcaagttcctgagatgcgacgacgaccagatgagcaacgacaaggagagattcgccagaagcgacgacgagcagagcagcgccgacaaggagagactggccagagagaaccacagcgagatcgagagaagaagaagaaacaagatgaccgcctacatcaccgagctgagcgacatggtgcccacctgcagcgccctggccagaaagcccgacaagctgaccatcctgagaatggccgtgagccacatgaagagcctgagaggcaccggcaacaccagcaccgacggcagctacaagcccagcttcctgaccgaccaggagctgaagcacctgatcctggaggccgccgacggcttcctgttcatcgtgagctgcgagaccggcagagtggtgtacgtgagcgacagcgtgacccccgtgctgaaccagccccagagcgagtggttcggcagcaccctgtacgaccaggtgcaccccgacgacgtggacaagctgagagagcagctgagcaccagcgagaacgccctgaccggcagaatcctggacctgaagaccggcaccgtgaagaaggagggccagcagagcagcatgagaatgtgcatgggcagcagaagaagcttcatctgcagaatgagatgcggcagcagcagcgtggaccccgtgagcgtgaacagactgagcttcgtgagaaacagatgcagaaacggcctgggcagcgtgaaggacggcgagccccacttcgtggtggtgcactgcaccggctacatcaaggcctggccccccgccggcgtgagcctgcccgacgacgaccccgaggccggccagggcagcaagttctgcctggtggccatcggcagactgcaggtgaccagcagccccaactgcaccgacatgagcaacgtgtgccagcccaccgagttcatcagcagacacaacatcgagggcatcttcaccttcgtggaccacagatgcgtggccaccgtgggctaccagccccaggagctgctgggcaagaacatcgtggagttctgccaccccgaggaccagcagctgctgagagacagcttccagcaggtggtgaagctgaagggccaggtgctgagcgtgatgttcagattcagaagcaagaaccaggagtggctgtggatgagaaccagcagcttcaccttccagaacccctacagcgacgagatcgagtacatcatctgcaccaacaccaacgtgaagaacagcagccaggagcccagacccaccctgagcaacaccatccagagaccccagctgggccccaccgccaacctgcccctggagatgggcagcggccagctggcccccagacagcagcagcagcagaccgagctggacatggtgcccggcagagacggcctggccagctacaaccacagccaggtggtgcagcccgtgaccaccaccggccccgagcacagcaagcccctggagaagagcgacggcctgttcgcccaggacagagaccccagattcagcgagatctaccacaacatcaacgccgaccagagcaagggcatcagcagcagcaccgtgcccgccacccagcagctgttcagccagggcaacaccttcccccccacccccagacccgccgagaacttcagcggcctggccccccccgtgaccatcgtgcagcccagcgccagcgccggccagatgctggcccagatcagcagacacagcaaccccacccagggcgccacccccacctggacccccaccaccagaagcggcttcagcgcccagcaggtggccacccaggccaccgccaagaccagaaccagccagttcggcgtgggcagcttccagacccccagcagcttcagcagcatgagcctgcccggcgcccccaccgccagccccggcgccgccgcctaccccagcctgaccaacagaggcagcaacttcgcccccgagaccggccagaccgccggccagttccagaccagaaccgccgagggcgtgggcgtgtggccccagtggcagggccagcagccccaccacagaagcagcagcagcgagcagcacgtgcagcagccccccgcccagcagcccggccagcccgaggtgttccaggagatgctgagcatgctgggcgaccagagcaacagctacaacaacgaggagttccccgacctgaccatgttcccccccttcagcgagtag

SEQ ID NO: 7603 - DNA, 2370 bp, Artificial Sequence
  Description of Artificial Sequence: Synthetic coding sequence
atggccgccaccaccgccaaccccgagatgaccagcgacgtgcccagcctgggccccgccatcgccagcggcaacagcggccccggcatccagggcggcggcgccatcgtgcagagagccatcaagagaagacccggcctggacttcgacgacgacggcgagggcaacagcaagttcctgagatgcgacgacgaccagatgagcaacgacaaggagagattcgccagaagcgacgacgagcagagcagcgccgacaaggagagactggccagagagaaccacagcgagatcgagagaagaagaagaaacaagatgaccgcctacatcaccgagctgagcgacatggtgcccacctgcagcgccctggccagaaagcccgacaagctgaccatcctgagaatggccgtgagccacatgaagagcctgagaggcaccggcaacaccagcaccgacggcagctacaagcccagcttcctgaccgaccaggagctgaagcacctgatcctggaggccgccgacggcttcctgttcatcgtgagctgcgagaccggcagagtggtgtacgtgagcgacagcgtgacccccgtgctgaaccagccccagagcgagtggttcggcagcaccctgtacgaccaggtgcaccccgacgacgtggacaagctgagagagcagctgagcaccagcgagaacgccctgaccggcagaatcctggacctgaagaccggcaccgtgaagaaggagggccagcagagcagcatgagaatgtgcatgggcagcagaagaagcttcatctgcagaatgagatgcggcagcagcagcgtggaccccgtgagcgtgaacagactgagcttcgtgagaaacagatgcagaaacggcctgggcagcgtgaaggacggcgagccccacttcgtggtggtgcactgcaccggctacatcaaggcctggccccccgccggcgtgagcctgcccgacgacgaccccgaggccggccagggcagcaagttctgcctggtggccatcggcagactgcaggtgaccagcagccccaactgcaccgacatgagcaacgtgtgccagcccaccgagttcatcagcagacacaacatcgagggcatcttcaccttcgtggaccacagatgcgtggccaccgtgggctaccagccccaggagctgctgggcaagaacatcgtggagttctgccaccccgaggaccagcagctgctgagagacagcttccagcaggtggtgaagctgaagggccaggtgctgagcgtgatgttcagattcagaagcaagaaccaggagtggctgtggatgagaaccagcagcttcaccttccagaacccctacagcgacgagatcgagtacatcatctgcaccaacaccaacgtgaagaacagcagccaggagcccagacccaccctgagcaacaccatccagagaccccagctgggccccaccgccaacctgcccctggagatgggcagcggccagctggcccccagacagcagcagcagcagaccgagctggacatggtgcccggcagagacggcctggccagctacaaccacagccaggtggtgcagcccgtgaccaccaccggccccgagcacagcaagcccctggagaagagcgacggcctgttcgcccaggacagagaccccagattcagcgagatctaccacaacatcaacgccgaccagagcaagggcatcagcagcagcaccgtgcccgccacccagcagctgttcagccagggcaacaccttcccccccacccccagacccgccgagaacttcagaaacagcggcctggccccccccgtgaccatcgtgcagcccagcgccagcgccggccagatgctggcccagatcagcagacacagcaaccccacccagggcgccacccccacctggacccccaccaccagaagcggcttcagcgcccagcaggtggccacccaggccaccgccaagaccagaaccagccagttcggcgtgggcagcttccagacccccagcagcttcagcagcatgagcctgcccggcgcccccaccgccagccccggcgccgccgcctaccccagcctgaccaacagaggcagcaacttcgcccccgagaccggccagaccgccggccagttccagaccagaaccgccgagggcgtgggcgtgtggccccagtggcagggccagcagccccaccacagaagcagcagcagcgagcagcacgtgcagcagccccccgcccagcagcccggccagcccgaggtgttccaggagatgctgagcatgctgggcgaccagagcaacagctacaacaacgaggagttccccgacctgaccatgttcccccccttcagcgagtag

SEQ ID NO: 7604 - DNA, 1767 bp, Artificial Sequence
  Description of Artificial Sequence: Synthetic coding sequence
atggccgccgaggaggaggccgccgccggcggcaaggtgctgagagaggagaaccagtgcatcgcccccgtggtgagcagcagagtgagccccggcaccagacccaccgccatgggcagcttcagcagccacatgaccgagttccccagaaagagaaagggcagcgacagcgaccccagccaggaggcccacagccagaccgagaagagaagaagagacaagatgaacaacctgatcgaggagctgagcgccatgatcccccagtgcaaccccatggccagaaagctggacaagctgaccgtgctgagaatggccgtgcagcacctgagaagcctgaagggcctgaccaacagctacgtgggcagcaactacagacccagcttcctgcaggacaacgagctgagacacctgatcctgaagaccgccgagggcttcctgttcgtggtgggctgcgagagaggcaagatcctgttcgtgagcaagagcgtgagcaagatcctgaactacgaccaggccagcctgaccggccagagcctgttcgacttcctgcaccccaaggacgtggccaaggtgaaggagcagctgagcagcttcgacatcagccccagagagaagctgatcgacgccaagaccggcctgcaggtgcacagcaacctgcacgccggcagaaccagagtgtacagcggcagcagaagaagcttcttctgcagaatcaagagctgcaagatcagcgtgaaggaggagcacggctgcctgcccaacagcaagaagaaggagcacagaaagttctacaccatccactgcaccggctacctgagaagctggccccccaacatcgtgggcatggaggaggagagaaacagcaagaaggacaacagcaacttcacctgcctggtggccatcggcagactgcagccctacatcgtgccccagaacagcggcgagatcaacgtgaagcccaccgagttcatcaccagattcgccgtgaacggcaagttcgtgtacgtggaccagagagccaccgccatcctgggctacctgccccaggagctgctgggcaccagctgctacgagtacttccaccaggacgaccacaacaacctgaccgacaagcacaaggccgtgctgcagagcaaggagaagatcctgaccgacagctacaagttcagagccaaggacggcagcttcgtgaccctgaagagccagtggttcagcttcaccaacccctggaccaaggagctggagtacatcgtgagcgtgaacaccctggtgctgggccacagcgagcccggcgaggccagcttcctgccctgcagcagccagagcagcgaggagagcagcagacagagctgcatgagcgtgcccggcatgagcaccggcaccgtgctgggcgccggcagcatcggcaccgacatcgccaacgagatcctggacctgcagagactgcagagcagcagctacctggacgacagcagccccaccggcctgatgaaggacacccacaccgtgaactgcagaagcatgagcaacaaggagctgttcccccccagccccagcgagatgggcgagctggaggccaccagacagaaccagagcaccgtggccgtgcacagccacgagcccctgctgagcgacggcgcccagctggacttcgacgccctgtgcgacaacgacgacaccgccatggccgccttcatgaactacctggaggccgagggcggcctgggcgaccccggcgacttcagcgacatccagtggaccctgtag

SEQ ID NO: 7605 - DNA, 1911 bp, Artificial Sequence
  Description of Artificial Sequence: Synthetic coding sequence
atggccgccgaggaggaggccgccgccggcggcaaggtgctgagagaggagaaccagtgcatcgcccccgtggtgagcagcagagtgagccccggcaccagacccaccgccatgggcagcttcagcagccacatgaccgagttccccagaaagagaaagggcagcgacagcgaccccagccagagcggcatcatgaccgagaaggtggtggagaagctgagccagaaccccctgacctacctgctgagcaccagaatcgagatcagcgccagcagcggcagcagagtggaggacggcgagcaccaggtgaagatgaaggccttcagagaggcccacagccagaccgagaagagaagaagagacaagatgaacaacctgatcgaggagctgagcgccatgatcccccagtgcaaccccatggccagaaagctggacaagctgaccgtgctgagaatggccgtgcagcacctgagaagcctgaagggcctgaccaacagctacgtgggcagcaactacagacccagcttcctgcaggacaacgagctgagacacctgatcctgaagaccgccgagggcttcctgttcgtggtgggctgcgagagaggcaagatcctgttcgtgagcaagagcgtgagcaagatcctgaactacgaccaggccagcctgaccggccagagcctgttcgacttcctgcaccccaaggacgtggccaaggtgaaggagcagctgagcagcttcgacatcagccccagagagaagctgatcgacgccaagaccggcctgcaggtgcacagcaacctgcacgccggcagaaccagagtgtacagcggcagcagaagaagcttcttctgcagaatcaagagctgcaagatcagcgtgaaggaggagcacggctgcctgcccaacagcaagaagaaggagcacagaaagttctacaccatccactgcaccggctacctgagaagctggccccccaacatcgtgggcatggaggaggagagaaacagcaagaaggacaacagcaacttcacctgcctggtggccatcggcagactgcagccctacatcgtgccccagaacagcggcgagatcaacgtgaagcccaccgagttcatcaccagattcgccgtgaacggcaagttcgtgtacgtggaccagagagccaccgccatcctgggctacctgccccaggagctgctgggcaccagctgctacgagtacttccaccaggacgaccacaacaacctgaccgacaagcacaaggccgtgctgcagagcaaggagaagatcctgaccgacagctacaagttcagagccaaggacggcagcttcgtgaccctgaagagccagtggttcagcttcaccaacccctggaccaaggagctggagtacatcgtgagcgtgaacaccctggtgctgggccacagcgagcccggcgaggccagcttcctgccctgcagcagccagagcagcgaggagagcagcagacagagctgcatgagcgtgcccggcatgagcaccggcaccgtgctgggcgccggcagcatcggcaccgacatcgccaacgagatcctggacctgcagagactgcagagcagcagctacctggacgacagcagccccaccggcctgatgaaggacacccacaccgtgaactgcagaagcatgagcaacaaggagctgttcccccccagccccagcgagatgggcgagctggaggccaccagacagaaccagagcaccgtggccgtgcacagccacgagcccctgctgagcgacggcgcccagctggacttcgacgccctgtgcgacaacgacgacaccgccatggccgccttcatgaactacctggaggccgagggcggcctgggcgaccccggcgacttcagcgacatccagtggaccctgtag

SEQ ID NO: 7606 - DNA, 1869 bp, Artificial Sequence
  Description of Artificial Sequence: Synthetic coding sequence
atggccgccgaggaggaggccgccgccggcggcaaggtgctgagagaggagaaccagtgcatcgcccccgtggtgagcagcagagtgagccccggcaccagacccaccgccatgggcagcttcagcagccacatgaccgagttccccagaaagagaaagggcagcgacagcgaccccagccagagcggcatcatgaccgagaaggtggtggagaagctgagccagaaccccctgacctacctgctgagcaccagaatcgagatcagcgccagcagcggcagcagagaggcccacagccagaccgagaagagaagaagagacaagatgaacaacctgatcgaggagctgagcgccatgatcccccagtgcaaccccatggccagaaagctggacaagctgaccgtgctgagaatggccgtgcagcacctgagaagcctgaagggcctgaccaacagctacgtgggcagcaactacagacccagcttcctgcaggacaacgagctgagacacctgatcctgaagaccgccgagggcttcctgttcgtggtgggctgcgagagaggcaagatcctgttcgtgagcaagagcgtgagcaagatcctgaactacgaccaggccagcctgaccggccagagcctgttcgacttcctgcaccccaaggacgtggccaaggtgaaggagcagctgagcagcttcgacatcagccccagagagaagctgatcgacgccaagaccggcctgcaggtgcacagcaacctgcacgccggcagaaccagagtgtacagcggcagcagaagaagcttcttctgcagaatcaagagctgcaagatcagcgtgaaggaggagcacggctgcctgcccaacagcaagaagaaggagcacagaaagttctacaccatccactgcaccggctacctgagaagctggccccccaacatcgtgggcatggaggaggagagaaacagcaagaaggacaacagcaacttcacctgcctggtggccatcggcagactgcagccctacatcgtgccccagaacagcggcgagatcaacgtgaagcccaccgagttcatcaccagattcgccgtgaacggcaagttcgtgtacgtggaccagagagccaccgccatcctgggctacctgccccaggagctgctgggcaccagctgctacgagtacttccaccaggacgaccacaacaacctgaccgacaagcacaaggccgtgctgcagagcaaggagaagatcctgaccgacagctacaagttcagagccaaggacggcagcttcgtgaccctgaagagccagtggttcagcttcaccaacccctggaccaaggagctggagtacatcgtgagcgtgaacaccctggtgctgggccacagcgagcccggcgaggccagcttcctgccctgcagcagccagagcagcgaggagagcagcagacagagctgcatgagcgtgcccggcatgagcaccggcaccgtgctgggcgccggcagcatcggcaccgacatcgccaacgagatcctggacctgcagagactgcagagcagcagctacctggacgacagcagccccaccggcctgatgaaggacacccacaccgtgaactgcagaagcatgagcaacaaggagctgttcccccccagccccagcgagatgggcgagctggaggccaccagacagaaccagagcaccgtggccgtgcacagccacgagcccctgctgagcgacggcgcccagctggacttcgacgccctgtgcgacaacgacgacaccgccatggccgccttcatgaactacctggaggccgagggcggcctgggcgaccccggcgacttcagcgacatccagtggaccctgtag

SEQ ID NO: 7607 - DNA, 1800 bp, Artificial Sequence
  Description of Artificial Sequence: Synthetic coding sequence
atggccgccgaggaggaggccgccgccggcggcgaggtggccggcggcgaggccaccgcccccggcaaggtgctgagagaggagaaccagtgcatcgcccccgtggtgagcagcagagtgagccccggcaccagacccaccgccatgggcagcttcagcagccacatgaccgagttccccagaaagagaaagggcagcgacagcgaccccagccaggaggcccacagccagaccgagaagagaagaagagacaagatgaacaacctgatcgaggagctgagcgccatgatcccccagtgcaaccccatggccagaaagctggacaagctgaccgtgctgagaatggccgtgcagcacctgagaagcctgaagggcctgaccaacagctacgtgggcagcaactacagacccagcttcctgcaggacaacgagctgagacacctgatcctgaagaccgccgagggcttcctgttcgtggtgggctgcgagagaggcaagatcctgttcgtgagcaagagcgtgagcaagatcctgaactacgaccaggccagcctgaccggccagagcctgttcgacttcctgcaccccaaggacgtggccaaggtgaaggagcagctgagcagcttcgacatcagccccagagagaagctgatcgacgccaagaccggcctgcaggtgcacagcaacctgcacgccggcagaaccagagtgtacagcggcagcagaagaagcttcttctgcagaatcaagagctgcaagatcagcgtgaaggaggagcacggctgcctgcccaacagcaagaagaaggagcacagaaagttctacaccatccactgcaccggctacctgagaagctggccccccaacatcgtgggcatggaggaggagagaaacagcaagaaggacaacagcaacttcacctgcctggtggccatcggcagactgcagccctacatcgtgccccagaacagcggcgagatcaacgtgaagcccaccgagttcatcaccagattcgccgtgaacggcaagttcgtgtacgtggaccagagagccaccgccatcctgggctacctgccccaggagctgctgggcaccagctgctacgagtacttccaccaggacgaccacaacaacctgaccgacaagcacaaggccgtgctgcagagcaaggagaagatcctgaccgacagctacaagttcagagccaaggacggcagcttcgtgaccctgaagagccagtggttcagcttcaccaacccctggaccaaggagctggagtacatcgtgagcgtgaacaccctggtgctgggccacagcgagcccggcgaggccagcttcctgccctgcagcagccagagcagcgaggagagcagcagacagagctgcatgagcgtgcccggcatgagcaccggcaccgtgctgggcgccggcagcatcggcaccgacatcgccaacgagatcctggacctgcagagactgcagagcagcagctacctggacgacagcagccccaccggcctgatgaaggacacccacaccgtgaactgcagaagcatgagcaacaaggagctgttcccccccagccccagcgagatgggcgagctggaggccaccagacagaaccagagcaccgtggccgtgcacagccacgagcccctgctgagcgacggcgcccagctggacttcgacgccctgtgcgacaacgacgacaccgccatggccgccttcatgaactacctggaggccgagggcggcctgggcgaccccggcgacttcagcgacatccagtggaccctgtag

SEQ ID NO: 7608 - DNA, 1656 bp, Artificial Sequence
  Description of Artificial Sequence: Synthetic coding sequence
atgggcagcttcagcagccacatgaccgagttccccagaaagagaaagggcagcgacagcgaccccagccaggaggcccacagccagaccgagaagagaagaagagacaagatgaacaacctgatcgaggagctgagcgccatgatcccccagtgcaaccccatggccagaaagctggacaagctgaccgtgctgagaatggccgtgcagcacctgagaagcctgaagggcctgaccaacagctacgtgggcagcaactacagacccagcttcctgcaggacaacgagctgagacacctgatcctgaagaccgccgagggcttcctgttcgtggtgggctgcgagagaggcaagatcctgttcgtgagcaagagcgtgagcaagatcctgaactacgaccaggccagcctgaccggccagagcctgttcgacttcctgcaccccaaggacgtggccaaggtgaaggagcagctgagcagcttcgacatcagccccagagagaagctgatcgacgccaagaccggcctgcaggtgcacagcaacctgcacgccggcagaaccagagtgtacagcggcagcagaagaagcttcttctgcagaatcaagagctgcaagatcagcgtgaaggaggagcacggctgcctgcccaacagcaagaagaaggagcacagaaagttctacaccatccactgcaccggctacctgagaagctggccccccaacatcgtgggcatggaggaggagagaaacagcaagaaggacaacagcaacttcacctgcctggtggccatcggcagactgcagccctacatcgtgccccagaacagcggcgagatcaacgtgaagcccaccgagttcatcaccagattcgccgtgaacggcaagttcgtgtacgtggaccagagagccaccgccatcctgggctacctgccccaggagctgctgggcaccagctgctacgagtacttccaccaggacgaccacaacaacctgaccgacaagcacaaggccgtgctgcagagcaaggagaagatcctgaccgacagctacaagttcagagccaaggacggcagcttcgtgaccctgaagagccagtggttcagcttcaccaacccctggaccaaggagctggagtacatcgtgagcgtgaacaccctggtgctgggccacagcgagcccggcgaggccagcttcctgccctgcagcagccagagcagcgaggagagcagcagacagagctgcatgagcgtgcccggcatgagcaccggcaccgtgctgggcgccggcagcatcggcaccgacatcgccaacgagatcctggacctgcagagactgcagagcagcagctacctggacgacagcagccccaccggcctgatgaaggacacccacaccgtgaactgcagaagcatgagcaacaaggagctgttcccccccagccccagcgagatgggcgagctggaggccaccagacagaaccagagcaccgtggccgtgcacagccacgagcccctgctgagcgacggcgcccagctggacttcgacgccctgtgcgacaacgacgacaccgccatggccgccttcatgaactacctggaggccgagggcggcctgggcgaccccggcgacttcagcgacatccagtggaccctgtag

SEQ ID NO: 7609 - DNA, 1809 bp, Artificial Sequence
  Description of Artificial Sequence: Synthetic coding sequence
atggccgccgaggaggaggccgccgccggcggcaaggtgctgagagaggagaaccagtgcatcgcccccgtggtgagcagcagagtgagccccggcaccagacccaccgccatgggcagcttcagcagccacatgaccgagttccccagaaagagaaagggcagcgacagcgaccccagccaggtggaggacggcgagcaccaggtgaagatgaaggccttcagagaggcccacagccagaccgagaagagaagaagagacaagatgaacaacctgatcgaggagctgagcgccatgatcccccagtgcaaccccatggccagaaagctggacaagctgaccgtgctgagaatggccgtgcagcacctgagaagcctgaagggcctgaccaacagctacgtgggcagcaactacagacccagcttcctgcaggacaacgagctgagacacctgatcctgaagaccgccgagggcttcctgttcgtggtgggctgcgagagaggcaagatcctgttcgtgagcaagagcgtgagcaagatcctgaactacgaccaggccagcctgaccggccagagcctgttcgacttcctgcaccccaaggacgtggccaaggtgaaggagcagctgagcagcttcgacatcagccccagagagaagctgatcgacgccaagaccggcctgcaggtgcacagcaacctgcacgccggcagaaccagagtgtacagcggcagcagaagaagcttcttctgcagaatcaagagctgcaagatcagcgtgaaggaggagcacggctgcctgcccaacagcaagaagaaggagcacagaaagttctacaccatccactgcaccggctacctgagaagctggccccccaacatcgtgggcatggaggaggagagaaacagcaagaaggacaacagcaacttcacctgcctggtggccatcggcagactgcagccctacatcgtgccccagaacagcggcgagatcaacgtgaagcccaccgagttcatcaccagattcgccgtgaacggcaagttcgtgtacgtggaccagagagccaccgccatcctgggctacctgccccaggagctgctgggcaccagctgctacgagtacttccaccaggacgaccacaacaacctgaccgacaagcacaaggccgtgctgcagagcaaggagaagatcctgaccgacagctacaagttcagagccaaggacggcagcttcgtgaccctgaagagccagtggttcagcttcaccaacccctggaccaaggagctggagtacatcgtgagcgtgaacaccctggtgctgggccacagcgagcccggcgaggccagcttcctgccctgcagcagccagagcagcgaggagagcagcagacagagctgcatgagcgtgcccggcatgagcaccggcaccgtgctgggcgccggcagcatcggcaccgacatcgccaacgagatcctggacctgcagagactgcagagcagcagctacctggacgacagcagccccaccggcctgatgaaggacacccacaccgtgaactgcagaagcatgagcaacaaggagctgttcccccccagccccagcgagatgggcgagctggaggccaccagacagaaccagagcaccgtggccgtgcacagccacgagcccctgctgagcgacggcgcccagctggacttcgacgccctgtgcgacaacgacgacaccgccatggccgccttcatgaactacctggaggccgagggcggcctgggcgaccccggcgacttcagcgacatccagtggaccctgtag

SEQ ID NO: 7610 - DNA, 6858 bp, Artificial Sequence
  Description of Artificial Sequence: Synthetic coding sequence
atggccgcccaggtggcccccgccgccgccagcagcctgggcaacccccccccccccccccccagcgagctgaagaaggccgagcagcagcagagagaggaggccggcggcgaggccgccgccgccgccgccgccgagagaggcgagatgaaggccgccgccggccaggagagcgagggccccgccgtgggccccccccagcccctgggcaaggagctgcaggacggcgccgagagcaacggcggcggcggcggcggcggcgccggcagcggcggcggccccggcgccgagcccgacctgaagaacagcaacggcaacgccggccccagacccgccctgaacaacaacctgaccgagccccccggcggcggcggcggcggcagcagcgacggcgtgggcgcccccccccacagcgccgccgccgccctgcccccccccgcctacggcttcggccagccctacggcagaagccccagcgccgtggccgccgccgccgccgccgtgttccaccagcagcacggcggccagcagagccccggcctggccgccctgcagagcggcggcggcggcggcctggagccctacgccggcccccagcagaacagccacgaccacggcttccccaaccaccagtacaacagctactaccccaacagaagcgcctaccccccccccgcccccgcctacgccctgagcagccccagaggcggcacccccggcagcggcgccgccgccgccgccggcagcaagcccccccccagcagcagcgccagcgccagcagcagcagcagcagcttcgcccagcagagattcggcgccatgggcggcggcggccccagcgccgccggcggcggcaccccccagcccaccgccacccccaccctgaaccagctgctgaccagccccagcagcgccagaggctaccagggctaccccggcggcgactacagcggcggcccccaggacggcggcgccggcaagggccccgccgacatggccagccagtgctggggcgccgccgccgccgccgccgccgccgccgccgccagcggcggcgcccagcagagaagccaccacgcccccatgagccccggcagcagcggcggcggcggccagcccctggccagaaccccccagcccagcagccccatggaccagatgggcaagatgagaccccagccctacggcggcaccaacccctacagccagcagcagggcccccccagcggcccccagcagggccacggctaccccggccagccctacggcagccagaccccccagagataccccatgaccatgcagggcagagcccagagcgccatgggcggcctgagctacacccagcagatccccccctacggccagcagggccccagcggctacggccagcagggccagaccccctactacaaccagcagagcccccacccccagcagcagcagcccccctacagccagcagccccccagccagaccccccacgcccagcccagctaccagcagcagccccagagccagcccccccagctgcagagcagccagcccccctacagccagcagcccagccagcccccccaccagcagagccccgccccctaccccagccagcagagcaccacccagcagcacccccagagccagcccccctacagccagccccaggcccagagcccctaccagcagcagcagccccagcagcccgcccccagcaccctgagccagcaggccgcctacccccagccccagagccagcagagccagcagaccgcctacagccagcagagattcccccccccccaggagctgagccaggacagcttcggcagccaggccagcagcgcccccagcatgaccagcagcaagggcggccaggaggacatgaacctgagcctgcagagcagacccagcagcctgcccgacctgagcggcagcatcgacgacctgcccatgggcaccgagggcgccctgagccccggcgtgagcaccagcggcatcagcagcagccagggcgagcagagcaaccccgcccagagccccttcagcccccacaccagcccccacctgcccggcatcagaggccccagccccagccccgtgggcagccccgccagcgtggcccagagcagaagcggccccctgagccccgccgccgtgcccggcaaccagatgccccccagaccccccagcggccagagcgacagcatcatgcaccccagcatgaaccagagcagcatcgcccaggacagaggctacatgcagagaaacccccagatgccccagtacagcagcccccagcccggcagcgccctgagccccagacagcccagcggcggccagatccacaccggcatgggcagctaccagcagaacagcatgggcagctacggcccccagggcggccagtacggcccccagggcggctaccccagacagcccaactacaacgccctgcccaacgccaactaccccagcgccggcatggccggcggcatcaaccccatgggcgccggcggccagatgcacggccagcccggcatccccccctacggcaccctgccccccggcagaatgagccacgccagcatgggcaacagaccctacggccccaacatggccaacatgcccccccaggtgggcagcggcatgtgccccccccccggcggcatgaacagaaagacccaggagaccgccgtggccatgcacgtggccgccaacagcatccagaacagaccccccggctaccccaacatgaaccagggcggcatgatgggcaccggccccccctacggccagggcatcaacagcatggccggcatgatcaacccccagggccccccctacagcatgggcggcaccatggccaacaacagcgccggcatggccgccagccccgagatgatgggcctgggcgacgtgaagctgacccccgccaccaagatgaacaacaaggccgacggcacccccaagaccgagagcaagagcaagaagagcagcagcagcaccaccaccaacgagaagatcaccaagctgtacgagctgggcggcgagcccgagagaaagatgtgggtggacagatacctggccttcaccgaggagaaggccatgggcatgaccaacctgcccgccgtgggcagaaagcccctggacctgtacagactgtacgtgagcgtgaaggagatcggcggcctgacccaggtgaacaagaacaagaagtggagagagctggccaccaacctgaacgtgggcaccagcagcagcgccgccagcagcctgaagaagcagtacatccagtgcctgtacgccttcgagtgcaagatcgagagaggcgaggaccccccccccgacatcttcgccgccgccgacagcaagaagagccagcccaagatccagccccccagccccgccggcagcggcagcatgcagggcccccagaccccccagagcaccagcagcagcatggccgagggcggcgacctgaagccccccacccccgccagcaccccccacagccagatcccccccctgcccggcatgagcagaagcaacagcgtgggcatccaggacgccttcaacgacggcagcgacagcaccttccagaagagaaacagcatgacccccaaccccggctaccagcccagcatgaacaccagcgacatgatgggcagaatgagctacgagcccaacaaggacccctacggcagcatgagaaaggcccccggcagcgaccccttcatgagcagcggccagggccccaacggcggcatgggcgacccctacagcagagccgccggccccggcctgggcaacgtggccatgggccccagacagcactacccctacggcggcccctacgacagagtgagaaccgagcccggcatcggccccgagggcaacatgagcaccggcgccccccagcccaacctgatgcccagcaaccccgacagcggcatgtacagccccagcagataccccccccagcagcagcagcagcagcagcagagacacgacagctacggcaaccagttcagcacccagggcacccccagcggcagccccttccccagccagcagaccaccatgtaccagcagcagcagcagaactacaagagacccatggacggcacctacggcccccccgccaagagacacgagggcgagatgtacagcgtgccctacagcaccggccagggccagccccagcagcagcagctgccccccgcccagccccagcccgccagccagcagcaggccgcccagcccagcccccagcaggacgtgtacaaccagtacggcaacgcctaccccgccaccgccaccgccgccaccgagagaagacccgccggcggcccccagaaccagttccccttccagttcggcagagacagagtgagcgccccccccggcaccaacgcccagcagaacatgcccccccagatgatgggcggccccatccaggccagcgccgaggtggcccagcagggcaccatgtggcagggcagaaacgacatgacctacaactacgccaacagacagagcaccggcagcgccccccagggccccgcctaccacggcgtgaacagaaccgacgagatgctgcacaccgaccagagagccaaccacgagggcagctggcccagccacggcaccagacagcccccctacggccccagcgcccccgtgccccccatgaccagacccccccccagcaactaccagcccccccccagcatgcagaaccacatcccccaggtgagcagccccgcccccctgcccagacccatggagaacagaaccagccccagcaagagccccttcctgcacagcggcatgaagatgcagaaggccggcccccccgtgcccgccagccacatcgcccccgcccccgtgcagccccccatgatcagaagagacatcaccttcccccccggcagcgtggaggccacccagcccgtgctgaagcagagaagaagactgaccatgaaggacatcggcacccccgaggcctggagagtgatgatgagcctgaagagcggcctgctggccgagagcacctgggccctggacaccatcaacatcctgctgtacgacgacaacagcatcatgaccttcaacctgagccagctgcccggcctgctggagctgctggtggagtacttcagaagatgcctgatcgagatcttcggcatcctgaaggagtacgaggtgggcgaccccggccagagaaccctgctggaccccggcagattcagcaaggtgagcagccccgcccccatggagggcggcgaggaggaggaggagctgctgggccccaagctggaggaggaggaggaggaggaggtggtggagaacgacgaggagatcgccttcagcggcaaggacaagcccgccagcgagaacagcgaggagaagctgatcagcaagttcgacaagctgcccgtgaagatcgtgcagaagaacgaccccttcgtggtggactgcagcgacaagctgggcagagtgcaggagttcgacagcggcctgctgcactggagaatcggcggcggcgacaccaccgagcacatccagacccacttcgagagcaagaccgagctgctgcccagcagaccccacgccccctgcccccccgcccccagaaagcacgtgaccaccgccgagggcacccccggcaccaccgaccaggagggccccccccccgacggcccccccgagaagagaatcaccgccaccatggacgacatgctgagcaccagaagcagcaccctgaccgaggacggcgccaagagcagcgaggccatcaaggagagcagcaagttccccttcggcatcagccccgcccagagccacagaaacatcaagatcctggaggacgagccccacagcaaggacgagacccccctgtgcaccctgctggactggcaggacagcctggccaagagatgcgtgtgcgtgagcaacaccatcagaagcctgagcttcgtgcccggcaacgacttcgagatgagcaagcaccccggcctgctgctgatcctgggcaagctgatcctgctgcaccacaagcaccccgagagaaagcaggcccccctgacctacgagaaggaggaggagcaggaccagggcgtgagctgcaacaaggtggagtggtggtgggactgcctggagatgctgagagagaacaccctggtgaccctggccaacatcagcggccagctggacctgagcccctaccccgagagcatctgcctgcccgtgctggacggcctgctgcactgggccgtgtgccccagcgccgaggcccaggaccccttcagcaccctgggccccaacgccgtgctgagcccccagagactggtgctggagaccctgagcaagctgagcatccaggacaacaacgtggacctgatcctggccaccccccccttcagcagactggagaagctgtacagcaccatggtgagattcctgagcgacagaaagaaccccgtgtgcagagagatggccgtggtgctgctggccaacctggcccagggcgacagcctggccgccagagccatcgccgtgcagaagggcagcatcggcaacctgctgggcttcctggaggacagcctggccgccacccagttccagcagagccaggccagcctgctgcacatgcagaacccccccttcgagcccaccagcgtggacatgatgagaagagccgccagagccctgctggccctggccaaggtggacgagaaccacagcgagttcaccctgtacgagagcagactgctggacatcagcgtgagccccctgatgaacagcctggtgagccaggtgatctgcgacgtgctgttcctgatcggccagagctag

SEQ ID NO: 7611 - DNA, 5709 bp, Artificial Sequence
  Description of Artificial Sequence: Synthetic coding sequence
atggaccagatgggcaagatgagaccccagccctacggcggcaccaacccctacagccagcagcagggcccccccagcggcccccagcagggccacggctaccccggccagccctacggcagccagaccccccagagataccccatgaccatgcagggcagagcccagagcgccatgggcggcctgagctacacccagcagatccccccctacggccagcagggccccagcggctacggccagcagggccagaccccctactacaaccagcagagcccccacccccagcagcagcagcccccctacagccagcagccccccagccagaccccccacgcccagcccagctaccagcagcagccccagagccagcccccccagctgcagagcagccagcccccctacagccagcagcccagccagcccccccaccagcagagccccgccccctaccccagccagcagagcaccacccagcagcacccccagagccagcccccctacagccagccccaggcccagagcccctaccagcagcagcagccccagcagcccgcccccagcaccctgagccagcaggccgcctacccccagccccagagccagcagagccagcagaccgcctacagccagcagagattcccccccccccaggagctgagccaggacagcttcggcagccaggccagcagcgcccccagcatgaccagcagcaagggcggccaggaggacatgaacctgagcctgcagagcagacccagcagcctgcccgacctgagcggcagcatcgacgacctgcccatgggcaccgagggcgccctgagccccggcgtgagcaccagcggcatcagcagcagccagggcgagcagagcaaccccgcccagagccccttcagcccccacaccagcccccacctgcccggcatcagaggccccagccccagccccgtgggcagccccgccagcgtggcccagagcagaagcggccccctgagccccgccgccgtgcccggcaaccagatgccccccagaccccccagcggccagagcgacagcatcatgcaccccagcatgaaccagagcagcatcgcccaggacagaggctacatgcagagaaacccccagatgccccagtacagcagcccccagcccggcagcgccctgagccccagacagcccagcggcggccagatccacaccggcatgggcagctaccagcagaacagcatgggcagctacggcccccagggcggccagtacggcccccagggcggctaccccagacagcccaactacaacgccctgcccaacgccaactaccccagcgccggcatggccggcggcatcaaccccatgggcgccggcggccagatgcacggccagcccggcatccccccctacggcaccctgccccccggcagaatgagccacgccagcatgggcaacagaccctacggccccaacatggccaacatgcccccccaggtgggcagcggcatgtgccccccccccggcggcatgaacagaaagacccaggagaccgccgtggccatgcacgtggccgccaacagcatccagaacagaccccccggctaccccaacatgaaccagggcggcatgatgggcaccggccccccctacggccagggcatcaacagcatggccggcatgatcaacccccagggccccccctacagcatgggcggcaccatggccaacaacagcgccggcatggccgccagccccgagatgatgggcctgggcgacgtgaagctgacccccgccaccaagatgaacaacaaggccgacggcacccccaagaccgagagcaagagcaagaagagcagcagcagcaccaccaccaacgagaagatcaccaagctgtacgagctgggcggcgagcccgagagaaagatgtgggtggacagatacctggccttcaccgaggagaaggccatgggcatgaccaacctgcccgccgtgggcagaaagcccctggacctgtacagactgtacgtgagcgtgaaggagatcggcggcctgacccaggtgaacaagaacaagaagtggagagagctggccaccaacctgaacgtgggcaccagcagcagcgccgccagcagcctgaagaagcagtacatccagtgcctgtacgccttcgagtgcaagatcgagagaggcgaggaccccccccccgacatcttcgccgccgccgacagcaagaagagccagcccaagatccagccccccagccccgccggcagcggcagcatgcagggcccccagaccccccagagcaccagcagcagcatggccgagggcggcgacctgaagccccccacccccgccagcaccccccacagccagatcccccccctgcccggcatgagcagaagcaacagcgtgggcatccaggacgccttcaacgacggcagcgacagcaccttccagaagagaaacagcatgacccccaaccccggctaccagcccagcatgaacaccagcgacatgatgggcagaatgagctacgagcccaacaaggacccctacggcagcatgagaaaggcccccggcagcgaccccttcatgagcagcggccagggccccaacggcggcatgggcgacccctacagcagagccgccggccccggcctgggcaacgtggccatgggccccagacagcactacccctacggcggcccctacgacagagtgagaaccgagcccggcatcggccccgagggcaacatgagcaccggcgccccccagcccaacctgatgcccagcaaccccgacagcggcatgtacagccccagcagataccccccccagcagcagcagcagcagcagcagagacacgacagctacggcaaccagttcagcacccagggcacccccagcggcagccccttccccagccagcagaccaccatgtaccagcagcagcagcagaactacaagagacccatggacggcacctacggcccccccgccaagagacacgagggcgagatgtacagcgtgccctacagcaccggccagggccagccccagcagcagcagctgccccccgcccagccccagcccgccagccagcagcaggccgcccagcccagcccccagcaggacgtgtacaaccagtacggcaacgcctaccccgccaccgccaccgccgccaccgagagaagacccgccggcggcccccagaaccagttccccttccagttcggcagagacagagtgagcgccccccccggcaccaacgcccagcagaacatgcccccccagatgatgggcggccccatccaggccagcgccgaggtggcccagcagggcaccatgtggcagggcagaaacgacatgacctacaactacgccaacagacagagcaccggcagcgccccccagggccccgcctaccacggcgtgaacagaaccgacgagatgctgcacaccgaccagagagccaaccacgagggcagctggcccagccacggcaccagacagcccccctacggccccagcgcccccgtgccccccatgaccagacccccccccagcaactaccagcccccccccagcatgcagaaccacatcccccaggtgagcagccccgcccccctgcccagacccatggagaacagaaccagccccagcaagagccccttcctgcacagcggcatgaagatgcagaaggccggcccccccgtgcccgccagccacatcgcccccgcccccgtgcagccccccatgatcagaagagacatcaccttcccccccggcagcgtggaggccacccagcccgtgctgaagcagagaagaagactgaccatgaaggacatcggcacccccgaggcctggagagtgatgatgagcctgaagagcggcctgctggccgagagcacctgggccctggacaccatcaacatcctgctgtacgacgacaacagcatcatgaccttcaacctgagccagctgcccggcctgctggagctgctggtggagtacttcagaagatgcctgatcgagatcttcggcatcctgaaggagtacgaggtgggcgaccccggccagagaaccctgctggaccccggcagattcagcaaggtgagcagccccgcccccatggagggcggcgaggaggaggaggagctgctgggccccaagctggaggaggaggaggaggaggaggtggtggagaacgacgaggagatcgccttcagcggcaaggacaagcccgccagcgagaacagcgaggagaagctgatcagcaagttcgacaagctgcccgtgaagatcgtgcagaagaacgaccccttcgtggtggactgcagcgacaagctgggcagagtgcaggagttcgacagcggcctgctgcactggagaatcggcggcggcgacaccaccgagcacatccagacccacttcgagagcaagaccgagctgctgcccagcagaccccacgccccctgcccccccgcccccagaaagcacgtgaccaccgccgagggcacccccggcaccaccgaccaggagggccccccccccgacggcccccccgagaagagaatcaccgccaccatggacgacatgctgagcaccagaagcagcaccctgaccgaggacggcgccaagagcagcgaggccatcaaggagagcagcaagttccccttcggcatcagccccgcccagagccacagaaacatcaagatcctggaggacgagccccacagcaaggacgagacccccctgtgcaccctgctggactggcaggacagcctggccaagagatgcgtgtgcgtgagcaacaccatcagaagcctgagcttcgtgcccggcaacgacttcgagatgagcaagcaccccggcctgctgctgatcctgggcaagctgatcctgctgcaccacaagcaccccgagagaaagcaggcccccctgacctacgagaaggaggaggagcaggaccagggcgtgagctgcaacaaggtggagtggtggtgggactgcctggagatgctgagagagaacaccctggtgaccctggccaacatcagcggccagctggacctgagcccctaccccgagagcatctgcctgcccgtgctggacggcctgctgcactgggccgtgtgccccagcgccgaggcccaggaccccttcagcaccctgggccccaacgccgtgctgagcccccagagactggtgctggagaccctgagcaagctgagcatccaggacaacaacgtggacctgatcctggccaccccccccttcagcagactggagaagctgtacagcaccatggtgagattcctgagcgacagaaagaaccccgtgtgcagagagatggccgtggtgctgctggccaacctggcccagggcgacagcctggccgccagagccatcgccgtgcagaagggcagcatcggcaacctgctgggcttcctggaggacagcctggccgccacccagttccagcagagccaggccagcctgctgcacatgcagaacccccccttcgagcccaccagcgtggacatgatgagaagagccgccagagccctgctggccctggccaaggtggacgagaaccacagcgagttcaccctgtacgagagcagactgctggacatcagcgtgagccccctgatgaacagcctggtgagccaggtgatctgcgacgtgctgttcctgatcggccagagctag

SEQ ID NO: 7612 - DNA, 6207 bp, Artificial Sequence
  Description of Artificial Sequence: Synthetic coding sequence
atggccgcccaggtggcccccgccgccgccagcagcctgggcaacccccccccccccccccccagcgagctgaagaaggccgagcagcagcagagagaggaggccggcggcgaggccgccgccgccgccgccgccgagagaggcgagatgaaggccgccgccggccaggagagcgagggccccgccgtgggccccccccagcccctgggcaaggagctgcaggacggcgccgagagcaacggcggcggcggcggcggcggcgccggcagcggcggcggccccggcgccgagcccgacctgaagaacagcaacggcaacgccggccccagacccgccctgaacaacaacctgaccgagccccccggcggcggcggcggcggcagcagcgacggcgtgggcgcccccccccacagcgccgccgccgccctgcccccccccgcctacggcttcggccagccctacggcagaagccccagcgccgtggccgccgccgccgccgccgtgttccaccagcagcacggcggccagcagagccccggcctggccgccctgcagagcggcggcggcggcggcctggagccctacgccggcccccagcagaacagccacgaccacggcttccccaaccaccagtacaacagctactaccccaacagaagcgcctaccccccccccgcccccgcctacgccctgagcagccccagaggcggcacccccggcagcggcgccgccgccgccgccggcagcaagcccccccccagcagcagcgccagcgccagcagcagcagcagcagcttcgcccagcagagattcggcgccatgggcggcggcggccccagcgccgccggcggcggcaccccccagcccaccgccacccccaccctgaaccagctgctgaccagccccagcagcgccagaggctaccagggctaccccggcggcgactacagcggcggcccccaggacggcggcgccggcaagggccccgccgacatggccagccagtgctggggcgccgccgccgccgccgccgccgccgccgccgccagcggcggcgcccagcagagaagccaccacgcccccatgagccccggcagcagcggcggcggcggccagcccctggccagaaccccccagcccagcagccccatggaccagatgggcaagatgagaccccagccctacggcggcaccaacccctacagccagcagcagggcccccccagcggcccccagcagggccacggctaccccggccagccctacggcagccagaccccccagagataccccatgaccatgcagggcagagcccagagcgccatgggcggcctgagctacacccagcagatccccccctacggccagcagggccccagcggctacggccagcagggccagaccccctactacaaccagcagagcccccacccccagcagcagcagcccccctacagccagcagccccccagccagaccccccacgcccagcccagctaccagcagcagccccagagccagcccccccagctgcagagcagccagcccccctacagccagcagcccagccagcccccccaccagcagagccccgccccctaccccagccagcagagcaccacccagcagcacccccagagccagcccccctacagccagccccaggcccagagcccctaccagcagcagcagccccagcagcccgcccccagcaccctgagccagcaggccgcctacccccagccccagagccagcagagccagcagaccgcctacagccagcagagattcccccccccccaggagctgagccaggacagcttcggcagccaggccagcagcgcccccagcatgaccagcagcaagggcggccaggaggacatgaacctgagcctgcagagcagacccagcagcctgcccgacctgagcggcagcatcgacgacctgcccatgggcaccgagggcgccctgagccccggcgtgagcaccagcggcatcagcagcagccagggcgagcagagcaaccccgcccagagccccttcagcccccacaccagcccccacctgcccggcatcagaggccccagccccagccccgtgggcagccccgccagcgtggcccagagcagaagcggccccctgagccccgccgccgtgcccggcaaccagatgccccccagaccccccagcggccagagcgacagcatcatgcaccccagcatgaaccagagcagcatcgcccaggacagaggctacatgcagagaaacccccagatgccccagtacagcagcccccagcccggcagcgccctgagccccagacagcccagcggcggccagatccacaccggcatgggcagctaccagcagaacagcatgggcagctacggcccccagggcggccagtacggcccccagggcggctaccccagacagcccaactacaacgccctgcccaacgccaactaccccagcgccggcatggccggcggcatcaaccccatgggcgccggcggccagatgcacggccagcccggcatccccccctacggcaccctgccccccggcagaatgagccacgccagcatgggcaacagaccctacggccccaacatggccaacatgcccccccaggtgggcagcggcatgtgccccccccccggcggcatgaacagaaagacccaggagaccgccgtggccatgcacgtggccgccaacagcatccagaacagaccccccggctaccccaacatgaaccagggcggcatgatgggcaccggccccccctacggccagggcatcaacagcatggccggcatgatcaacccccagggccccccctacagcatgggcggcaccatggccaacaacagcgccggcatggccgccagccccgagatgatgggcctgggcgacgtgaagctgacccccgccaccaagatgaacaacaaggccgacggcacccccaagaccgagagcaagagcaagaagagcagcagcagcaccaccaccaacgagaagatcaccaagctgtacgagctgggcggcgagcccgagagaaagatgtgggtggacagatacctggccttcaccgaggagaaggccatgggcatgaccaacctgcccgccgtgggcagaaagcccctggacctgtacagactgtacgtgagcgtgaaggagatcggcggcctgacccaggtgaacaagaacaagaagtggagagagctggccaccaacctgaacgtgggcaccagcagcagcgccgccagcagcctgaagaagcagtacatccagtgcctgtacgccttcgagtgcaagatcgagagaggcgaggaccccccccccgacatcttcgccgccgccgacagcaagaagagccagcccaagatccagccccccagccccgccggcagcggcagcatgcagggcccccagaccccccagagcaccagcagcagcatggccgagggcggcgacctgaagccccccacccccgccagcaccccccacagccagatcccccccctgcccggcatgagcagaagcaacagcgtgggcatccaggacgccttcaacgacggcagcgacagcaccttccagaagagaaacagcatgacccccaaccccggctaccagcccagcatgaacaccagcgacatgatgggcagaatgagctacgagcccaacaaggacccctacggcagcatgagaaaggcccccggcagcgaccccttcatgagcagcggccagggccccaacggcggcatgggcgacccctacagcagagccgccggccccggcctgggcaacgtggccatgggccccagacagcactacccctacggcggcccctacgacagagtgagaaccgagcccggcatcggccccgagggcaacatgagcaccggcgccccccagcccaacctgatgcccagcaaccccgacagcggcatgtacagccccagcagataccccccccagcagcagcagcagcagcagcagagacacgacagctacggcaaccagttcagcacccagggcacccccagcggcagccccttccccagccagcagaccaccatgtaccagcagcagcagcaggtgagcagccccgcccccctgcccagacccatggagaacagaaccagccccagcaagagccccttcctgcacagcggcatgaagatgcagaaggccggcccccccgtgcccgccagccacatcgcccccgcccccgtgcagccccccatgatcagaagagacatcaccttcccccccggcagcgtggaggccacccagcccgtgctgaagcagagaagaagactgaccatgaaggacatcggcacccccgaggcctggagagtgatgatgagcctgaagagcggcctgctggccgagagcacctgggccctggacaccatcaacatcctgctgtacgacgacaacagcatcatgaccttcaacctgagccagctgcccggcctgctggagctgctggtggagtacttcagaagatgcctgatcgagatcttcggcatcctgaaggagtacgaggtgggcgaccccggccagagaaccctgctggaccccggcagattcagcaaggtgagcagccccgcccccatggagggcggcgaggaggaggaggagctgctgggccccaagctggaggaggaggaggaggaggaggtggtggagaacgacgaggagatcgccttcagcggcaaggacaagcccgccagcgagaacagcgaggagaagctgatcagcaagttcgacaagctgcccgtgaagatcgtgcagaagaacgaccccttcgtggtggactgcagcgacaagctgggcagagtgcaggagttcgacagcggcctgctgcactggagaatcggcggcggcgacaccaccgagcacatccagacccacttcgagagcaagaccgagctgctgcccagcagaccccacgccccctgcccccccgcccccagaaagcacgtgaccaccgccgagggcacccccggcaccaccgaccaggagggccccccccccgacggcccccccgagaagagaatcaccgccaccatggacgacatgctgagcaccagaagcagcaccctgaccgaggacggcgccaagagcagcgaggccatcaaggagagcagcaagttccccttcggcatcagccccgcccagagccacagaaacatcaagatcctggaggacgagccccacagcaaggacgagacccccctgtgcaccctgctggactggcaggacagcctggccaagagatgcgtgtgcgtgagcaacaccatcagaagcctgagcttcgtgcccggcaacgacttcgagatgagcaagcaccccggcctgctgctgatcctgggcaagctgatcctgctgcaccacaagcaccccgagagaaagcaggcccccctgacctacgagaaggaggaggagcaggaccagggcgtgagctgcaacaaggtggagtggtggtgggactgcctggagatgctgagagagaacaccctggtgaccctggccaacatcagcggccagctggacctgagcccctaccccgagagcatctgcctgcccgtgctggacggcctgctgcactgggccgtgtgccccagcgccgaggcccaggaccccttcagcaccctgggccccaacgccgtgctgagcccccagagactggtgctggagaccctgagcaagctgagcatccaggacaacaacgtggacctgatcctggccaccccccccttcagcagactggagaagctgtacagcaccatggtgagattcctgagcgacagaaagaaccccgtgtgcagagagatggccgtggtgctgctggccaacctggcccagggcgacagcctggccgccagagccatcgccgtgcagaagggcagcatcggcaacctgctgggcttcctggaggacagcctggccgccacccagttccagcagagccaggccagcctgctgcacatgcagaacccccccttcgagcccaccagcgtggacatgatgagaagagccgccagagccctgctggccctggccaaggtggacgagaaccacagcgagttcaccctgtacgagagcagactgctggacatcagcgtgagccccctgatgaacagcctggtgagccaggtgatctgcgacgtgctgttcctgatcggccagagctag

SEQ ID NO: 7613 - DNA, 1842 bp, Artificial Sequence
  Description of Artificial Sequence: Synthetic coding sequence
atgatgagcctgaagagcggcctgctggccgagagcacctgggccctggacaccatcaacatcctgctgtacgacgacaacagcatcatgaccttcaacctgagccagctgcccggcctgctggagctgctggtggagtacttcagaagatgcctgatcgagatcttcggcatcctgaaggagtacgaggtgggcgaccccggccagagaaccctgctggaccccggcagattcagcaaggtgagcagccccgcccccatggagggcggcgaggaggaggaggagctgctgggccccaagctggaggaggaggaggaggaggaggtggtggagaacgacgaggagatcgccttcagcggcaaggacaagcccgccagcgagaacagcgaggagaagctgatcagcaagttcgacaagctgcccgtgaagatcgtgcagaagaacgaccccttcgtggtggactgcagcgacaagctgggcagagtgcaggagttcgacagcggcctgctgcactggagaatcggcggcggcgacaccaccgagcacatccagacccacttcgagagcaagaccgagctgctgcccagcagaccccacgccccctgcccccccgcccccagaaagcacgtgaccaccgccgagggcacccccggcaccaccgaccaggagggccccccccccgacggcccccccgagaagagaatcaccgccaccatggacgacatgctgagcaccagaagcagcaccctgaccgaggacggcgccaagagcagcgaggccatcaaggagagcagcaagttccccttcggcatcagccccgcccagagccacagaaacatcaagatcctggaggacgagccccacagcaaggacgagacccccctgtgcaccctgctggactggcaggacagcctggccaagagatgcgtgtgcgtgagcaacaccatcagaagcctgagcttcgtgcccggcaacgacttcgagatgagcaagcaccccggcctgctgctgatcctgggcaagctgatcctgctgcaccacaagcaccccgagagaaagcaggcccccctgacctacgagaaggaggaggagcaggaccagggcgtgagctgcaacaaggtggagtggtggtgggactgcctggagatgctgagagagaacaccctggtgaccctggccaacatcagcggccagctggacctgagcccctaccccgagagcatctgcctgcccgtgctggacggcctgctgcactgggccgtgtgccccagcgccgaggcccaggaccccttcagcaccctgggccccaacgccgtgctgagcccccagagactggtgctggagaccctgagcaagctgagcatccaggacaacaacgtggacctgatcctggccaccccccccttcagcagactggagaagctgtacagcaccatggtgagattcctgagcgacagaaagaaccccgtgtgcagagagatggccgtggtgctgctggccaacctggcccagggcgacagcctggccgccagagccatcgccgtgcagaagggcagcatcggcaacctgctgggcttcctggaggacagcctggccgccacccagttccagcagagccaggccagcctgctgcacatgcagaacccccccttcgagcccaccagcgtggacatgatgagaagagccgccagagccctgctggccctggccaaggtggacgagaaccacagcgagttcaccctgtacgagagcagactgctggacatcagcgtgagccccctgatgaacagcctggtgagccaggtgatctgcgacgtgctgttcctgatcggccagagctag

SEQ ID NO: 7614 - DNA, 6696 bp, Artificial Sequence
  Description of Artificial Sequence: Synthetic coding sequence
atggagaccggcctgctgcccaaccacaagctgaagaccgtgggcgaggcccccgccgcccccccccaccagcagcaccaccaccaccaccacgcccaccaccaccaccaccacgcccaccacctgcaccaccaccacgccctgcagcagcagctgaaccagttccagcagcagcagcagcagcagcagcagcagcagcagcagcagcagcagcagcagcaccccatcagcaacaacaacagcctgggcggcgccggcggcggcgccccccagcccggccccgacatggagcagccccagcacggcggcgccaaggacagcgccgccggcggccaggccgacccccccggcccccccctgctgagcaagcccggcgacgaggacgacgccccccccaagatgggcgagcccgccggcggcagatacgagcaccccggcctgggcgccctgggcacccagcagccccccgtggccgtgcccggcggcggcggcggccccgccgccgtgcccgagttcaacaactactacggcagcgccgcccccgccagcggcggccccggcggcagagccggcccctgcttcgaccagcacggcggccagcagagccccggcatgggcatgatgcacagcgccagcgccgccgccgccggcgcccccggcagcatggaccccctgcagaacagccacgagggctaccccaacagccagtgcaaccactaccccggctacagcagacccggcgccggcggcggcggcggcggcggcggcggcggcggcggcggcagcggcggcggcggcggcggcggcggcgccggcgccggcggcgccggcgccggcgccgtggccgccgccgccgccgccgccgccgccgccgccggcggcggcggcggcggcggctacggcggcagcagcgccggctacggcgtgctgagcagccccagacagcagggcggcggcatgatgatgggccccggcggcggcggcgccgccagcctgagcaaggccgccgccggcagcgccgccggcggcttccagagattcgccggccagaaccagcaccccagcggcgccacccccaccctgaaccagctgctgaccagccccagccccatgatgagaagctacggcggcagctaccccgagtacagcagccccagcgcccccccccccccccccagccagccccagagccaggccgccgccgccggcgccgccgccggcggccagcaggccgccgccggcatgggcctgggcaaggacatgggcgcccagtacgccgccgccagccccgcctgggccgccgcccagcagagaagccaccccgccatgagccccggcacccccggccccaccatgggcagaagccagggcagccccatggaccccatggtgatgaagagaccccagctgtacggcatgggcagcaacccccacagccagccccagcagagcagcccctaccccggcggcagctacggcccccccggcccccagagataccccatcggcatccagggcagaacccccggcgccatggccggcatgcagtacccccagcagcagatgcccccccagtacggccagcagggcgtgagcggctactgccagcagggccagcagccctactacagccagcagccccagcccccccacctgcccccccaggcccagtacctgcccagccagagccagcagagataccagccccagcaggacatgagccaggagggctacggcaccagaagccagccccccctggcccccggcaagcccaaccacgaggacctgaacctgatccagcaggagagacccagcagcctgcccgacctgagcggcagcatcgacgacctgcccaccggcaccgaggccaccctgagcagcgccgtgagcgccagcggcagcaccagcagccagggcgaccagagcaaccccgcccagagccccttcagcccccacgccagcccccacctgagcagcatccccggcggccccagccccagccccgtgggcagccccgtgggcagcaaccagagcagaagcggccccatcagccccgccagcatccccggcagccagatgcccccccagccccccggcagccagagcgagagcagcagccaccccgccctgagccagagccccatgccccaggagagaggcttcatggccggcacccagagaaacccccagatggcccagtacggcccccagcagaccggccccagcatgagcccccaccccagccccggcggccagatgcacgccggcatcagcagcttccagcagagcaacagcagcggcacctacggcccccagatgagccagtacggcccccagggcaactacagcagaccccccgcctacagcggcgtgcccagcgccagctacagcggccccggccccggcatgggcatcagcgccaacaaccagatgcacggccagggccccagccagccctgcggcgccgtgcccctgggcagaatgcccagcgccggcatgcagaacagacccttccccggcaacatgagcagcatgacccccagcagccccggcatgagccagcagggcggccccggcatgggcccccccatgcccaccgtgaacagaaaggcccaggaggccgccgccgccgtgatgcaggccgccgccaacagcgcccagagcagacagggcagcttccccggcatgaaccagagcggcctgatggccagcagcagcccctacagccagcccatgaacaacagcagcagcctgatgaacacccaggcccccccctacagcatggcccccgccatggtgaacagcagcgccgccagcgtgggcctggccgacatgatgagccccggcgagagcaagctgcccctgcccctgaaggccgacggcaaggaggagggcaccccccagcccgagagcaagagcaaggacagctacagcagccagggcatcagccagccccccacccccggcaacctgcccgtgcccagccccatgagccccagcagcgccagcatcagcagcttccacggcgacgagagcgacagcatcagcagccccggctggcccaagacccccagcagccccaagagcagcagcagcaccaccaccggcgagaagatcaccaaggtgtacgagctgggcaacgagcccgagagaaagctgtgggtggacagatacctgaccttcatggaggagagaggcagccccgtgagcagcctgcccgccgtgggcaagaagcccctggacctgttcagactgtacgtgtgcgtgaaggagatcggcggcctggcccaggtgaacaagaacaagaagtggagagagctggccaccaacctgaacgtgggcaccagcagcagcgccgccagcagcctgaagaagcagtacatccagtacctgttcgccttcgagtgcaagatcgagagaggcgaggagcccccccccgaggtgttcagcaccggcgacaccaagaagcagcccaagctgcagccccccagccccgccaacagcggcagcctgcagggcccccagaccccccagagcaccggcagcaacagcatggccgaggtgcccggcgacctgaagccccccacccccgccagcaccccccacggccagatgacccccatgcagggcggcagaagcagcaccatcagcgtgcacgaccccttcagcgacgtgagcgacagcagcttccccaagagaaacagcatgacccccaacgccccctaccagcagggcatgagcatgcccgacgtgatgggcagaatgccctacgagcccaacaaggaccccttcggcggcatgagaaaggtgcccggcagcagcgagcccttcatgacccagggccagatgcccaacagcagcatgcaggacatgtacaaccagagccccagcggcgccatgagcaacctgggcatgggccagagacagcagttcccctacggcgccagctacgacagaagacacgagccctacggccagcagtaccccggccagggcccccccagcggccagcccccctacggcggccaccagcccggcctgtacccccagcagcccaactacaagagacacatggacggcatgtacggcccccccgccaagagacacgagggcgacatgtacaacatgcagtacagcagccagcagcaggagatgtacaaccagtacggcggcagctacagcggccccgacagaagacccatccagggccagtacccctacccctacagcagagagagaatgcagggccccggccagatccagacccacggcatccccccccagatgatgggcggccccctgcagagcagcagcagcgagggcccccagcagaacatgtgggccgccagaaacgacatgccctacccctaccagaacagacagggccccggcggccccacccaggcccccccctaccccggcatgaacagaaccgacgacatgatggtgcccgaccagagaatcaaccacgagagccagtggcccagccacgtgagccagagacagccctacatgagcagcagcgccagcatgcagcccatcaccagacccccccagcccagctaccagaccccccccagcctgcccaaccacatcagcagagcccccagccccgccagcttccagagaagcctggagaacagaatgagccccagcaagagccccttcctgcccagcatgaagatgcagaaggtgatgcccaccgtgcccaccagccaggtgaccggcccccccccccagcccccccccatcagaagagagatcaccttcccccccggcagcgtggaggccagccagcccgtgctgaagcagagaagaaagatcaccagcaaggacatcgtgacccccgaggcctggagagtgatgatgagcctgaagagcggcctgctggccgagagcacctgggccctggacaccatcaacatcctgctgtacgacgacagcaccgtggccaccttcaacctgagccagctgagcggcttcctggagctgctggtggagtacttcagaaagtgcctgatcgacatcttcggcatcctgatggagtacgaggtgggcgaccccagccagaaggccctggaccacaacgccgccagaaaggacgacagccagagcctggccgacgacagcggcaaggaggaggaggacgccgagtgcatcgacgacgacgaggaggacgaggaggacgaggaggaggacagcgagaagaccgagagcgacgagaagagcagcatcgccctgaccgcccccgacgccgccgccgaccccaaggagaagcccaagcaggccagcaagttcgacaagctgcccatcaagatcgtgaagaagaacaacctgttcgtggtggacagaagcgacaagctgggcagagtgcaggagttcaacagcggcctgctgcactggcagctgggcggcggcgacaccaccgagcacatccagacccacttcgagagcaagatggagatcccccccagaagaagaccccccccccccctgagcagcgccggcagaaagaaggagcaggagggcaagggcgacagcgaggagcagcaggagaagagcatcatcgccaccatcgacgacgtgctgagcgccagacccggcgccctgcccgaggacgccaaccccggcccccagaccgagagcagcaagttccccttcggcatccagcaggccaagagccacagaaacatcaagctgctggaggacgagcccagaagcagagacgagacccccctgtgcaccatcgcccactggcaggacagcctggccaagagatgcatctgcgtgagcaacatcgtgagaagcctgagcttcgtgcccggcaacgacgccgagatgagcaagcaccccggcctggtgctgatcctgggcaagctgatcctgctgcaccacgagcaccccgagagaaagagagccccccagacctacgagaaggaggaggacgaggacaagggcgtggcctgcagcaaggacgagtggtggtgggactgcctggaggtgctgagagacaacaccctggtgaccctggccaacatcagcggccagctggacctgagcgcctacaccgagagcatctgcctgcccatcctggacggcctgctgcactggatggtgtgccccagcgccgaggcccaggaccccttccccaccgtgggccccaacagcgtgctgagcccccagagactggtgctggagaccctgtgcaagctgagcatccaggacaacaacgtggacctgatcctggccaccccccccttcagcagacaggagaagttctacgccaccctggtgagatacgtgggcgacagaaagaaccccgtgtgcagagagatgagcatggccctgctgagcaacctggcccagggcgacgccctggccgccagagccatcgccgtgcagaagggcagcatcggcaacctgatcagcttcctggaggacggcgtgaccatggcccagtaccagcagagccagcacaacctgatgcacatgcagcccccccccctggagccccccagcgtggacatgatgtgcagagccgccaaggccctgctggccatggccagagtggacgagaacagaagcgagttcctgctgcacgagggcagactgctggacatcagcatcagcgccgtgctgaacagcctggtggccagcgtgatctgcgacgtgctgttccagatcggccagctgtag

SEQ ID NO: 7615 - DNA, 6750 bp, Artificial Sequence
  Description of Artificial Sequence: Synthetic coding sequence
atggcccacaacgccggcgccgccgccgccgccggcacccacagcgccaagagcggcggcagcgaggccgccctgaaggagggcggcagcgccgccgccctgagcagcagcagcagcagcagcgccgccgccgccgccgccagcagcagcagcagcagcggccccggcagcgccatggagaccggcctgctgcccaaccacaagctgaagaccgtgggcgaggcccccgccgcccccccccaccagcagcaccaccaccaccaccacgcccaccaccaccaccaccacgcccaccacctgcaccaccaccacgccctgcagcagcagctgaaccagttccagcagcagcagcagcagcagcagcagcagcagcagcagcagcagcagcagcagcaccccatcagcaacaacaacagcctgggcggcgccggcggcggcgccccccagcccggccccgacatggagcagccccagcacggcggcgccaaggacagcgccgccggcggccaggccgacccccccggcccccccctgctgagcaagcccggcgacgaggacgacgccccccccaagatgggcgagcccgccggcggcagatacgagcaccccggcctgggcgccctgggcacccagcagccccccgtggccgtgcccggcggcggcggcggccccgccgccgtgcccgagttcaacaactactacggcagcgccgcccccgccagcggcggccccggcggcagagccggcccctgcttcgaccagcacggcggccagcagagccccggcatgggcatgatgcacagcgccagcgccgccgccgccggcgcccccggcagcatggaccccctgcagaacagccacgagggctaccccaacagccagtgcaaccactaccccggctacagcagacccggcgccggcggcggcggcggcggcggcggcggcggcggcggcggcagcggcggcggcggcggcggcggcggcgccggcgccggcggcgccggcgccggcgccgtggccgccgccgccgccgccgccgccgccgccgccggcggcggcggcggcggcggctacggcggcagcagcgccggctacggcgtgctgagcagccccagacagcagggcggcggcatgatgatgggccccggcggcggcggcgccgccagcctgagcaaggccgccgccggcagcgccgccggcggcttccagagattcgccggccagaaccagcaccccagcggcgccacccccaccctgaaccagctgctgaccagccccagccccatgatgagaagctacggcggcagctaccccgagtacagcagccccagcgcccccccccccccccccagccagccccagagccaggccgccgccgccggcgccgccgccggcggccagcaggccgccgccggcatgggcctgggcaaggacatgggcgcccagtacgccgccgccagccccgcctgggccgccgcccagcagagaagccaccccgccatgagccccggcacccccggccccaccatgggcagaagccagggcagccccatggaccccatggtgatgaagagaccccagctgtacggcatgggcagcaacccccacagccagccccagcagagcagcccctaccccggcggcagctacggcccccccggcccccagagataccccatcggcatccagggcagaacccccggcgccatggccggcatgcagtacccccagcagcaggacagcggcgacgccacctggaaggagaccttctggctgatgcccccccagtacggccagcagggcgtgagcggctactgccagcagggccagcagccctactacagccagcagccccagcccccccacctgcccccccaggcccagtacctgcccagccagagccagcagagataccagccccagcaggacatgagccaggagggctacggcaccagaagccagccccccctggcccccggcaagcccaaccacgaggacctgaacctgatccagcaggagagacccagcagcctgcccgacctgagcggcagcatcgacgacctgcccaccggcaccgaggccaccctgagcagcgccgtgagcgccagcggcagcaccagcagccagggcgaccagagcaaccccgcccagagccccttcagcccccacgccagcccccacctgagcagcatccccggcggccccagccccagccccgtgggcagccccgtgggcagcaaccagagcagaagcggccccatcagccccgccagcatccccggcagccagatgcccccccagccccccggcagccagagcgagagcagcagccaccccgccctgagccagagccccatgccccaggagagaggcttcatggccggcacccagagaaacccccagatggcccagtacggcccccagcagaccggccccagcatgagcccccaccccagccccggcggccagatgcacgccggcatcagcagcttccagcagagcaacagcagcggcacctacggcccccagatgagccagtacggcccccagggcaactacagcagaccccccgcctacagcggcgtgcccagcgccagctacagcggccccggccccggcatgggcatcagcgccaacaaccagatgcacggccagggccccagccagccctgcggcgccgtgcccctgggcagaatgcccagcgccggcatgcagaacagacccttccccggcaacatgagcagcatgacccccagcagccccggcatgagccagcagggcggccccggcatgggcccccccatgcccaccgtgaacagaaaggcccaggaggccgccgccgccgtgatgcaggccgccgccaacagcgcccagagcagacagggcagcttccccggcatgaaccagagcggcctgatggccagcagcagcccctacagccagcccatgaacaacagcagcagcctgatgaacacccaggcccccccctacagcatggcccccgccatggtgaacagcagcgccgccagcgtgggcctggccgacatgatgagccccggcgagagcaagctgcccctgcccctgaaggccgacggcaaggaggagggcaccccccagcccgagagcaagagcaagaagagcagcagcagcaccaccaccggcgagaagatcaccaaggtgtacgagctgggcaacgagcccgagagaaagctgtgggtggacagatacctgaccttcatggaggagagaggcagccccgtgagcagcctgcccgccgtgggcaagaagcccctggacctgttcagactgtacgtgtgcgtgaaggagatcggcggcctggcccaggtgaacaagaacaagaagtggagagagctggccaccaacctgaacgtgggcaccagcagcagcgccgccagcagcctgaagaagcagtacatccagtacctgttcgccttcgagtgcaagatcgagagaggcgaggagcccccccccgaggtgttcagcaccggcgacaccaagaagcagcccaagctgcagccccccagccccgccaacagcggcagcctgcagggcccccagaccccccagagcaccggcagcaacagcatggccgaggtgcccggcgacctgaagccccccacccccgccagcaccccccacggccagatgacccccatgcagggcggcagaagcagcaccatcagcgtgcacgaccccttcagcgacgtgagcgacagcagcttccccaagagaaacagcatgacccccaacgccccctaccagcagggcatgagcatgcccgacgtgatgggcagaatgccctacgagcccaacaaggaccccttcggcggcatgagaaaggtgcccggcagcagcgagcccttcatgacccagggccagatgcccaacagcagcatgcaggacatgtacaaccagagccccagcggcgccatgagcaacctgggcatgggccagagacagcagttcccctacggcgccagctacgacagaagacacgagccctacggccagcagtaccccggccagggcccccccagcggccagcccccctacggcggccaccagcccggcctgtacccccagcagcccaactacaagagacacatggacggcatgtacggcccccccgccaagagacacgagggcgacatgtacaacatgcagtacagcagccagcagcaggagatgtacaaccagtacggcggcagctacagcggccccgacagaagacccatccagggccagtacccctacccctacagcagagagagaatgcagggccccggccagatccagacccacggcatccccccccagatgatgggcggccccctgcagagcagcagcagcgagggcccccagcagaacatgtgggccgccagaaacgacatgccctacccctaccagaacagacagggccccggcggccccacccaggcccccccctaccccggcatgaacagaaccgacgacatgatggtgcccgaccagagaatcaaccacgagagccagtggcccagccacgtgagccagagacagccctacatgagcagcagcgccagcatgcagcccatcaccagacccccccagcccagctaccagaccccccccagcctgcccaaccacatcagcagagcccccagccccgccagcttccagagaagcctggagaacagaatgagccccagcaagagccccttcctgcccagcatgaagatgcagaaggtgatgcccaccgtgcccaccagccaggtgaccggcccccccccccagcccccccccatcagaagagagatcaccttcccccccggcagcgtggaggccagccagcccgtgctgaagcagagaagaaagatcaccagcaaggacatcgtgacccccgaggcctggagagtgatgatgagcctgaagagcggcctgctggccgagagcacctgggccctggacaccatcaacatcctgctgtacgacgacagcaccgtggccaccttcaacctgagccagctgagcggcttcctggagctgctggtggagtacttcagaaagtgcctgatcgacatcttcggcatcctgatggagtacgaggtgggcgaccccagccagaaggccctggaccacaacgccgccagaaaggacgacagccagagcctggccgacgacagcggcaaggaggaggaggacgccgagtgcatcgacgacgacgaggaggacgaggaggacgaggaggaggacagcgagaagaccgagagcgacgagaagagcagcatcgccctgaccgcccccgacgccgccgccgaccccaaggagaagcccaagcaggccagcaagttcgacaagctgcccatcaagatcgtgaagaagaacaacctgttcgtggtggacagaagcgacaagctgggcagagtgcaggagttcaacagcggcctgctgcactggcagctgggcggcggcgacaccaccgagcacatccagacccacttcgagagcaagatggagatcccccccagaagaagaccccccccccccctgagcagcgccggcagaaagaaggagcaggagggcaagggcgacagcgaggagcagcaggagaagagcatcatcgccaccatcgacgacgtgctgagcgccagacccggcgccctgcccgaggacgccaaccccggcccccagaccgagagcagcaagttccccttcggcatccagcaggccaagagccacagaaacatcaagctgctggaggacgagcccagaagcagagacgagacccccctgtgcaccatcgcccactggcaggacagcctggccaagagatgcatctgcgtgagcaacatcgtgagaagcctgagcttcgtgcccggcaacgacgccgagatgagcaagcaccccggcctggtgctgatcctgggcaagctgatcctgctgcaccacgagcaccccgagagaaagagagccccccagacctacgagaaggaggaggacgaggacaagggcgtggcctgcagcaaggacgagtggtggtgggactgcctggaggtgctgagagacaacaccctggtgaccctggccaacatcagcggccagctggacctgagcgcctacaccgagagcatctgcctgcccatcctggacggcctgctgcactggatggtgtgccccagcgccgaggcccaggaccccttccccaccgtgggccccaacagcgtgctgagcccccagagactggtgctggagaccctgtgcaagctgagcatccaggacaacaacgtggacctgatcctggccaccccccccttcagcagacaggagaagttctacgccaccctggtgagatacgtgggcgacagaaagaaccccgtgtgcagagagatgagcatggccctgctgagcaacctggcccagggcgacgccctggccgccagagccatcgccgtgcagaagggcagcatcggcaacctgatcagcttcctggaggacggcgtgaccatggcccagtaccagcagagccagcacaacctgatgcacatgcagcccccccccctggagccccccagcgtggacatgatgtgcagagccgccaaggccctgctggccatggccagagtggacgagaacagaagcgagttcctgctgcacgagggcagactgctggacatcagcatcagcgccgtgctgaacagcctggtggccagcgtgatctgcgacgtgctgttccagatcggccagctgtag

SEQ ID NO: 7616 - DNA, 6711 bp, Artificial Sequence
  Description of Artificial Sequence: Synthetic coding sequence
atggcccacaacgccggcgccgccgccgccgccggcacccacagcgccaagagcggcggcagcgaggccgccctgaaggagggcggcagcgccgccgccctgagcagcagcagcagcagcagcgccgccgccgccgccgccagcagcagcagcagcagcggccccggcagcgccatggagaccggcctgctgcccaaccacaagctgaagaccgtgggcgaggcccccgccgcccccccccaccagcagcaccaccaccaccaccacgcccaccaccaccaccaccacgcccaccacctgcaccaccaccacgccctgcagcagcagctgaaccagttccagcagcagcagcagcagcagcagcagcagcagcagcagcagcagcagcagcagcaccccatcagcaacaacaacagcctgggcggcgccggcggcggcgccccccagcccggccccgacatggagcagccccagcacggcggcgccaaggacagcgccgccggcggccaggccgacccccccggcccccccctgctgagcaagcccggcgacgaggacgacgccccccccaagatgggcgagcccgccggcggcagatacgagcaccccggcctgggcgccctgggcacccagcagccccccgtggccgtgcccggcggcggcggcggccccgccgccgtgcccgagttcaacaactactacggcagcgccgcccccgccagcggcggccccggcggcagagccggcccctgcttcgaccagcacggcggccagcagagccccggcatgggcatgatgcacagcgccagcgccgccgccgccggcgcccccggcagcatggaccccctgcagaacagccacgagggctaccccaacagccagtgcaaccactaccccggctacagcagacccggcgccggcggcggcggcggcggcggcggcggcggcggcggcggcagcggcggcggcggcggcggcggcggcgccggcgccggcggcgccggcgccggcgccgtggccgccgccgccgccgccgccgccgccgccgccggcggcggcggcggcggcggctacggcggcagcagcgccggctacggcgtgctgagcagccccagacagcagggcggcggcatgatgatgggccccggcggcggcggcgccgccagcctgagcaaggccgccgccggcagcgccgccggcggcttccagagattcgccggccagaaccagcaccccagcggcgccacccccaccctgaaccagctgctgaccagccccagccccatgatgagaagctacggcggcagctaccccgagtacagcagccccagcgcccccccccccccccccagccagccccagagccaggccgccgccgccggcgccgccgccggcggccagcaggccgccgccggcatgggcctgggcaaggacatgggcgcccagtacgccgccgccagccccgcctgggccgccgcccagcagagaagccaccccgccatgagccccggcacccccggccccaccatgggcagaagccagggcagccccatggaccccatggtgatgaagagaccccagctgtacggcatgggcagcaacccccacagccagccccagcagagcagcccctaccccggcggcagctacggcccccccggcccccagagataccccatcggcatccagggcagaacccccggcgccatggccggcatgcagtacccccagcagcagatgcccccccagtacggccagcagggcgtgagcggctactgccagcagggccagcagccctactacagccagcagccccagcccccccacctgcccccccaggcccagtacctgcccagccagagccagcagagataccagccccagcaggacatgagccaggagggctacggcaccagaagccagccccccctggcccccggcaagcccaaccacgaggacctgaacctgatccagcaggagagacccagcagcctgcccgacctgagcggcagcatcgacgacctgcccaccggcaccgaggccaccctgagcagcgccgtgagcgccagcggcagcaccagcagccagggcgaccagagcaaccccgcccagagccccttcagcccccacgccagcccccacctgagcagcatccccggcggccccagccccagccccgtgggcagccccgtgggcagcaaccagagcagaagcggccccatcagccccgccagcatccccggcagccagatgcccccccagccccccggcagccagagcgagagcagcagccaccccgccctgagccagagccccatgccccaggagagaggcttcatggccggcacccagagaaacccccagatggcccagtacggcccccagcagaccggccccagcatgagcccccaccccagccccggcggccagatgcacgccggcatcagcagcttccagcagagcaacagcagcggcacctacggcccccagatgagccagtacggcccccagggcaactacagcagaccccccgcctacagcggcgtgcccagcgccagctacagcggccccggccccggcatgggcatcagcgccaacaaccagatgcacggccagggccccagccagccctgcggcgccgtgcccctgggcagaatgcccagcgccggcatgcagaacagacccttccccggcaacatgagcagcatgacccccagcagccccggcatgagccagcagggcggccccggcatgggcccccccatgcccaccgtgaacagaaaggcccaggaggccgccgccgccgtgatgcaggccgccgccaacagcgcccagagcagacagggcagcttccccggcatgaaccagagcggcctgatggccagcagcagcccctacagccagcccatgaacaacagcagcagcctgatgaacacccaggcccccccctacagcatggcccccgccatggtgaacagcagcgccgccagcgtgggcctggccgacatgatgagccccggcgagagcaagctgcccctgcccctgaaggccgacggcaaggaggagggcaccccccagcccgagagcaagagcaagaagagcagcagcagcaccaccaccggcgagaagatcaccaaggtgtacgagctgggcaacgagcccgagagaaagctgtgggtggacagatacctgaccttcatggaggagagaggcagccccgtgagcagcctgcccgccgtgggcaagaagcccctggacctgttcagactgtacgtgtgcgtgaaggagatcggcggcctggcccaggtgaacaagaacaagaagtggagagagctggccaccaacctgaacgtgggcaccagcagcagcgccgccagcagcctgaagaagcagtacatccagtacctgttcgccttcgagtgcaagatcgagagaggcgaggagcccccccccgaggtgttcagcaccggcgacaccaagaagcagcccaagctgcagccccccagccccgccaacagcggcagcctgcagggcccccagaccccccagagcaccggcagcaacagcatggccgaggtgcccggcgacctgaagccccccacccccgccagcaccccccacggccagatgacccccatgcagggcggcagaagcagcaccatcagcgtgcacgaccccttcagcgacgtgagcgacagcagcttccccaagagaaacagcatgacccccaacgccccctaccagcagggcatgagcatgcccgacgtgatgggcagaatgccctacgagcccaacaaggaccccttcggcggcatgagaaaggtgcccggcagcagcgagcccttcatgacccagggccagatgcccaacagcagcatgcaggacatgtacaaccagagccccagcggcgccatgagcaacctgggcatgggccagagacagcagttcccctacggcgccagctacgacagaagacacgagccctacggccagcagtaccccggccagggcccccccagcggccagcccccctacggcggccaccagcccggcctgtacccccagcagcccaactacaagagacacatggacggcatgtacggcccccccgccaagagacacgagggcgacatgtacaacatgcagtacagcagccagcagcaggagatgtacaaccagtacggcggcagctacagcggccccgacagaagacccatccagggccagtacccctacccctacagcagagagagaatgcagggccccggccagatccagacccacggcatccccccccagatgatgggcggccccctgcagagcagcagcagcgagggcccccagcagaacatgtgggccgccagaaacgacatgccctacccctaccagaacagacagggccccggcggccccacccaggcccccccctaccccggcatgaacagaaccgacgacatgatggtgcccgaccagagaatcaaccacgagagccagtggcccagccacgtgagccagagacagccctacatgagcagcagcgccagcatgcagcccatcaccagacccccccagcccagctaccagaccccccccagcctgcccaaccacatcagcagagcccccagccccgccagcttccagagaagcctggagaacagaatgagccccagcaagagccccttcctgcccagcatgaagatgcagaaggtgatgcccaccgtgcccaccagccaggtgaccggcccccccccccagcccccccccatcagaagagagatcaccttcccccccggcagcgtggaggccagccagcccgtgctgaagcagagaagaaagatcaccagcaaggacatcgtgacccccgaggcctggagagtgatgatgagcctgaagagcggcctgctggccgagagcacctgggccctggacaccatcaacatcctgctgtacgacgacagcaccgtggccaccttcaacctgagccagctgagcggcttcctggagctgctggtggagtacttcagaaagtgcctgatcgacatcttcggcatcctgatggagtacgaggtgggcgaccccagccagaaggccctggaccacaacgccgccagaaaggacgacagccagagcctggccgacgacagcggcaaggaggaggaggacgccgagtgcatcgacgacgacgaggaggacgaggaggacgaggaggaggacagcgagaagaccgagagcgacgagaagagcagcatcgccctgaccgcccccgacgccgccgccgaccccaaggagaagcccaagcaggccagcaagttcgacaagctgcccatcaagatcgtgaagaagaacaacctgttcgtggtggacagaagcgacaagctgggcagagtgcaggagttcaacagcggcctgctgcactggcagctgggcggcggcgacaccaccgagcacatccagacccacttcgagagcaagatggagatcccccccagaagaagaccccccccccccctgagcagcgccggcagaaagaaggagcaggagggcaagggcgacagcgaggagcagcaggagaagagcatcatcgccaccatcgacgacgtgctgagcgccagacccggcgccctgcccgaggacgccaaccccggcccccagaccgagagcagcaagttccccttcggcatccagcaggccaagagccacagaaacatcaagctgctggaggacgagcccagaagcagagacgagacccccctgtgcaccatcgcccactggcaggacagcctggccaagagatgcatctgcgtgagcaacatcgtgagaagcctgagcttcgtgcccggcaacgacgccgagatgagcaagcaccccggcctggtgctgatcctgggcaagctgatcctgctgcaccacgagcaccccgagagaaagagagccccccagacctacgagaaggaggaggacgaggacaagggcgtggcctgcagcaaggacgagtggtggtgggactgcctggaggtgctgagagacaacaccctggtgaccctggccaacatcagcggccagctggacctgagcgcctacaccgagagcatctgcctgcccatcctggacggcctgctgcactggatggtgtgccccagcgccgaggcccaggaccccttccccaccgtgggccccaacagcgtgctgagcccccagagactggtgctggagaccctgtgcaagctgagcatccaggacaacaacgtggacctgatcctggccaccccccccttcagcagacaggagaagttctacgccaccctggtgagatacgtgggcgacagaaagaaccccgtgtgcagagagatgagcatggccctgctgagcaacctggcccagggcgacgccctggccgccagagccatcgccgtgcagaagggcagcatcggcaacctgatcagcttcctggaggacggcgtgaccatggcccagtaccagcagagccagcacaacctgatgcacatgcagcccccccccctggagccccccagcgtggacatgatgtgcagagccgccaaggccctgctggccatggccagagtggacgagaacagaagcgagttcctgctgcacgagggcagactgctggacatcagcatcagcgccgtgctgaacagcctggtggccagcgtgatctgcgacgtgctgttccagatcggccagctgtag

SEQ ID NO: 7617 - DNA, 2172 bp, Artificial Sequence
  Description of Artificial Sequence: Synthetic coding sequence
atgcccccccagtacggccagcagggcgtgagcggctactgccagcagggccagcagccctactacagccagcagccccagcccccccacctgcccccccaggcccagtacctgcccagccagagccagcagagataccagccccagcaggacatgagccaggagggctacggcaccagaagccagccccccctggcccccggcaagcccaaccacgaggacctgaacctgatccagcaggagagacccagcagcctgcccgacctgagcggcagcatcgacgacctgcccaccggcaccgaggccaccctgagcagcgccgtgagcgccagcggcagcaccagcagccagggcgaccagagcaaccccgcccagagccccttcagcccccacgccagcccccacctgagcagcatccccggcggccccagccccagccccgtgggcagccccgtgggcagcaaccagagcagaagcggccccatcagccccgccagcatccccggcagccagatgcccccccagccccccggcagccagagcgagagcagcagccaccccgccctgagccagagccccatgccccaggagagaggcacccagagaaacccccagatggcccagtacggcccccagcagaccggccccagcatgagcccccaccccagccccggcggccagatgcacgccggcatcagcagcttccagcagagcaacagcagcggcacctacggcccccagatgagccagtacggcccccagggcaactacagcagaccccccgcctacagcggcgtgcccagcgccagctacagcggccccggccccggcatgggcatcagcgccaacaaccagatgcacggccagggccccagccagccctgcggcgccgtgcccctgggcagaatgcccagcgccggcatgcagaacagacccttccccggcaacatgagcagcatgacccccagcagccccggcatgagccagcagggcggccccggcatgggcccccccatgcccaccgtgaacagaaaggcccaggaggccgccgccgccgtgatgcaggccgccgccaacagcgcccagagcagacagggcagcttccccggcatgaaccagagcggcctgatggccagcagcagcccctacagccagcccatgaacaacagcagcagcctgatgaacacccaggcccccccctacagcatggcccccgccatggtgaacagcagcgccgccagcgtgggcctggccgacatgatgagccccggcgagagcaagctgcccctgcccctgaaggccgacggcaaggaggagggcaccccccagcccgagagcaagagcaaggacagctacagcagccagggcatcagccagccccccacccccggcaacctgcccgtgcccagccccatgagccccagcagcgccagcatcagcagcttccacggcgacgagagcgacagcatcagcagccccggctggcccaagacccccagcagccccaagagcagcagcagcaccaccaccggcgagaagatcaccaaggtgtacgagctgggcaacgagcccgagagaaagctgtgggtggacagatacctgaccttcatggaggagagaggcagccccgtgagcagcctgcccgccgtgggcaagaagcccctggacctgttcagactgtacgtgtgcgtgaaggagatcggcggcctggcccaggtgaacaagaacaagaagtggagagagctggccaccaacctgaacgtgggcaccagcagcagcgccgccagcagcctgaagaagcagtacatccagtacctgttcgccttcgagtgcaagatcgagagaggcgaggagcccccccccgaggtgttcagcaccggcgacaccaagaagcagcccaagctgcagccccccagccccgtggtgcagatggagcccagagcctgcgacaccggcggcagcggcagaaaggccagctggagcagacccgcccccagagccagagccggcggcagcagacacacccaggccagcggcggcagaagacagagacaccccggcctgcagaagcccctggacagcctgccccccacccagcaggtggccagccccatccccgtgcccagcctgggcaaggtgagcggcaacatcttcgtggtgaagggcaagtag

SEQ ID NO: 7618 - DNA, 6870 bp, Artificial Sequence
  Description of Artificial Sequence: Synthetic coding sequence
atggcccacaacgccggcgccgccgccgccgccggcacccacagcgccaagagcggcggcagcgaggccgccctgaaggagggcggcagcgccgccgccctgagcagcagcagcagcagcagcgccgccgccgccgccgccagcagcagcagcagcagcggccccggcagcgccatggagaccggcctgctgcccaaccacaagctgaagaccgtgggcgaggcccccgccgcccccccccaccagcagcaccaccaccaccaccacgcccaccaccaccaccaccacgcccaccacctgcaccaccaccacgccctgcagcagcagctgaaccagttccagcagcagcagcagcagcagcagcagcagcagcagcagcagcagcagcagcagcaccccatcagcaacaacaacagcctgggcggcgccggcggcggcgccccccagcccggccccgacatggagcagccccagcacggcggcgccaaggacagcgccgccggcggccaggccgacccccccggcccccccctgctgagcaagcccggcgacgaggacgacgccccccccaagatgggcgagcccgccggcggcagatacgagcaccccggcctgggcgccctgggcacccagcagccccccgtggccgtgcccggcggcggcggcggccccgccgccgtgcccgagttcaacaactactacggcagcgccgcccccgccagcggcggccccggcggcagagccggcccctgcttcgaccagcacggcggccagcagagccccggcatgggcatgatgcacagcgccagcgccgccgccgccggcgcccccggcagcatggaccccctgcagaacagccacgagggctaccccaacagccagtgcaaccactaccccggctacagcagacccggcgccggcggcggcggcggcggcggcggcggcggcggcggcggcagcggcggcggcggcggcggcggcggcgccggcgccggcggcgccggcgccggcgccgtggccgccgccgccgccgccgccgccgccgccgccggcggcggcggcggcggcggctacggcggcagcagcgccggctacggcgtgctgagcagccccagacagcagggcggcggcatgatgatgggccccggcggcggcggcgccgccagcctgagcaaggccgccgccggcagcgccgccggcggcttccagagattcgccggccagaaccagcaccccagcggcgccacccccaccctgaaccagctgctgaccagccccagccccatgatgagaagctacggcggcagctaccccgagtacagcagccccagcgcccccccccccccccccagccagccccagagccaggccgccgccgccggcgccgccgccggcggccagcaggccgccgccggcatgggcctgggcaaggacatgggcgcccagtacgccgccgccagccccgcctgggccgccgcccagcagagaagccaccccgccatgagccccggcacccccggccccaccatgggcagaagccagggcagccccatggaccccatggtgatgaagagaccccagctgtacggcatgggcagcaacccccacagccagccccagcagagcagcccctaccccggcggcagctacggcccccccggcccccagagataccccatcggcatccagggcagaacccccggcgccatggccggcatgcagtacccccagcagcagatgcccccccagtacggccagcagggcgtgagcggctactgccagcagggccagcagccctactacagccagcagccccagcccccccacctgcccccccaggcccagtacctgcccagccagagccagcagagataccagccccagcaggacatgagccaggagggctacggcaccagaagccagccccccctggcccccggcaagcccaaccacgaggacctgaacctgatccagcaggagagacccagcagcctgcccgacctgagcggcagcatcgacgacctgcccaccggcaccgaggccaccctgagcagcgccgtgagcgccagcggcagcaccagcagccagggcgaccagagcaaccccgcccagagccccttcagcccccacgccagcccccacctgagcagcatccccggcggccccagccccagccccgtgggcagccccgtgggcagcaaccagagcagaagcggccccatcagccccgccagcatccccggcagccagatgcccccccagccccccggcagccagagcgagagcagcagccaccccgccctgagccagagccccatgccccaggagagaggcttcatggccggcacccagagaaacccccagatggcccagtacggcccccagcagaccggccccagcatgagcccccaccccagccccggcggccagatgcacgccggcatcagcagcttccagcagagcaacagcagcggcacctacggcccccagatgagccagtacggcccccagggcaactacagcagaccccccgcctacagcggcgtgcccagcgccagctacagcggccccggccccggcatgggcatcagcgccaacaaccagatgcacggccagggccccagccagccctgcggcgccgtgcccctgggcagaatgcccagcgccggcatgcagaacagacccttccccggcaacatgagcagcatgacccccagcagccccggcatgagccagcagggcggccccggcatgggcccccccatgcccaccgtgaacagaaaggcccaggaggccgccgccgccgtgatgcaggccgccgccaacagcgcccagagcagacagggcagcttccccggcatgaaccagagcggcctgatggccagcagcagcccctacagccagcccatgaacaacagcagcagcctgatgaacacccaggcccccccctacagcatggcccccgccatggtgaacagcagcgccgccagcgtgggcctggccgacatgatgagccccggcgagagcaagctgcccctgcccctgaaggccgacggcaaggaggagggcaccccccagcccgagagcaagagcaaggacagctacagcagccagggcatcagccagccccccacccccggcaacctgcccgtgcccagccccatgagccccagcagcgccagcatcagcagcttccacggcgacgagagcgacagcatcagcagccccggctggcccaagacccccagcagccccaagagcagcagcagcaccaccaccggcgagaagatcaccaaggtgtacgagctgggcaacgagcccgagagaaagctgtgggtggacagatacctgaccttcatggaggagagaggcagccccgtgagcagcctgcccgccgtgggcaagaagcccctggacctgttcagactgtacgtgtgcgtgaaggagatcggcggcctggcccaggtgaacaagaacaagaagtggagagagctggccaccaacctgaacgtgggcaccagcagcagcgccgccagcagcctgaagaagcagtacatccagtacctgttcgccttcgagtgcaagatcgagagaggcgaggagcccccccccgaggtgttcagcaccggcgacaccaagaagcagcccaagctgcagccccccagccccgccaacagcggcagcctgcagggcccccagaccccccagagcaccggcagcaacagcatggccgaggtgcccggcgacctgaagccccccacccccgccagcaccccccacggccagatgacccccatgcagggcggcagaagcagcaccatcagcgtgcacgaccccttcagcgacgtgagcgacagcagcttccccaagagaaacagcatgacccccaacgccccctaccagcagggcatgagcatgcccgacgtgatgggcagaatgccctacgagcccaacaaggaccccttcggcggcatgagaaaggtgcccggcagcagcgagcccttcatgacccagggccagatgcccaacagcagcatgcaggacatgtacaaccagagccccagcggcgccatgagcaacctgggcatgggccagagacagcagttcccctacggcgccagctacgacagaagacacgagccctacggccagcagtaccccggccagggcccccccagcggccagcccccctacggcggccaccagcccggcctgtacccccagcagcccaactacaagagacacatggacggcatgtacggcccccccgccaagagacacgagggcgacatgtacaacatgcagtacagcagccagcagcaggagatgtacaaccagtacggcggcagctacagcggccccgacagaagacccatccagggccagtacccctacccctacagcagagagagaatgcagggccccggccagatccagacccacggcatccccccccagatgatgggcggccccctgcagagcagcagcagcgagggcccccagcagaacatgtgggccgccagaaacgacatgccctacccctaccagaacagacagggccccggcggccccacccaggcccccccctaccccggcatgaacagaaccgacgacatgatggtgcccgaccagagaatcaaccacgagagccagtggcccagccacgtgagccagagacagccctacatgagcagcagcgccagcatgcagcccatcaccagacccccccagcccagctaccagaccccccccagcctgcccaaccacatcagcagagcccccagccccgccagcttccagagaagcctggagaacagaatgagccccagcaagagccccttcctgcccagcatgaagatgcagaaggtgatgcccaccgtgcccaccagccaggtgaccggcccccccccccagcccccccccatcagaagagagatcaccttcccccccggcagcgtggaggccagccagcccgtgctgaagcagagaagaaagatcaccagcaaggacatcgtgacccccgaggcctggagagtgatgatgagcctgaagagcggcctgctggccgagagcacctgggccctggacaccatcaacatcctgctgtacgacgacagcaccgtggccaccttcaacctgagccagctgagcggcttcctggagctgctggtggagtacttcagaaagtgcctgatcgacatcttcggcatcctgatggagtacgaggtgggcgaccccagccagaaggccctggaccacaacgccgccagaaaggacgacagccagagcctggccgacgacagcggcaaggaggaggaggacgccgagtgcatcgacgacgacgaggaggacgaggaggacgaggaggaggacagcgagaagaccgagagcgacgagaagagcagcatcgccctgaccgcccccgacgccgccgccgaccccaaggagaagcccaagcaggccagcaagttcgacaagctgcccatcaagatcgtgaagaagaacaacctgttcgtggtggacagaagcgacaagctgggcagagtgcaggagttcaacagcggcctgctgcactggcagctgggcggcggcgacaccaccgagcacatccagacccacttcgagagcaagatggagatcccccccagaagaagaccccccccccccctgagcagcgccggcagaaagaaggagcaggagggcaagggcgacagcgaggagcagcaggagaagagcatcatcgccaccatcgacgacgtgctgagcgccagacccggcgccctgcccgaggacgccaaccccggcccccagaccgagagcagcaagttccccttcggcatccagcaggccaagagccacagaaacatcaagctgctggaggacgagcccagaagcagagacgagacccccctgtgcaccatcgcccactggcaggacagcctggccaagagatgcatctgcgtgagcaacatcgtgagaagcctgagcttcgtgcccggcaacgacgccgagatgagcaagcaccccggcctggtgctgatcctgggcaagctgatcctgctgcaccacgagcaccccgagagaaagagagccccccagacctacgagaaggaggaggacgaggacaagggcgtggcctgcagcaaggacgagtggtggtgggactgcctggaggtgctgagagacaacaccctggtgaccctggccaacatcagcggccagctggacctgagcgcctacaccgagagcatctgcctgcccatcctggacggcctgctgcactggatggtgtgccccagcgccgaggcccaggaccccttccccaccgtgggccccaacagcgtgctgagcccccagagactggtgctggagaccctgtgcaagctgagcatccaggacaacaacgtggacctgatcctggccaccccccccttcagcagacaggagaagttctacgccaccctggtgagatacgtgggcgacagaaagaaccccgtgtgcagagagatgagcatggccctgctgagcaacctggcccagggcgacgccctggccgccagagccatcgccgtgcagaagggcagcatcggcaacctgatcagcttcctggaggacggcgtgaccatggcccagtaccagcagagccagcacaacctgatgcacatgcagcccccccccctggagccccccagcgtggacatgatgtgcagagccgccaaggccctgctggccatggccagagtggacgagaacagaagcgagttcctgctgcacgagggcagactgctggacatcagcatcagcgccgtgctgaacagcctggtggccagcgtgatctgcgacgtgctgttccagatcggccagctgtag

SEQ ID NO: 7619 - DNA, 822 bp, Artificial Sequence
  Description of Artificial Sequence: Synthetic coding sequence
gccgccgtgatgcaggccgccgccaacagcgcccagagcagacagggcagcttccccggcatgaaccagagcggcctgatggccagcagcagcccctacagccagcccatgaacaacagcagcagcctgatgaacacccaggcccccccctacagcatggcccccgccatggtgaacagcagcgccgccagcgtgggcctggccgacatgatgagccccggcgagagcaagctgcccctgcccctgaaggccgacggcaaggaggagggcaccccccagcccgagagcaagagcaagaagagcagcagcagcaccaccaccggcgagaagatcaccaaggtgtacgagctgggcaacgagcccgagagaaagctgtgggtggacagatacctgaccttcatggaggagagaggcagccccgtgagcagcctgcccgccgtgggcaagaagcccctggacctgttcagactgtacgtgtgcgtgaaggagatcggcggcctggcccaggtgaacaagaacaagaagtggagagagctggccaccaacctgaacgtgggcaccagcagcagcgccgccagcagcctgaagaagcagtacatccagtacctgttcgccttcgagtgcaagatcgagagaggcgaggagcccccccccgaggtgttcagcaccggcgacaccaagaagcagcccaagctgcagccccccagccccggcaagtggagaagatgcagccactggcccagaaaggcccaggcccccggcctgggcggcagcggcaaggtggtgagccagagcggccagcagggcacctgggacttctag

SEQ ID NO: 7620 - DNA, 1053 bp, Artificial Sequence
  Description of Artificial Sequence: Synthetic coding sequence
atgagccaggagggctacggcaccagaagccagccccccctggcccccggcaagcccaaccacgaggacctgaacctgatccagcaggagagacccagcagcctgcccgtggaggtgctggccagcgaggacgccgccttcggcctgaaggacctgagcggcagcatcgacgacctgcccaccggcaccgaggccaccctgagcagcgccgtgagcgccagcggcagcaccagcagccagggcgaccagagcaaccccgcccagagccccttcagcccccacgccagcccccacctgagcagcatccccggcggccccagccccagccccgtgggcagccccgtgggcagcaaccagagcagaagcggccccatcagccccgccagcatccccggcagccagatgcccccccagccccccggcagccagagcgagagcagcagccaccccgccctgagccagagccccatgccccaggagagaggcttcatggccggcacccagagaaacccccagatggcccagtacggcccccagcagaccggccccagcatgagcccccaccccagccccggcggccagatgcacgccggcatcagcagcttccagcagagcaacagcagcggcacctacggcccccagatgagccagtacggcccccagggcaactacagcagaccccccgcctacagcggcgtgcccagcgccagctacagcggccccggccccggcatgggcatcagcgccaacaaccagatgcacggccagggccccagccagccctgcggcgccgtgcccctgggcagaatgcccagcgccggcatgcagaacagacccttccccggcaacatgagcagcatgacccccagcagccccggcatgagccagcagggcggccccggcatgggcccccccatgcccaccgtgaacagaaaggcccaggaggccgccgccgccgtgatgcaggccgccgccaacagcgcccagagcagatacgccacccaggagcacgcccccggcagatacgccgtgtgcctgcccgtgaccacctag

SEQ ID NO: 7621 - DNA, 5508 bp, Artificial Sequence
  Description of Artificial Sequence: Synthetic coding sequence
atggccaacagcaccggcaaggccccccccgacgagagaagaaagggcctggccttcctggacgagctgagacagttccaccacagcagaggcagccccttcaagaagatccccgccgtgggcggcaaggagctggacctgcacggcctgtacaccagagtgaccaccctgggcggcttcgccaaggtgagcgagaagaaccagtggggcgagatcgtggaggagttcaacttccccagaagctgcagcaacgccgccttcgccctgaagcagtactacctgagatacctggagaagtacgagaaggtgcaccacttcggcgaggacgacgacgaggtgccccccggcaaccccaagccccagctgcccatcggcgccatccccagcagctacaactaccagcagcacagcgtgagcgactacctgagacagagctacggcctgagcatggacttcaacagccccaacgactacaacaagctggtgctgagcctgctgagcggcctgcccaacgaggtggacttcgccatcaacgtgtgcaccctgctgagcaacgagagcaagcacgtgatgcagctggagaaggaccccaagatcatcaccctgctgctggccaacgccggcgtgttcgacgacaccctgggcagcttcagcaccgtgttcggcgaggagtggaaggagaagaccgacagagacttcgtgaagttctggaaggacatcgtggacgacaacgaggtgagagacctgatcagcgacagaaacaagagccacgagggcaccagcggcgagtggatctgggagagcctgttccacccccccagaaagctgggcatcaacgacatcgagggccagagagtgctgcagatcgccgtgatcctgagaaacctgagcttcgaggagggcaacgtgaagctgctggccgccaacagaacctgcctgagattcctgctgctgagcgcccacagccacttcatcagcctgagacagctgggcctggacaccctgggcaacatcgccgccgagctgctgctggaccccgtggacttcaagaccacccacctgatgttccacaccgtgaccaagtgcctgatgagcagagacagattcctgaagatgagaggcatggagatcctgggcaacctgtgcaaggccgaggacaacggcgtgctgatctgcgagtacgtggaccaggacagctacagagagatcatctgccacctgaccctgcccgacgtgctgctggtgatcagcaccctggaggtgctgtacatgctgaccgagatgggcgacgtggcctgcaccaagatcgccaaggtggagaagagcatcgacatgctggtgtgcctggtgagcatggacatccagatgttcggccccgacgccctggccgccgtgaagctgatcgagcaccccagcagcagccaccagatgctgagcgagatcagaccccaggccatcgagcaggtgcagacccagacccacgtggccagcgcccccgccagcagagccgtggtggcccagcacgtggcccccccccccggcatcgtggagatcgacagcgagaagttcgcctgccagtggctgaacgcccacttcgaggtgaaccccgactgcagcgtgagcagagccgagatgtacagcgagtacctgagcacctgcagcaagctggccagaggcggcatcctgaccagcaccggcttctacaagtgcctgagaaccgtgttccccaaccacaccgtgaagagagtggaggacagcagcagcaacggccaggcccacatccacgtggtgggcgtgaagagaagagccatccccctgcccatccagatgtactaccagcagcagcccgtgagcaccagcgtggtgagagtggacagcgtgcccgacgtgagccccgcccccagccccgccggcatcccccacggcagccagaccatcggcaaccacttccagagaacccccgtggccaaccagagcagcaacctgaccgccacccagatgagcttccccgtgcagggcgtgcacaccgtggcccagaccgtgagcagaatcccccagaaccccagcccccacacccaccagcagcagaacgcccccgtgaccgtgatccagagcaaggcccccatcccctgcgaggtggtgaaggccaccgtgatccagaacagcatcccccagaccggcgtgcccgtgagcatcgccgtgggcggcggccccccccagagcagcgtggtgcagaaccacagcaccggcccccagcccgtgaccgtggtgaacagccagaccctgctgcaccaccccagcgtgatcccccagcagagccccctgcacaccgtggtgcccggccagatccccagcggcacccccgtgaccgtgatccagcaggccgtgccccagagccacatgttcggcagagtgcagaacatccccgcctgcaccagcaccgtgagccagggccagcagctgatcaccaccagcccccagcccgtgcagaccagcagccagcagaccagcgccggcagccagagccaggacaccgtgatcatcgcccccccccagtacgtgaccaccagcgccagcaacatcgtgagcgccaccagcgtgcagaacttccaggtggccaccggccagatggtgaccatcgccggcgtgcccagcccccaggccagcagagtgggcttccagaacatcgcccccaagcccctgcccagccagcaggtgagcagcaccgtggtgcagcagcccatccagcagccccagcagcccacccagcagagcgtggtgatcgtgagccagcccgcccagcagggccagacctacgcccccgccatccaccagatcgtgctggccaaccccgccgccctgcccgccggccagaccgtgcagctgaccggccagcccaacatcacccccagcagcagccccagccccgtgcccgccaccaacaaccaggtgcccaccgccatgagcagcagcagcaccccccagagccagggccccccccccaccgtgagccagatgctgagcgtgaagagacagcagcagcagcagcacagccccgccccccccccccagcaggtgcaggtgcaggtgcagcagccccagcaggtgcagatgcaggtgcagccccagcagagcaacgccggcgtgggccagcccgccagcggcgagagcagcctgatcaagcagctgctgctgcccaagagaggccccagcacccccggcggcaagctgatcctgcccgccccccagatccccccccccaacaacgccagagcccccagcccccaggtggtgtaccaggtggccagcaaccaggccgccggcttcggcgtgcagggccagacccccgcccagcagctgctggtgggccagcagaacgtgcagctggtgcccagcgccatgccccccagcggcggcgtgcagaccgtgcccatcagcaacctgcagatcctgcccggccccctgatcagcaacagccccgccaccatcttccagggcaccagcggcaaccaggtgaccatcaccgtggtgcccaacaccagcttcgcccccgccaccgtgagccagggcaacgccacccagctgatcgcccccgccggcatcaccatgagcggcacccagaccggcgtgggcctgcccgtgcagaccctgcccgccacccaggccagccccgccggccagagcagctgcaccaccgccaccccccccttcaagggcgacaagatcatctgccagaaggaggaggaggccaaggaggccaccggcctgcacgtgcacgagagaaagatcgaggtgatggagaaccccagctgcagaagaggcgccaccaacaccagcaacggcgacaccaaggagaacgagatgcacgtgggcagcctgctgaacggcagaaagtacagcgacagcagcctgccccccagcaacagcggcaagatccagagcgagaccaaccagtgcagcctgatcagcaacggccccagcctggagctgggcgagaacggcgccagcggcaagcagaacagcgagcagatcgacatgcaggacatcaagagcgacctgagaaagcccctggtgaacggcatctgcgacttcgacaagggcgacggcagccacctgagcaagaacatccccaaccacaagaccagcaaccacgtgggcaacggcgagatcagccccatggagccccagggcaccctggacatcacccagcaggacaccgccaagggcgaccagctggagagaatcagcaacggccccgtgctgaccctgggcggcagcagcgtgagcagcatccaggaggccagcaacgccgccacccagcagttcagcggcaccgacctgctgaacggccccctggccagcagcctgaacagcgacgtgccccagcagagacccagcgtggtggtgagcccccacagcaccaccagcgtgatccagggccaccagatcatcgccgtgcccgacagcggcagcaaggtgagccacagccccgccctgagcagcgacgtgagaagcaccaacggcaccgccgagtgcaagaccgtgaagagacccgccgaggacaccgacagagagaccgtggccggcatccccaacaaggtgggcgtgagaatcgtgaccatcagcgaccccaacaacgccggctgcagcgccaccatggtggccgtgcccgccggcgccgaccccagcaccgtggccaaggtggccatcgagagcgccgtgcagcagaagcagcagcacccccccacctacgtgcagaacgtggtgccccagaacacccccatgccccccagccccgccgtgcaggtgcagggccagcccaacagcagccagcccagccccttcagcggcagcagccagcccggcgaccccatgagaaagcccggccagaacttcatgtgcctgtggcagagctgcaagaagtggttccagacccccagccaggtgttctaccacgccgccaccgagcacggcggcaaggacgtgtaccccggccagtgcctgtgggagggctgcgagcccttccagagacagagattcagcttcatcacccacctgcaggacaagcactgcagcaaggacgccctgctggccggcctgaagcaggacgagcccggccaggccggcagccagaagagcagcaccaagcagcccaccgtgggcggcaccagcagcacccccagagcccagaaggccatcgtgaaccaccccagcgccgccctgatggccctgagaagaggcagcagaaacctggtgttcagagacttcaccgacgagaaggagggccccatcaccaagcacatcagactgaccgccgccctgatcctgaagaacatcggcaagtacagcgagtgcggcagaagactgctgaagagacacgagaacaacctgagcgtgctggccatcagcaacatggaggccagcagcaccctggccaagtgcctgtacgagctgaacttcaccgtgcagagcaaggagcaggagaaggacagcgagatgctgcagtag

SEQ ID NO: 7622 - DNA, 2859 bp, Artificial Sequence
  Description of Artificial Sequence: Synthetic coding sequence
atgatgatgagataccaccaggccatccagagccacagcttcctgctggtgcagttccacctgcccaccatcaccagcaacaccgtgtgcagaatcatctgcgtgaaggtgatgggctgcccctggaccctgatcagacagatgatcatcatcaactggtgcttccactgctacctggacagccagatgaagtggaccctgctgctgacctacgccctgagctaccagatgaaggccagcaccagctgcaacctgaagaagatcctgaagagcagccccgtgcccgccaccaacaaccaggtgcccaccgccatgagcagcagcagcaccccccagagccagggccccccccccaccgtgagccagatgctgagcgtgaagagacagcagcagcagcagcacagccccgccccccccccccagcaggtgcaggtgcaggtgcagcagccccagcaggtgcagatgcaggtgcagccccagcagagcaacgccggcgtgggccagcccgccagcggcgagagcagcctgatcaagcagctgctgctgcccaagagaggccccagcacccccggcggcaagctgatcctgcccgccccccagatccccccccccaacaacgccagagcccccagcccccaggtggtgtaccaggtggccagcaaccaggccgccggcttcggcgtgcagggccagacccccgcccagcagctgctggtgggccagcagaacgtgcagctggtgcccagcgccatgccccccagcggcggcgtgcagaccgtgcccatcagcaacctgcagatcctgcccggccccctgatcagcaacagccccgccaccatcttccagggcaccagcggcaaccaggtgaccatcaccgtggtgcccaacaccagcttcgcccccgccaccgtgagccagggcaacgccacccagctgatcgcccccgccggcatcaccatgagcggcacccagaccggcgtgggcctgcccgtgcagaccctgcccgccacccaggccagccccgccggccagagcagctgcaccaccgccaccccccccttcaagggcgacaagatcatctgccagaaggaggaggaggccaaggaggccaccggcctgcacgtgcacgagagaaagatcgaggtgatggagaaccccagctgcagaagaggcgccaccaacaccagcaacggcgacaccaaggagaacgagatgcacgtgggcagcctgctgaacggcagaaagtacagcgacagcagcctgccccccagcaacagcggcaagatccagagcgagaccaaccagtgcagcctgatcagcaacggccccagcctggagctgggcgagaacggcgccagcggcaagcagaacagcgagcagatcgacatgcaggacatcaagagcgacctgagaaagcccctggtgaacggcatctgcgacttcgacaagggcgacggcagccacctgagcaagaacatccccaaccacaagaccagcaaccacgtgggcaacggcgagatcagccccatggagccccagggcaccctggacatcacccagcaggacaccgccaagggcgaccagctggagagaatcagcaacggccccgtgctgaccctgggcggcagcagcgtgagcagcatccaggaggccagcaacgccgccacccagcagttcagcggcaccgacctgctgaacggccccctggccagcagcctgaacagcgacgtgccccagcagagacccagcgtggtggtgagcccccacagcaccaccagcgtgatccagggccaccagatcatcgccgtgcccgacagcggcagcaaggtgagccacagccccgccctgagcagcgacgtgagaagcaccaacggcaccgccgagtgcaagaccgtgaagagacccgccgaggacaccgacagagagaccgtggccggcatccccaacaaggtgggcgtgagaatcgtgaccatcagcgaccccaacaacgccggctgcagcgccaccatggtggccgtgcccgccggcgccgaccccagcaccgtggccaaggtggccatcgagagcgccgtgcagcagaagcagcagcacccccccacctacgtgcagaacgtggtgccccagaacacccccatgccccccagccccgccgtgcaggtgcagggccagcccaacagcagccagcccagccccttcagcggcagcagccagcccggcgaccccatgagaaagcccggccagaacttcatgtgcctgtggcagagctgcaagaagtggttccagacccccagccaggtgttctaccacgccgccaccgagcacggcggcaaggacgtgtaccccggccagtgcctgtgggagggctgcgagcccttccagagacagagattcagcttcatcacccacctgcaggacaagcactgcagcaaggacgccctgctggccggcctgaagcaggacgagcccggccaggccggcagccagaagagcagcaccaagcagcccaccgtgggcggcaccagcagcacccccagagcccagaaggccatcgtgaaccaccccagcgccgccctgatggccctgagaagaggcagcagaaacctggtgttcagagacttcaccgacgagaaggagggccccatcaccaagcacatcagactgaccgccgccctgatcctgaagaacatcggcaagtacagcgagtgcggcagaagactgctgaagagacacgagaacaacctgagcgtgctggccatcagcaacatggaggccagcagcaccctggccaagtgcctgtacgagctgaacttcaccgtgcagagcaaggagcaggagaaggacagcgagatgctgcagtag

SEQ ID NO: 7623 - DNA, 4338 bp, Artificial Sequence
  Description of Artificial Sequence: Synthetic coding sequence
atgagaggcatggagatcctgggcaacctgtgcaaggccgaggacaacggcgtgctgatctgcgagtacgtggaccaggacagctacagagagatcatctgccacctgaccctgcccgacgtgctgctggtgatcagcaccctggaggtgctgtacatgctgaccgagatgggcgacgtggcctgcaccaagatcgccaaggtggagaagagcatcgccgccgtgaagctgatcgagcaccccagcagcagccaccagatgctgagcgagatcagaccccaggccatcgagcaggtgcagacccagacccacgtggccagcgcccccgccagcagagccgtggtggcccagcacgtggcccccccccccggcatcgtggagatcgacagcgagaagttcgcctgccagtggctgaacgcccacttcgaggtgaaccccgactgcagcgtgagcagagccgagatgtacagcgagtacctgagcacctgcagcaagctggccagaggcggcatcctgaccagcaccggcttctacaagtgcctgagaaccgtgttccccaaccacaccgtgaagagagtggaggacagcagcagcaacggccaggcccacatccacgtggtgggcgtgaagagaagagccatccccctgcccatccagatgtactaccagcagcagcccgtgagcaccagcgtggtgagagtggacagcgtgcccgacgtgagccccgcccccagccccgccggcatcccccacggcagccagaccatcggcaaccacttccagagaacccccgtggccaaccagagcagcaacctgaccgccacccagatgagcttccccgtgcagggcgtgcacaccgtggcccagaccgtgagcagaatcccccagaaccccagcccccacacccaccagcagcagaacgcccccgtgaccgtgatccagagcaaggcccccatcccctgcgaggtggtgaaggccaccgtgatccagaacagcatcccccagaccggcgtgcccgtgagcatcgccgtgggcggcggccccccccagagcagcgtggtgcagaaccacagcaccggcccccagcccgtgaccgtggtgaacagccagaccctgctgcaccaccccagcgtgatcccccagcagagccccctgcacaccgtggtgcccggccagatccccagcggcacccccgtgaccgtgatccagcaggccgtgccccagagccacatgttcggcagagtgcagaacatccccgcctgcaccagcaccgtgagccagggccagcagctgatcaccaccagcccccagcccgtgcagaccagcagccagcagaccagcgccggcagccagagccaggacaccgtgatcatcgcccccccccagtacgtgaccaccagcgccagcaacatcgtgagcgccaccagcgtgcagaacttccaggtggccaccggccagatggtgaccatcgccggcgtgcccagcccccaggccagcagagtgggcttccagaacatcgcccccaagcccctgcccagccagcaggtgagcagcaccgtggtgcagcagcccatccagcagccccagcagcccacccagcagagcgtggtgatcgtgagccagcccgcccagcagggccagacctacgcccccgccatccaccagatcgtgctggccaaccccgccgccctgcccgccggccagaccgtgcagctgaccggccagcccaacatcacccccagcagcagccccagccccgtgcccgccaccaacaaccaggtgcccaccgccatgagcagcagcagcaccccccagagccagggccccccccccaccgtgagccagatgctgagcgtgaagagacagcagcagcagcagcacagccccgccccccccccccagcaggtgcaggtgcaggtgcagcagccccagcaggtgcagatgcaggtgcagccccagcagagcaacgccggcgtgggccagcccgccagcggcgagagcagcctgatcaagcagctgctgctgcccaagagaggccccagcacccccggcggcaagctgatcctgcccgccccccagatccccccccccaacaacgccagagcccccagcccccaggtggtgtaccaggtggccagcaaccaggccgccggcttcggcgtgcagggccagacccccgcccagcagctgctggtgggccagcagaacgtgcagctggtgcccagcgccatgccccccagcggcggcgtgcagaccgtgcccatcagcaacctgcagatcctgcccggccccctgatcagcaacagccccgccaccatcttccagggcaccagcggcaaccaggtgaccatcaccgtggtgcccaacaccagcttcgcccccgccaccgtgagccagggcaacgccacccagctgatcgcccccgccggcatcaccatgagcggcacccagaccggcgtgggcctgcccgtgcagaccctgcccgccacccaggccagccccgccggccagagcagctgcaccaccgccaccccccccttcaagggcgacaagatcatctgccagaaggaggaggaggccaaggaggccaccggcctgcacgtgcacgagagaaagatcgaggtgatggagaaccccagctgcagaagaggcgccaccaacaccagcaacggcgacaccaaggagaacgagatgcacgtgggcagcctgctgaacggcagaaagtacagcgacagcagcctgccccccagcaacagcggcaagatccagagcgagaccaaccagtgcagcctgatcagcaacggccccagcctggagctgggcgagaacggcgccagcggcaagcagaacagcgagcagatcgacatgcaggacatcaagagcgacctgagaaagcccctggtgaacggcatctgcgacttcgacaagggcgacggcagccacctgagcaagaacatccccaaccacaagaccagcaaccacgtgggcaacggcgagatcagccccatggagccccagggcaccctggacatcacccagcaggacaccgccaagggcgaccagctggagagaatcagcaacggccccgtgctgaccctgggcggcagcagcgtgagcagcatccaggaggccagcaacgccgccacccagcagttcagcggcaccgacctgctgaacggccccctggccagcagcctgaacagcgacgtgccccagcagagacccagcgtggtggtgagcccccacagcaccaccagcgtgatccagggccaccagatcatcgccgtgcccgacagcggcagcaaggtgagccacagccccgccctgagcagcgacgtgagaagcaccaacggcaccgccgagtgcaagaccgtgaagagacccgccgaggacaccgacagagagaccgtggccggcatccccaacaaggtgggcgtgagaatcgtgaccatcagcgaccccaacaacgccggctgcagcgccaccatggtggccgtgcccgccggcgccgaccccagcaccgtggccaaggtggccatcgagagcgccgtgcagcagaagcagcagcacccccccacctacgtgcagaacgtggtgccccagaacacccccatgccccccagccccgccgtgcaggtgcagggccagcccaacagcagccagcccagccccttcagcggcagcagccagcccggcgaccccatgagaaagcccggccagaacttcatgtgcctgtggcagagctgcaagaagtggttccagacccccagccaggtgttctaccacgccgccaccgagcacggcggcaaggacgtgtaccccggccagtgcctgtgggagggctgcgagcccttccagagacagagattcagcttcatcacccacctgcaggacaagcactgcagcaaggacgccctgctggccggcctgaagcaggacgagcccggccaggccggcagccagaagagcagcaccaagcagcccaccgtgggcggcaccagcagcacccccagagcccagaaggccatcgtgaaccaccccagcgccgccctgatggccctgagaagaggcagcagaaacctggtgttcagagacttcaccgacgagaaggagggccccatcaccaagcacatcagactgaccgccgccctgatcctgaagaacatcggcaagtacagcgagtgcggcagaagactgctgaagagacacgagaacaacctgagcgtgctggccatcagcaacatggaggccagcagcaccctggccaagtgcctgtacgagctgaacttcaccgtgcagagcaaggagcaggagaaggacagcgagatgctgcagtag

SEQ ID NO: 7624 - DNA, 2859 bp, Artificial Sequence; identical to SEQ ID NO: 7622
  Description of Artificial Sequence: Synthetic coding sequence

SEQ ID NO: 7625 - DNA, 1044 bp, Artificial Sequence
  Description of Artificial Sequence: Synthetic coding sequence
atgaagatggaggagatgagcctgagcggcctggacaacagcaagctggaggccatcgcccaggagatctacgccgacctggtggaggacagctgcctgggcttctgcttcgaggtgcacagagccgtgaagtgcggctacttcttcctggacgacaccgaccccgacagcatgaaggacttcgagatcgtggaccagcccggcctggacatcttcggccaggtgttcaaccagtggaagagcaaggagtgcgtgtgccccaactgcagcagaagcatcgccgccagcagattcgccccccacctggagaagtgcctgggcatgggcagaaacagcagcagaatcgccaacagaagaatcgccaacagcaacaacatgaacaagagcgagagcgaccaggaggacaacgacgacatcaacgacaacgactggagctacggcagcgagaagaaggccaagaagagaaagagcgacaagaaccccaacagccccagaagaagcaagagcctgaagcacaagaacggcgagctgagcaacagcgaccccttcaagtacaacaacagcaccggcatcagctacgagaccctgggccccgaggagctgagaagcctgctgaccacccagtgcggcgtgatcagcgagcacaccaagaagatgtgcaccagaagcctgagatgcccccagcacaccgacgagcagagaagaaccgtgagaatctacttcctgggccccagcgccgtgctgcccgaggtggagagcagcctggacaacgacagcttcgacatgaccgacagccaggccctgatcagcagactgcagtgggacggcagcagcgacctgagccccagcgacagcggcagcagcaagaccagcgagaaccagggctggggcctgggcaccaacagcagcgagagcagaaagaccaagaagaagaagagccacctgagcctggtgggcaccgccagcggcctgggcagcaacaagaagaagaagcccaagccccccgccccccccacccccagcatctacgacgacatcaactag

SEQ ID NO: 7626 - DNA, 1065 bp, Artificial Sequence
  Description of Artificial Sequence: Synthetic coding sequence
atgaagatggaggagatgagcctgagcggcctggacaacagcaagctggaggccatcgcccaggagatctacgccgacctggtggaggacagctgcctgggcttctgcttcgaggtgcacagagccgtgaagtgcggctacttcttcctggacgacaccgaccccgacagcatgaaggacttcgagatcgtggaccagcccggcctggacatcttcggccaggtgttcaaccagtggaagagcaaggagtgcgtgtgccccaactgcagcagaagcatcgccgccagcagattcgccccccacctggagaagtgcctgggcatgggcagaaacagcagcagaatcgccaacagaagaatcgccaacagcaacaacatgaacaagagcgagagcgaccaggaggacaacgacgacatcaacgacaacgactggagctacggcagcgagaagaaggccaagaagagaaagagcgacaagctgtggtacctgcccttccagaaccccaacagccccagaagaagcaagagcctgaagcacaagaacggcgagctgagcaacagcgaccccttcaagtacaacaacagcaccggcatcagctacgagaccctgggccccgaggagctgagaagcctgctgaccacccagtgcggcgtgatcagcgagcacaccaagaagatgtgcaccagaagcctgagatgcccccagcacaccgacgagcagagaagaaccgtgagaatctacttcctgggccccagcgccgtgctgcccgaggtggagagcagcctggacaacgacagcttcgacatgaccgacagccaggccctgatcagcagactgcagtgggacggcagcagcgacctgagccccagcgacagcggcagcagcaagaccagcgagaaccagggctggggcctgggcaccaacagcagcgagagcagaaagaccaagaagaagaagagccacctgagcctggtgggcaccgccagcggcctgggcagcaacaagaagaagaagcccaagccccccgccccccccacccccagcatctacgacgacatcaactag

SEQ ID NO: 7627 - DNA, 390 bp, Artificial Sequence
  Description of Artificial Sequence: Synthetic coding sequence
atgtgcaccagaagcctgagatgcccccagcacaccgacgagcagagaagaaccgtgagaatctacttcctgggccccagcgccgtgctgcccgaggtggagagcagcctggacaacgacagcttcgacatgaccgacagccaggccctgatcagcagactgcagtgggacggcagcagcgacctgagccccagcgacagcggcagcagcaagaccagcgagaaccagggctggggcctgggcaccaacagcagcgagagcagaaagaccaagaagaagaagagccacctgagcctggtgggcaccgccagcggcctgggcagcaacaagaagaagaagcccaagccccccgccccccccacccccagcatctacgacgacatcaactag

SEQ ID NO: 7628 - DNA, 5031 bp, Artificial Sequence
  Description of Artificial Sequence: Synthetic coding sequence
atgggcctgctgggcatcctgtgcttcctgatcttcctgggcaagacctggggccaggagcagacctacgtgatcagcgcccccaagatcttcagagtgggcgccagcgagaacatcgtgatccaggtgtacggctacaccgaggccttcgacgccaccatcagcatcaagagctaccccgacaagaagttcagctacagcagcggccacgtgcacctgagcagcgagaacaagttccagaacagcgccatcctgaccatccagcccaagcagctgcccggcggccagaaccccgtgagctacgtgtacctggaggtggtgagcaagcacttcagcaagagcaagagaatgcccatcacctacgacaacggcttcctgttcatccacaccgacaagcccgtgtacacccccgaccagagcgtgaaggtgagagtgtacagcctgaacgacgacctgaagcccgccaagagagagaccgtgctgaccttcatcgaccccgagggcagcgaggtggacatggtggaggagatcgaccacatcggcatcatcagcttccccgacttcaagatccccagcaaccccagatacggcatgtggaccatcaaggccaagtacaaggaggacttcagcaccaccggcaccgcctacttcgaggtgaaggagtacgtgctgccccacttcagcgtgagcatcgagcccgagtacaacttcatcggctacaagaacttcaagaacttcgagatcaccatcaaggccagatacttctacaacaaggtggtgaccgaggccgacgtgtacatcaccttcggcatcagagaggacctgaaggacgaccagaaggagatgatgcagaccgccatgcagaacaccatgctgatcaacggcatcgcccaggtgaccttcgacagcgagaccgccgtgaaggagctgagctactacagcctggaggacctgaacaacaagtacctgtacatcgccgtgaccgtgatcgagagcaccggcggcttcagcgaggaggccgagatccccggcatcaagtacgtgctgagcccctacaagctgaacctggtggccacccccctgttcctgaagcccggcatcccctaccccatcaaggtgcaggtgaaggacagcctggaccagctggtgggcggcgtgcccgtgaccctgaacgcccagaccatcgacgtgaaccaggagaccagcgacctggaccccagcaagagcgtgaccagagtggacgacggcgtggccagcttcgtgctgaacctgcccagcggcgtgaccgtgctggagttcaacgtgaagaccgacgcccccgacctgcccgaggagaaccaggccagagagggctacagagccatcgcctacagcagcctgagccagagctacctgtacatcgactggaccgacaaccacaaggccctgctggtgggcgagcacctgaacatcatcgtgacccccaagagcccctacatcgacaagatcacccactacaactacctgatcctgagcaagggcaagatcatccacttcggcaccagagagaagttcagcgacgccagctaccagagcatcaacatccccgtgacccagaacatggtgcccagcagcagactgctggtgtactacatcgtgaccggcgagcagaccgccgagctggtgagcgacagcgtgtggctgaacatcgaggagaagtgcggcaaccagctgcaggtgcacctgagccccgacgccgacgcctacagccccggccagaccgtgagcctgaacatggccaccggcatggacagctgggtggccctggccgccgtggacagcgccgtgtacggcgtgcagagaggcgccaagaagcccctggagagagtgttccagttcctggagaagagcgacctgggctgcggcgccggcggcggcctgaacaacgccaacgtgttccacctggccggcctgaccttcctgaccaacgccaacgccgacgacagccaggagaacgacgagccctgcaaggagatcctgagacccagaagaaccctgcagaagaagatcgaggagatcgccgccaagtacaagcacagcgtggtgaagaagtgctgctacgacggcgcctgcgtgaacaacgacgagacctgcgagcagagagccgccagaatcagcctgggccccagatgcatcaaggccttcaccgagtgctgcgtggtggccagccagctgagagccaacatcagccacaaggacatgcagctgggcagactgcacatgaagaccctgctgcccgtgagcaagcccgagatcagaagctacttccccgagagctggctgtgggaggtgcacctggtgcccagaagaaagcagctgcagttcgccctgcccgacagcctgaccacctgggagatccagggcgtgggcatcagcaacaccggcatctgcgtggccgacaccgtgaaggccaaggtgttcaaggacgtgttcctggagatgaacatcccctacagcgtggtgagaggcgagcagatccagctgaagggcaccgtgtacaactacagaaccagcggcatgcagttctgcgtgaagatgagcgccgtggagggcatctgcaccagcgagagccccgtgatcgaccaccagggcaccaagagcagcaagtgcgtgagacagaaggtggagggcagcagcagccacctggtgaccttcaccgtgctgcccctggagatcggcctgcacaacatcaacttcagcctggagacctggttcggcaaggagatcctggtgaagaccctgagagtggtgcccgagggcgtgaagagagagagctacagcggcgtgaccctggaccccagaggcatctacggcaccatcagcagaagaaaggagttcccctacagaatccccctggacctggtgcccaagaccgagatcaagagaatcctgagcgtgaagggcctgctggtgggcgagatcctgagcgccgtgctgagccaggagggcatcaacatcctgacccacctgcccaagggcagcgccgaggccgagctgatgagcgtggtgcccgtgttctacgtgttccactacctggagaccggcaaccactggaacatcttccacagcgaccccctgatcgagaagcagaagctgaagaagaagctgaaggagggcatgctgagcatcatgagctacagaaacgccgactacagctacagcgtgtggaagggcggcagcgccagcacctggctgaccgccttcgccctgagagtgctgggccaggtgaacaagtacgtggagcagaaccagaacagcatctgcaacagcctgctgtggctggtggagaactaccagctggacaacggcagcttcaaggagaacagccagtaccagcccatcaagctgcagggcaccctgcccgtggaggccagagagaacagcctgtacctgaccgccttcaccgtgatcggcatcagaaaggccttcgacatctgccccctggtgaagatcgacaccgccctgatcaaggccgacaacttcctgctggagaacaccctgcccgcccagagcaccttcaccctggccatcagcgcctacgccctgagcctgggcgacaagacccacccccagttcagaagcatcgtgagcgccctgaagagagaggccctggtgaagggcaacccccccatctacagattctggaaggacaacctgcagcacaaggacagcagcgtgcccaacaccggcaccgccagaatggtggagaccaccgcctacgccctgctgaccagcctgaacctgaaggacatcaactacgtgaaccccgtgatcaagtggctgagcgaggagcagagatacggcggcggcttctacagcacccaggacaccatcaacgccatcgagggcctgaccgagtacagcctgctggtgaagcagctgagactgagcatggacatcgacgtgagctacaagcacaagggcgccctgcacaactacaagatgaccgacaagaacttcctgggcagacccgtggaggtgctgctgaacgacgacctgatcgtgagcaccggcttcggcagcggcctggccaccgtgcacgtgaccaccgtggtgcacaagaccagcaccagcgaggaggtgtgcagcttctacctgaagatcgacacccaggacatcgaggccagccactacagaggctacggcaacagcgactacaagagaatcgtggcctgcgccagctacaagcccagcagagaggagagcagcagcggcagcagccacgccgtgatggacatcagcctgcccaccggcatcagcgccaacgaggaggacctgaaggccctggtggagggcgtggaccagctgttcaccgactaccagatcaaggacggccacgtgatcctgcagctgaacagcatccccagcagcgacttcctgtgcgtgagattcagaatcttcgagctgttcgaggtgggcttcctgagccccgccaccttcaccgtgtacgagtaccacagacccgacaagcagtgcaccatgttctacagcaccagcaacatcaagatccagaaggtgtgcgagggcgccgcctgcaagtgcgtggaggccgactgcggccagatgcaggaggagctggacctgaccatcagcgccgagaccagaaagcagaccgcctgcaagcccgagatcgcctacgcctacaaggtgagcatcaccagcatcaccgtggagaacgtgttcgtgaagtacaaggccaccctgctggacatctacaagaccggcgaggccgtggccgagaaggacagcgagatcaccttcatcaagaaggtgacctgcaccaacgccgagctggtgaagggcagacagtacctgatcatgggcaaggaggccctgcagatcaagtacaacttcagcttcagatacatctaccccctggacagcctgacctggatcgagtactggcccagagacaccacctgcagcagctgccaggccttcctggccaacctggacgagttcgccgaggacatcttcctgaacggctgctag

SEQ ID NO: 7629 - DNA, 4320 bp, Artificial Sequence
  Description of Artificial Sequence: Synthetic coding sequence
atggccagcagcgagaccgagatcagatgggccgagcccggcctgggcaagggcccccagagaagaagatgggcctgggccgaggacaagagagacgtggacagaagcagcagccagagctgggaggaggagagactgttccccaacgccaccagccccgagctgctggaggacttcagactggcccagcagcacctgccccccctggagtgggacccccacccccagcccgacggccaccaggacagcgagagcggcgagaccagcggcgaggaggccgaggccgaggacgtggacagccccgccagcagccacgagcccctggcctggctgccccagcagggcagacagctggacatgaccgaggaggagcccgacggcaccctgggcagcctggaggtggaggaggccggcgagagcagcagcagactgggctacgaggccggcctgagcctggagggccacggcaacaccagccccatggccctgggccacggccaggccagaggctgggtggccagcggcgagcaggccagcggcgacaagctgagcgagcacagcgaggtgaaccccagcgtggagctgagccccgccagaagctggagcagcggcaccgtgagcctggaccaccccagcgacagcctggacagcacctgggagggcgagaccgacggcccccagcccaccgccctggccgagaccctgcccgagggccccagccaccacctgctgagccccgacggcagaaccggcggcagcgtggccagagccacccccatggagttccaggacagcagcgccccccccgcccagagcccccagcacgccaccgacagatggagaagagagaccaccagattcttctgcccccagcccaaggagcacatctggaagcagaccaagaccagccccaagcccctgcccagcagattcatcggcagcatcagccccctgaacccccagcccagacccaccagacagggcagacccctgcccagacagggcgccaccctggccggcagaagcagcagcaacgcccccaagtacggcagaggccagctgaactaccccctgcccgacttcagcaaggtgggccccagagtgagattccccaaggacgagagctacagaccccccaagagcagaagccacaacagaaagccccaggcccccgccagacccctgatcttcaagagccccgccgagatcgtgcaggaggtgctgctgagcagcggcgaggccgccctggccaaggacaccccccccgcccaccccatcaccagagtgccccaggagttccagacccccgagcaggccaccgagctggtgcaccagctgcaggaggactaccacagactgctgaccaagtacgccgaggccgagaacaccatcgaccagctgagactgggcgccaaggtgaacctgttcagcgaccccccccagcccaaccacagcatccacaccggcatggtgccccagggcaccaaggtgctgagcttcaccatcccccagcccagaagcgccgagtggtggcccggccccgccgaggacccccaggccagcgccgccagcggctggcccagcgccagaggcgacctgagccccagcagcctgaccagcatgcccaccctgggctggctgcccgagaacagagacatcagcgaggaccagagcagcgccgagcagacccaggccctggccagccaggccagccagttcctggccaaggtggagagcttcgagagactgatccaggccggcagactgatgccccaggaccaggtgaagggcttccagagactgaaggccgcccacgccgccctggaggaggagtacctgaaggcctgcagagagcagcaccccgcccagcccctggccggcagcaagggcacccccggcagattcgaccccagaagagagctggaggccgagatctacagactgggcagctgcctggaggagctgaaggagcacatcgaccagacccagcaggagcccgagccccccggcagcgacagcgccctggacagcacccccgccctgccctgcctgcaccagcccacccacctgcccgcccccagcggccaggcccccatgcccgccatcaagaccagctgccccgagcccgccaccaccaccgccgccgccagcaccggcccctgccccctgcacgtgaacgtggaggtgagcagcggcaacagcgaggtggaggacagaccccaggaccccctggccagactgagacacaaggagctgcagatggagcaggtgtaccacggcctgatggagagatacctgagcgtgaagagcctgcccgaggccatgagaatggaggaggaggaggagggcgaggaggaggaggaggaggagggcggcggcgacagcctggaggtggacggcgtggccgccacccccggcaaggccgaggccaccagagtgctgcccagacagtgccccgtgcaggccgagaagagccacggcgcccccctggaggaggccaccgagaagatggtgagcatgaagccccccggcttccaggccagcctggccagagacggccacatgagcggcctgggcaaggccgaggccgccccccccggccccggcgtgcccccccacccccccggcaccaagagcgccgccagccaccagagcagcatgaccagcctggagggcagcggcatcagcgagagactgccccagaagcccctgcacagaggcggcggcccccacctggaggagacctggatggccagccccgagaccgacagcggcttcgtgggcagcgagaccagcagagtgagccccctgacccagacccccgagcacagactgagccacatcagcaccgccggcaccctggcccagcccttcgccgccagcgtgcccagagacggcgccagctaccccaaggccagaggcagcctgatccccagaagagccaccgagcccagcacccccagaagccaggcccagagatacctgagcagccccagcggccccctgagacagagagcccccaacttcagcctggagagaaccctggccgccgagatggccgtgcccggcagcgagttcgagggccacaagagaatcagcgagcagcccctgcccaacaagaccatcagccccccccccgcccccgcccccgccgccgcccccctgccctgcggccccaccgagaccatccccagcttcctgctgaccagagccggcagagaccaggccatctgcgagctgcaggaggaggtgagcagactgagactgagactggaggacagcctgcaccagcccctgcagggcagccccaccagacccgccagcgccttcgacagacccgccagaaccagaggcagacccgccgacagccccgccacctggggcagccactacggcagcaagagcaccgagagactgcccggcgagcccagaggcgaggagcagatcgtgccccccggcagacagagagccagaagcagcagcgtgcccagagaggtgctgagactgagcctgagcagcgagagcgagctgcccagcctgcccctgttcagcgagaagagcaagaccaccaaggacagcccccaggccgccagagacggcaagagaggcgtgggcagcgccggctggcccgacagagtgaccttcagaggccagtacaccggccacgagtaccacgtgctgagccccaaggccgtgcccaagggcaacggcaccgtgagctgcccccactgcagacccatcagaacccaggacgccggcggcgccgtgaccggcgaccccctgggccccccccccgccgacaccctgcagtgccccctgtgcggccaggtgggcagcccccccgaggccgacggccccggcagcgccaccagcggcgccgagaaggccaccaccagaagaaaggccagcagcacccccagccccaagcagagaagcaagcaggccggcagcagccccagacccccccccggcctgtggtacctggccaccgccccccccgcccccgccccccccgccttcgcctacatcagcagcgtgcccatcatgccctacccccccgccgccgtgtactacgcccccgccggccccaccagcgcccagcccgccgccaagtggccccccaccgccagccccccccccgccagaagacacagacacagcatccagctggacctgggcgacctggaggagctgaacaaggccctgagcagagccgtgcaggccgccgagagcgtgagaagcaccaccagacagatgagaagcagcctgagcgccgacctgagacaggcccacagcctgagaggcagctgcctgttctag

SEQ ID NO: 7630 - DNA, 2496 bp, Artificial Sequence
  Description of Artificial Sequence: Synthetic coding sequence
atggccagcagcgagaccgagatcagatgggccgagcccggcctgggcaagggcccccagagaagaagatgggcctgggccgaggacaagagagacgtggacagaagcagcagccagagctgggaggaggagagactgttccccaacgccaccagccccgagctgctggaggacttcagactggcccagcagcacctgccccccctggagtgggacccccacccccagcccgacggccaccaggacagcgagagcggcgagaccagcggcgaggaggccgaggccgaggacgtggacagccccgccagcagccacgagcccctggcctggctgccccagcagggcagacagctggacatgaccgaggaggagcccgacggcaccctgggcagcctggaggtggaggaggccggcgagagcagcagcagactgggctacgaggccggcctgagcctggagggccacggcaacaccagccccatggccctgggccacggccaggccagaggctgggtggccagcggcgagcaggccagcggcgacaagctgagcgagcacagcgaggtgaaccccagcgtggagctgagccccgccagaagctggagcagcggcaccgtgagcctggaccaccccagcgacagcctggacagcacctgggagggcgagaccgacggcccccagcccaccgccctggccgagaccctgcccgagggccccagccaccacctgctgagccccgacggcagaaccggcggcagcgtggccagagccacccccatggagttccaggacagcagcgccccccccgcccagagcccccagcacgccaccgacagatggagaagagagaccaccagattcttctgcccccagcccaaggagcacatctggaagcagaccaagaccagccccaagcccctgcccagcagattcatcggcagcatcagccccctgaacccccagcccagacccaccagacagggcagacccctgcccagacagggcgccaccctggccggcagaagcagcagcaacgcccccaagtacggcagaggccagctgaactaccccctgcccgacttcagcaaggtgggccccagagtgagattccccaaggacgagagctacagaccccccaagagcagaagccacaacagaaagccccaggcccccgccagacccctgatcttcaagagccccgccgagatcgtgcaggaggtgctgctgagcagcggcgaggccgccctggccaaggacaccccccccgcccaccccatcaccagagtgccccaggagttccagacccccgagcaggccaccgagctggtgcaccagctgcaggaggactaccacagactgctgaccaagtacgccgaggccgagaacaccatcgaccagctgagactgggcgccaaggtgaacctgttcagcgaccccccccagcccaaccacagcatccacaccggcatggtgccccagggcaccaaggtgctgagcttcaccatcccccagcccagaagcgccgagtggtggcccggccccgccgaggacccccaggccagcgccgccagcggctggcccagcgccagaggcgacctgagccccagcagcctgaccagcatgcccaccctgggctggctgcccgagaacagagacatcagcgaggaccagagcagcgccgagcagacccaggccctggccagccaggccagccagttcctggccaaggtggagagcttcgagagactgatccaggccggcagactgatgccccaggaccaggtgaagggcttccagagactgaaggccgcccacgccgccctggaggaggagtacctgaaggcctgcagagagcagcaccccgcccagcccctggccggcagcaagggcacccccggcagattcgaccccagaagagagctggaggccgagatctacagactgggcagctgcctggaggagctgaaggagcacatcgaccagacccagcaggagcccgagccccccggcagcgacagcgccctggacagcacccccgccctgccctgcctgcaccagcccacccacctgcccgcccccagcggccaggcccccatgcccgccatcaagaccagctgccccgagcccgccaccaccaccgccgccgccagcaccggcccctgccccctgcacgtgaacgtggaggtgagcagcggcaacagcgaggtggaggacagaccccaggaccccctggccagactgagacacaaggagctgcagatggagcaggtgtaccacggcctgatggagagatacctgagcgtgaagagcctgcccgaggccatgagaatggaggaggaggaggagggcgaggaggaggaggaggaggagggcggcggcgacagcctggaggtggacggcgtggccgccacccccggcaaggccgaggccaccagagtgctgcccagacagtgccccgtgcaggccgagaagagccacggcgcccccctggagtag

SEQ ID NO: 7631 - DNA, 1218 bp, Artificial Sequence
  Description of Artificial Sequence: Synthetic coding sequence
ctgaacctgtgcctgagcatcttcctgacccccgcctgctaccaccactgcagaagacagcactggcccctgcccatcgccagaaagtgcggcgccgtgcccggcagcgagttcgagggccacaagagaatcagcgagcagcccctgcccaacaagaccatcagccccccccccgcccccgcccccgccgccgcccccctgccctgcggccccaccgagaccatccccagcttcctgctgaccagagccggcagagaccaggccatctgcgagctgcaggaggaggtgagcagactgagactgagactggaggacagcctgcaccagcccctgcagggcagccccaccagacccgccagcgccttcgacagacccgccagaaccagaggcagacccgccgacagccccgccacctggggcagccactacggcagcaagagcaccgagagactgcccggcgagcccagaggcgaggagcagatcgtgccccccggcagacagagagccagaagcagcagcgtgcccagagaggtgctgagactgagcctgagcagcgagagcgagctgcccagcctgcccctgttcagcgagaagagcaagaccaccaaggacagcccccaggccgccagagacggcaagagaggcgtgggcagcgccggctggcccgacagagtgaccttcagaggccagtacaccggccacgagtaccacgtgctgctgagaagaagccagaaggccatggcccagagccccgtgcccaccgccggccccctgggccccagaatgagagtggtgctgagccagggcacccactgggacagactgcccctgatccccttcagcgtgccctgcgtggtgaagctgggcctgccccagagacagatggtgcaggcccagccccccctgggccagagaagaccccccagaggcgagaagcacctgcagctgcccgcccccagcagaggcgccagcagaagaggcagaagacacgcccacccccccgactgcggcatctggcagcagagaccccagcaccagcccctgcagcccctgcccaccagccccagattccccagctgcctgatccacctgcccctgtgcaccatgagactgcaggacctgccccagcccaaccagctgcccagcggcagaccccagcccctgccccaccagcccggcgacaccggcacccccagcagcagcacctgggccacctag

SEQ ID NO: 7632 - DNA, 4077 bp, Artificial Sequence
  Description of Artificial Sequence: Synthetic coding sequence
atgctgagaagcgagtggcccgtgttccccgaggccgaggccgaggacgtggacagccccgccagcagccacgagcccctggcctggctgccccagcagggcagacagctggacatgaccgaggaggagcccgacggcaccctgggcagcctggaggtggaggaggccggcgagagcagcagcagactgggctacgaggccggcctgagcctggagggccacggcaacaccagccccatggccctgggccacggccaggccagaggctgggtggccagcggcgagcaggccagcggcgacaagctgagcgagcacagcgaggtgaaccccagcgtggagctgagccccgccagaagctggagcagcggcaccgtgagcctggaccaccccagcgacagcctggacagcacctgggagggcgagaccgacggcccccagcccaccgccctggccgagaccctgcccgagggccccagccaccacctgctgagccccgacggcagaaccggcggcagcgtggccagagccacccccatggagttccaggacagcagcgccccccccgcccagagcccccagcacgccaccgacagatggagaagagagaccaccagattcttctgcccccagcccaaggagcacatctggaagcagaccaagaccagccccaagcccctgcccagcagattcatcggcagcatcagccccctgaacccccagcccagacccaccagacagggcagacccctgcccagacagggcgccaccctggccggcagaagcagcagcaacgcccccaagtacggcagaggccagctgaactaccccctgcccgacttcagcaaggtgggccccagagtgagattccccaaggacgagagctacagaccccccaagagcagaagccacaacagaaagccccaggcccccgccagacccctgatcttcaagagccccgccgagatcgtgcaggaggtgctgctgagcagcggcgaggccgccctggccaaggacaccccccccgcccaccccatcaccagagtgccccaggagttccagacccccgagcaggccaccgagctggtgcaccagctgcaggaggactaccacagactgctgaccaagtacgccgaggccgagaacaccatcgaccagctgagactgggcgccaaggtgaacctgttcagcgaccccccccagcccaaccacagcatccacaccggcatggtgccccagggcaccaaggtgctgagcttcaccatcccccagcccagaagcgccgagtggtggcccggccccgccgaggacccccaggccagcgccgccagcggctggcccagcgccagaggcgacctgagccccagcagcctgaccagcatgcccaccctgggctggctgcccgagaacagagacatcagcgaggaccagagcagcgccgagcagacccaggccctggccagccaggccagccagttcctggccaaggtggagagcttcgagagactgatccaggccggcagactgatgccccaggaccaggtgaagggcttccagagactgaaggccgcccacgccgccctggaggaggagtacctgaaggcctgcagagagcagcaccccgcccagcccctggccggcagcaagggcacccccggcagattcgaccccagaagagagctggaggccgagatctacagactgggcagctgcctggaggagctgaaggagcacatcgaccagacccagcaggagcccgagccccccggcagcgacagcgccctggacagcacccccgccctgccctgcctgcaccagcccacccacctgcccgcccccagcggccaggcccccatgcccgccatcaagaccagctgccccgagcccgccaccaccaccgccgccgccagcaccggcccctgccccctgcacgtgaacgtggaggtgagcagcggcaacagcgaggtggaggacagaccccaggaccccctggccagactgagacacaaggagctgcagatggagcaggtgtaccacggcctgatggagagatacctgagcgtgaagagcctgcccgaggccatgagaatggaggaggaggaggagggcgaggaggaggaggaggaggagggcggcggcgacagcctggaggtggacggcgtggccgccacccccggcaaggccgaggccaccagagtgctgcccagacagtgccccgtgcaggccgagaagagccacggcgcccccctggaggaggccaccgagaagatggtgagcatgaagccccccggcttccaggccagcctggccagagacggccacatgagcggcctgggcaaggccgaggccgccccccccggccccggcgtgcccccccacccccccggcaccaagagcgccgccagccaccagagcagcatgaccagcctggagggcagcggcatcagcgagagactgccccagaagcccctgcacagaggcggcggcccccacctggaggagacctggatggccagccccgagaccgacagcggcttcgtgggcagcgagaccagcagagtgagccccctgacccagacccccgagcacagactgagccacatcagcaccgccggcaccctggcccagcccttcgccgccagcgtgcccagagacggcgccagctaccccaaggccagaggcagcctgatccccagaagagccaccgagcccagcacccccagaagccaggcccagagatacctgagcagccccagcggccccctgagacagagagcccccaacttcagcctggagagaaccctggccgccgagatggccgtgcccggcagcgagttcgagggccacaagagaatcagcgagcagcccctgcccaacaagaccatcagccccccccccgcccccgcccccgccgccgcccccctgccctgcggccccaccgagaccatccccagcttcctgctgaccagagccggcagagaccaggccatctgcgagctgcaggaggaggtgagcagactgagactgagactggaggacagcctgcaccagcccctgcagggcagccccaccagacccgccagcgccttcgacagacccgccagaaccagaggcagacccgccgacagccccgccacctggggcagccactacggcagcaagagcaccgagagactgcccggcgagcccagaggcgaggagcagatcgtgccccccggcagacagagagccagaagcagcagcgtgcccagagaggtgctgagactgagcctgagcagcgagagcgagctgcccagcctgcccctgttcagcgagaagagcaagaccaccaaggacagcccccaggccgccagagacggcaagagaggcgtgggcagcgccggctggcccgacagagtgaccttcagaggccagtacaccggccacgagtaccacgtgctgagccccaaggccgtgcccaagggcaacggcaccgtgagctgcccccactgcagacccatcagaacccaggacgccggcggcgccgtgaccggcgaccccctgggccccccccccgccgacaccctgcagtgccccctgtgcggccaggtgggcagcccccccgaggccgacggccccggcagcgccaccagcggcgccgagaaggccaccaccagaagaaaggccagcagcacccccagccccaagcagagaagcaagcaggccggcagcagccccagacccccccccggcctgtggtacctggccaccgccccccccgcccccgccccccccgccttcgcctacatcagcagcgtgcccatcatgccctacccccccgccgccgtgtactacgcccccgccggccccaccagcgcccagcccgccgccaagtggccccccaccgccagccccccccccgccagaagacacagacacagcatccagctggacctgggcgacctggaggagctgaacaaggccctgagcagagccgtgcaggccgccgagagcgtgagaagcaccaccagacagatgagaagcagcctgagcgccgacctgagacaggcccacagcctgagaggcagctgcctgttctag

SEQ ID NO: 7633 - DNA, 1155 bp, Artificial Sequence
  Description of Artificial Sequence: Synthetic coding sequence
atgagcgccggcggcggcaccagaggctacagccccagaagccccggcgccaccagccaggccatctgcgagctgcaggaggaggtgagcagactgagactgagactggaggacagcctgcaccagcccctgcagggcagccccaccagacccgccagcgccttcgacagacccgccagaaccagaggcagacccgccgacagccccgccacctggggcagccactacggcagcaagagcaccgagagactgcccggcgagcccagaggcgaggagcagatcgtgccccccggcagacagagagccagaagcagcagcgtgcccagagaggtgctgagactgagcctgagcagcgagagcgagctgcccagcctgcccctgttcagcgagaagagcaagaccaccaaggacagcccccaggccgccagagacggcaagagaggcgtgggcagcgccggctggcccgacagagtgaccttcagaggccagtacaccggccacgagtaccacgtgctgagccccaaggccgtgcccaagggcaacggcaccgtgagctgcccccactgcagacccatcagaacccaggacgccggcggcgccgtgaccggcgaccccctgggccccccccccgccgacaccctgcagtgccccctgtgcggccaggtgggcagcccccccgaggccgacggccccggcagcgccaccagcggcgccgagaaggccaccaccagaagaaaggccagcagcacccccagccccaagcagagaagcaagcaggccggcagcagccccagacccccccccggcctgtggtacctggccaccgccccccccgcccccgccccccccgccttcgcctacatcagcagcgtgcccatcatgccctacccccccgccgccgtgtactacgcccccgccggccccaccagcgcccagcccgccgccaagtggccccccaccgccagccccccccccgccagaagacacagacacagcatccagctggacctgggcgacctggaggagctgaacaaggccctgagcagagccgtgcaggccgccgagagcgtgagaagcaccaccagacagatgagaagcagcctgagcgccgacctgagacaggcccacagcctgagaggcagctgcctgttctag

SEQ ID NO: 7634 - DNA, 4320 bp, Artificial Sequence; identical to SEQ ID NO: 7629
  Description of Artificial Sequence: Synthetic coding sequence

SEQ ID NO: 7635 - DNA, 1719 bp, Artificial Sequence
  Description of Artificial Sequence: Synthetic coding sequence
atggccagcagcgagaccgagatcagatgggccgagcccggcctgggcaagggcccccagagaagaagatgggcctgggccgaggacaagagagacgtggacagaagcagcagccagagctgggaggaggagagactgttccccaacgccaccagccccgagctgctggaggacttcagactggcccagcagcacctgccccccctggagtgggacccccacccccagcccgacggccaccaggacagcgagagcggcgagaccagcggcgaggaggccgaggccgaggacgtggacagccccgccagcagccacgagcccctggcctggctgccccagcagggcagacagctggacatgaccgaggaggagcccgacggcaccctgggcagcctggaggtggaggaggccggcgagagcagcagcagactgggctacgaggccggcctgagcctggagggccacggcaacaccagccccatggccctgggccacggccaggccagaggctgggtggccagcggcgagcaggccagcggcgacaagctgagcgagcacagcgaggtgaaccccagcgtggagctgagccccgccagaagctggagcagcggcaccgtgagcctggaccaccccagcgacagcctggacagcacctgggagggcgagaccgacggcccccagcccaccgccctggccgagaccctgcccgagggccccagccaccacctgctgagccccgacggcagaaccggcggcagcgtggccagagccacccccatggagttccaggacagcagcgccccccccgcccagagcccccagcacgccaccgacagatggagaagagagaccaccagattcttctgcccccagcccaaggagcacatctggaagcagaccaagaccagccccaagcccctgcccagcagattcatcggcagcatcagccccctgaacccccagcccagacccaccagacagggcagacccctgcccagacagggcgccaccctggccggcagaagcagcagcaacgcccccaagtacggcagaggccagctgaactaccccctgcccgacttcagcaaggtgggccccagagtgagattccccaaggacgagagctacagaccccccaagagcagaagccacaacagaaagccccaggcccccgccagacccctgatcttcaagagccccgccgagatcgtgcaggaggtgctgctgagcagcggcgaggccgccctggccaaggacaccccccccgcccaccccatcaccagagtgccccaggagttccagacccccgagcaggccaccgagctggtgcaccagctgcaggtgagcggcacccacggctgcggctgcgtgaccaaggcccccgtgggcctgggctggagactgatcggcgtgggcagacccggcgtggaggccggctggggcggcgaggcctgggacagagcctggctgggctgggaggccctgggcagaagactggtgggctggggcggcctgggctggagactggccagagtgggcagccccggcatggaggccagcggcgtgggcagacccggcgtgggcagccccggcgtggagcccggcggcgtgggcagacccggcgtggaggccggctggggcagaaagccctgggacagaggctggtggggcggcgaggcctggggcggcggctggctgggccaggaggccctgggctag

SEQ ID NO: 7636 - DNA, 2016 bp, Artificial Sequence
  Description of Artificial Sequence: Synthetic coding sequence
cccggcttcggcaccaagaacagccaggccggccccctgaagctgggcagacaggacggcggcggcgccagagagagagccgcccagggcgacgtggacagaagcagcagccagagctgggaggaggagagactgttccccaacgccaccagccccgagctgctggaggacttcagaggccccgccgcccccgccgcccccggcgtgggccccacccccgccgccagatgggccagcggcttcagagtgagaagagacttcggcagaagaaccggcggcagcgtggccagagccacccccatggagttccaggacagcagcgccccccccgcccagagcccccagcacgccaccgacagatggagaagagagaccaccagattcttctgcccccagcccaaggagcacatctggaagcagaccaagaccagccccaagcccctgcccagcagattcatcggcagcatcagccccctgaacccccagcccagacccaccagacagggcagacccctgcccagacagggcgccaccctggccggcagaagcagcagcaacgcccccaagtacggcagaggccagctgaactaccccctgcccgacttcagcaaggtgggccccagagtgagattccccaaggacgagagctacagaccccccaagagcagaagccacaacagaaagccccaggcccccgccagacccctgatcttcaagagccccgccgagatcgtgcaggaggtgctgctgagcagcggcgaggccgccctggccaaggacaccccccccgcccaccccatcaccagagtgccccaggagttccagacccccgagcaggccaccgagctggtgcaccagctgcaggaggactaccacagactgctgaccaagtacgccgaggccgagaacaccatcgaccagctgagactgggcgccaaggtgaacctgttcagcgaccccccccagcccaaccacagcatccacaccggcatggtgccccagggcaccaaggtgctgagcttcaccatcccccagcccagaagcgccgagtggtggcccggccccgccgaggacccccaggccagcgccgccagcggctggcccagcgccagaggcgacctgagccccagcagcctgaccagcatgcccaccctgggctggctgcccgagaacagagacatcagcgaggaccagagcagcgccgagcagacccaggccctggccagccaggccagccagttcctggccaaggtggagagcttcgagagactgatccaggccggcagactgatgccccaggaccaggtgaagggcttccagagactgaaggccgcccacgccgccctggaggaggagtacctgaaggcctgcagagagcagcaccccgcccagcccctggccggcagcaagggcacccccggcagattcgaccccagaagagagctggaggccgagatctacagactgggcagctgcctggaggagctgaaggagcacatcgaccagacccagcaggagcccgagccccccggcagcgacagcgccctggacagcacccccgccctgccctgcctgcaccagcccacccacctgcccgcccccagcggccaggcccccatgcccgccatcaagaccagctgccccgagcccgccaccaccaccgccgccgccagcaccggcccctgccccctgcacgtgaacgtggaggtgagcagcggcaacagcgaggtggaggacagaccccaggaccccctggccagactgagacacaaggagctgcagatggagcaggtgtaccacggcctgatggagagatacctgagcgtgaagagcctgcccgaggccatgagaatggaggaggaggaggagggcgaggaggaggaggaggaggagggcggcggcgacagcctggaggtggacggcgtggccgccacccccggcaaggccgaggccaccagagtgctgcccagacagtgccccgtgcaggccgagaagagccacggcgcccccctgtag

SEQ ID NO: 7637 - DNA, 2472 bp, Artificial Sequence
  Description of Artificial Sequence: Synthetic coding sequence
atggccgccagcgaggccgccgccgccgccggcagcgccgccctggccgccggcgccagagccgtgcccgccgccaccaccggcgccgccgccgccgccagcggcccctgggtgccccccggccccagactgagaggcagcagacccagacccgccggcgccacccagcagcccgccgtgcccgccccccccgccggcgagctgatccagcccagcgtgagcgagctgagcagagccgtgagaaccaacatcctgtgcaccgtgagaggctgcggcaagatcctgcccaacagccccgccctgaacatgcacctggtgaagagccacagactgcaggacggcatcgtgaaccccaccatcagaaaggacctgaagaccggccccaagttctactgctgccccatcgagggctgccccagaggccccgagagacccttcagccagttcagcctggtgaagcagcacttcatgaagatgcacgccgagaagaagcacaagtgcagcaagtgcagcaacagctacggcaccgagtgggacctgaagagacacgccgaggactgcggcaagaccttcagatgcacctgcggctgcccctacgccagcagaaccgccctgcagagccacatctacagaaccggccacgagatccccgccgagcacagagacccccccagcaagaagagaaagatggagaactgcgcccagaaccagaagctgagcaacaagaccatcgagagcctgaacaaccagcccatccccagacccgacacccaggagctggaggccagcgagatcaagctggagcccagcttcgaggacagctgcggcagcaacaccgacaagcagaccctgaccaccccccccagatacccccagaagctgctgctgcccaagcccaaggtggccctggtgaagctgcccgtgatgcagttcagcgtgatgcccgtgttcgtgcccaccgccgacagcagcgcccagcccgtggtgctgggcgtggaccagggcagcgccaccggcgccgtgcacctgatgcccctgagcgtgggcaccctgatcctgggcctggacagcgaggcctgcagcctgaaggagagcctgcccctgttcaagatcgccaaccccatcgccggcgagcccatcagcaccggcgtgcaggtgaacttcggcaagagccccagcaaccccctgcaggagctgggcaacacctgccagaagaacagcatcagcagcatcaacgtgcagaccgacctgagctacgccagccagaacttcatccccagcgcccagtgggccaccgccgacagcagcgtgagcagctgcagccagaccgacctgagcttcgacagccaggtgagcctgcccatcagcgtgcacacccagaccttcctgcccagcagcaaggtgaccagcagcatcgccgcccagaccgacgccttcatggacacctgcttccagagcggcggcgtgagcagagagacccagaccagcggcatcgagagccccaccgacgaccacgtgcagatggaccaggccggcatgtgcggcgacatcttcgagagcgtgcacagcagctacaacgtggccaccggcaacatcatcagcaacagcctggtggccgagaccgtgacccacagcctgctgccccagaacgagcccaagaccctgaaccaggacatcgagaagagcgcccccatcatcaacttcagcgcccagaacagcatgctgcccagccagaacatgaccgacaaccagacccagaccatcgacctgctgagcgacctggagaacatcctgagcagcaacctgcccgcccagaccctggaccacagaagcctgctgagcgacaccaaccccggccccgacacccagctgcccagcggccccgcccagaaccccggcatcgacttcgacatcgaggagttcttcagcgccagcaacatccagacccagaccgaggagagcgagctgagcaccatgaccaccgagcccgtgctggagagcctggacatcgagacccagaccgacttcctgctggccgacaccagcgcccagagctacggctgcagaggcaacagcaacttcctgggcctggagatgttcgacacccagacccagaccgacctgaacttcttcctggacagcagcccccacctgcccctgggcagcatcctgaagcacagcagcttcagcgtgagcaccgacagcagcgacaccgagacccagaccgagggcgtgagcaccgccaagaacatccccgccctggagagcaaggtgcagctgaacagcaccgagacccagaccatgagcagcggcttcgagaccctgggcagcctgttcttcaccagcaacgagacccagaccgccatggacgacttcctgctggccgacctggcctggaacaccatggagagccagttcagcagcgtggagacccagaccagcgccgagccccacaccgtgagcaacttctag

SEQ ID NO: 7638 - DNA, 1785 bp, Artificial Sequence
  Description of Artificial Sequence: Synthetic coding sequence
atggagaactgcgcccagaaccagaagctgagcaacaagaccatcgagagcctgaacaaccagcccatccccagacccgacacccaggagctggaggccagcgagatcaagctggagcccagcttcgaggacagctgcggcagcaacaccgacaagcagaccctgaccaccccccccagatacccccagaagctgctgctgcccaagcccaaggtggccctggtgaagctgcccgtgatgcagttcagcgtgatgcccgtgttcgtgcccaccgccgacagcagcgcccagcccgtggtgctgggcgtggaccagggcagcgccaccggcgccgtgcacctgatgcccctgagcgtgggcaccctgatcctgggcctggacagcgaggcctgcagcctgaaggagagcctgcccctgttcaagatcgccaaccccatcgccggcgagcccatcagcaccggcgtgcaggtgaacttcggcaagagccccagcaaccccctgcaggagctgggcaacacctgccagaagaacagcatcagcagcatcaacgtgcagaccgacctgagctacgccagccagaacttcatccccagcgcccagtgggccaccgccgacagcagcgtgagcagctgcagccagaccgacctgagcttcgacagccaggtgagcctgcccatcagcgtgcacacccagaccttcctgcccagcagcaaggtgaccagcagcatcgccgcccagaccgacgccttcatggacacctgcttccagagcggcggcgtgagcagagagacccagaccagcggcatcgagagccccaccgacgaccacgtgcagatggaccaggccggcatgtgcggcgacatcttcgagagcgtgcacagcagctacaacgtggccaccggcaacatcatcagcaacagcctggtggccgagaccgtgacccacagcctgctgccccagaacgagcccaagaccctgaaccaggacatcgagaagagcgcccccatcatcaacttcagcgcccagaacagcatgctgcccagccagaacatgaccgacaaccagacccagaccatcgacctgctgagcgacctggagaacatcctgagcagcaacctgcccgcccagaccctggaccacagaagcctgctgagcgacaccaaccccggccccgacacccagctgcccagcggccccgcccagaaccccggcatcgacttcgacatcgaggagttcttcagcgccagcaacatccagacccagaccgaggagagcgagctgagcaccatgaccaccgagcccgtgctggagagcctggacatcgagacccagaccgacttcctgctggccgacaccagcgcccagagctacggctgcagaggcaacagcaacttcctgggcctggagatgttcgacacccagacccagaccgacctgaacttcttcctggacagcagcccccacctgcccctgggcagcatcctgaagcacagcagcttcagcgtgagcaccgacagcagcgacaccgagacccagaccgagggcgtgagcaccgccaagaacatccccgccctggagagcaaggtgcagctgaacagcaccgagacccagaccatgagcagcggcttcgagaccctgggcagcctgttcttcaccagcaacgagacccagaccgccatggacgacttcctgctggccgacctggcctggaacaccatggagagccagttcagcagcgtggagacccagaccagcgccgagccccacaccgtgagcaacttctag

SEQ ID NO: 7639 - DNA, 966 bp, Artificial Sequence
  Description of Artificial Sequence: Synthetic coding sequence
atgaagcacatccccgtgctggaggacggcccctggaagaccgtgtgcgtgaaggagctgaacggcctgaagaagctgaagagaaagggcaaggagcccgccagaagagccaacggctacaagaccttcagactggacctggaggcccccgagcccagagccgtggccaccaacggcctgagagacagaacccacagactgcagcccgtgcccgtgcccgtgcccgtgcccgtgcccgtggcccccgccgtgccccccagaggcggcaccgacaccgccggcgagagaggcggcagcagagcccccgaggtgagcgacgccagaaagagatgcttcgccctgggcgccgtgggccccggcctgcccacccccccccccccccccccccccgccccccagagccaggcccccggcggccccgaggcccagcccttcagagagcccggcctgagacccagaatcctgctgtgcgccccccccgccagacccgcccccagcgccccccccgccccccccgccccccccgagagcaccgtgagacccgccccccccaccagacccggcgagagcagctacagcagcatcagccacgtgatctacaacaaccaccaggacagcagcgccagccccagaaagagacccggcgaggccaccgccgccagcagcgagatcaaggccctgcagcagaccagaagactgctggccaacgccagagagagaaccagagtgcacaccatcagcgccgccttcgaggccctgagaaagcaggtgccctgctacagctacggccagaagctgagcaagctggccatcctgagaatcgcctgcaactacatcctgagcctggccagactggccgacctggactacagcgccgaccacagcaacctgagcttcagcgagtgcgtgcagagatgcaccagaaccctgcaggccgagggcagagccaagaagagaaaggagtag

SEQ ID NO: 7640 - DNA, 1164 bp, Artificial Sequence
  Description of Artificial Sequence: Synthetic coding sequence
atgaccatggagggcgccagcggcagcagcttcggcatcgacaccatcctgagcagcgccagcagcggcagccccggcatgatgaacggcgacttcagacccctgggcgaggccagaaccgccgacttcagaagccaggccacccccagcccctgcagcgagatcgacaccgtgggcaccgcccccagcagccccatcagcgtgaccatggagccccccgagccccacctggtggccgacgccacccagcaccaccaccacctgcaccacagccagcagccccccccccccgccgccgcccccacccagagcctgcagcccctgccccagcagcagcagcccctgcccccccagcagcccccccccccccccccccagcagctgggcagcgccgccagcgcccccagaaccagcaccagcagcttcctgatcaaggacatcctgggcgacagcaagcccctggccgcctgcgccccctacagcaccagcgtgagcagcccccaccacacccccaagcaggagagcaacgccgtgcacgagagcttcagacccaagctggagcaggaggacagcaagaccaagctggacaagagagaggacagccagagcgacatcaagtgccacggcaccaaggaggagggcgacagagagatcaccagcagcagagagagcccccccgtgagagccaagaagcccagaaaggccagaaccgccttcagcgaccaccagctgaaccagctggagagaagcttcgagagacagaagtacctgagcgtgcaggacagaatggacctggccgccgccctgaacctgaccgacacccaggtgaagacctggtaccagaacagaagaaccaagtggaagagacagaccgccgtgggcctggagctgctggccgaggccggcaactacagcgccctgcagagaatgttccccagcccctacttctaccaccccagcctgctgggcagcatggacagcaccaccgccgccgccgccgccgccgccatgtacagcagcatgtacagaaccccccccgccccccacccccagctgcagagacccctggtgcccagagtgctgatccacggcctgggccccggcggccagcccgccctgaaccccctgagcagccccatccccggcaccccccaccccagatag

SEQ ID NO: 7641 - DNA, 321 bp, Artificial Sequence
  Description of Artificial Sequence: Synthetic coding sequence
atgatgaccctggtgcccagagccagaaccagagccggccaggaccactacagccacccctgccccagattcagccaggtgctgctgaccgagggcatcatgacctactgcctgaccaagaacctgagcgacgtgaacatcctgcacagactgctgaagaacggcaacgtgagaaacaccctgctgcagagcaaggtgggcctgctgacctactacgtgaagctgtaccccggcgaggtgaccctgctgaccagacccagcatccagatgagactgtgctgcatcaccggcagcgtgagcagacccagaagccagaagtag

SEQ ID NO: 7642 - DNA, 321 bp, Artificial Sequence; identical to SEQ ID NO: 7641
  Description of Artificial Sequence: Synthetic coding sequence

SEQ ID NO: 7643 - DNA, 570 bp, Artificial Sequence
  Description of Artificial Sequence: Synthetic coding sequence
atgaagaccaagaacagaccccccagaagaagagcccccgtgcaggacaccgaggccacccccggcgagggcacccccgacggcagcctgcccaaccccggccccgagcccgccaagggcctgagaagcagacccgccagagccgccgccagagcccccggcgagggcagaagaagaagacccggccccagcggccccggcggcagaagagacagcagcatccagagaagactggagagcaacgagagagagagacagagaatgcacaagctgaacaacgccttccaggccctgagagaggtgatcccccacgtgagagccgacaagaagctgagcaagatcgagaccctgaccctggccaagaactacatcaagagcctgaccgccaccatcctgaccatgagcagcagcagactgcccggcctggagggccccggccccaagctgtaccagcactaccagcagcagcagcaggtggccggcggcgccctgggcgccaccgaggcccagccccagggccacctgcagagatacagcacccagatccacagcttcagagagggcacctag

SEQ ID NO: 7644 - DNA, 708 bp, Artificial Sequence
  Description of Artificial Sequence: Synthetic coding sequence
atgctgagaggcgcccccggcctgggcctgaccgccagaaagggcgccgaggacagcgccgaggacctgggcggcccctgccccgagcccggcggcgacagcggcgtgctgggcgccaacggcgccagctgcagcagaggcgaggccgaggagcccgccggcagaagaagagccagacccgtgagaagcaaggccagaagaatggccgccaacgtgagagagagaaagagaatcctggactacaacgaggccttcaacgccctgagaagagccctgagacacgacctgggcggcaagagactgagcaagatcgccaccctgagaagagccatccacagaatcgccgccctgagcctggtgctgagagccagccccgcccccagaggcccctgcggccacctggagtgccacggccccgccgccagaggcgacaccggcgacaccggcgccagcccccccccccccgccggccccagcctggccagacccgacgccgccagacccagcgtgcccagcgcccccagatgcgccagctgccccccccacgcccccctggccagacccagcgccgtggccgagggccccggcctggcccaggccagcggcggcagctggagaagatgccccggcgccagcagcgccggcccccccccctggcccagaggctacctgagaagcgcccccggcatgggccaccccagaagctag

SEQ ID NO: 7645 - DNA, 825 bp, Artificial Sequence
  Description of Artificial Sequence: Synthetic coding sequence
atgcacctgtgcggcggcaacggcctgctgacccagaccgaccccaaggagcagcagagacagctgaagaagcagaagaacagagccgccgcccagagaagcagacagaagcacaccgacaaggccgacgccctgcaccagcagcacgagagcctggagaaggacaacctggccctgagaaaggagatccagagcctgcaggccgagctggcctggtggagcagaaccctgcacgtgcacgagagactgtgccccatggactgcgccagctgcagcgcccccggcctgctgggctgctgggaccaggccgagggcctgctgggccccggcccccagggccagcacggctgcagagagcagctggagctgttccagacccccggcagctgctaccccgcccagcccctgagccccggcccccagccccacgacagccccagcctgctgcagtgccccctgcccagcctgagcctgggccccgccgtggtggccgagccccccgtgcagctgagccccagccccctgctgttcgccagccacaccggcagcagcctgcagggcagcagcagcaagctgagcgccctgcagcccagcctgaccgcccagaccgcccccccccagcccctggagctggagcaccccaccagaggcaagctgggcagcagccccgacaaccccagcagcgccctgggcctggccagactgcagagcagagagcacaagcccgccctgagcgccgccacctggcagggcctggtggtggaccccagcccccaccccctgctggccttccccctgctgagcagcgcccaggtgcacttctag

SEQ ID NO: 7646 - DNA, 2031 bp, Artificial Sequence
  Description of Artificial Sequence: Synthetic coding sequence
atgaagaagttcagcagaatgcccaagagcgagggcggcagcggcggcggcgccgccggcggcggcgccggcggcgccggcgccggcgccggctgcggcagcggcggcagcagcgtgggcgtgagagtgttcgccgtgggcagacaccaggtgaccctggaggagagcctggccgagggcggcttcagcaccgtgttcctggtgagaacccacggcggcatcagatgcgccctgaagagaatgtacgtgaacaacatgcccgacctgaacgtgtgcaagagagagatcaccatcatgaaggagctgagcggccacaagaacatcgtgggctacctggactgcgccgtgaacagcatcagcgacaacgtgtgggaggtgctgatcctgatggagtactgcagagccggccaggtggtgaaccagatgaacaagaagctgcagaccggcttcaccgagcccgaggtgctgcagatcttctgcgacacctgcgaggccgtggccagactgcaccagtgcaagacccccatcatccacagagacctgaaggtggagaacatcctgctgaacgacggcggcaactacgtgctgtgcgacttcggcagcgccaccaacaagttcctgaacccccagaaggacggcgtgaacgtggtggaggaggagatcaagaagtacaccaccctgagctacagagcccccgagatgatcaacctgtacggcggcaagcccatcaccaccaaggccgacatctgggccctgggctgcctgctgtacaagctgtgcttcttcaccctgcccttcggcgagagccaggtggccatctgcgacggcaacttcaccatccccgacaacagcagatacagcagaaacatccactgcctgatcagattcatgctggagcccgaccccgagcacagacccgacatcttccaggtgagctacttcgccttcaagttcgccaagaaggactgccccgtgagcaacatcaacaagtgctgcaagcagctgctgagacacggcgccctgctgaccgagatcctgctgttcctgcagctgttcctgaacatgaccgccagcgaggccgccgccagaaagagccagatcaaggccagaatcaccgacaccatcggccccaccgagaccagcatcgcccccagacagagacccaaggccaacagcgccaccaccgccacccccagcgtgctgaccatccagagcagcgccacccccgtgaaggtgctggcccccggcgagttcggcaaccacagacccaagggcgccctgagacccggcaacggccccgagatcctgctgggccagggccccccccagcagcccccccagcagcacagagtgctgcagcagctgcagcagggcgactggagactgcagcagctgcacctgcagcacagacacccccaccagcagcagcagcagcagcagcagcagcagcagcagcagcagcagcagcagcagcagcagcagcagcagcagcagcagcagcaccaccaccaccaccaccaccacctgctgcaggacgcctacatgcagcagtaccagcacgccacccagcagcagcagatgctgcagcagcagttcctgatgcacagcgtgtaccagccccagcccagcgccagccagtaccccaccatgatgccccagtaccagcaggccttcttccagcagcagatgctggcccagcaccagcccagccagcagcaggccagccccgagtacctgaccagcccccaggagttcagccccgccctggtgagctacaccagcagcctgcccgcccaggtgggcaccatcatggacagcagctacagcgccaacagaagcgtggccgacaaggaggccatcgccaacttcaccaaccagaagaacatcagcaacccccccgacatgagcggctggaaccccttcggcgaggacaacttcagcaagctgaccgaggaggagctgctggacagagagttcgacctgctgagaagcagcaagggccacctgaaggcctacttcgccagccagtag

SEQ ID NO: 7647 - DNA, 3486 bp, Artificial Sequence
  Description of Artificial Sequence: Synthetic coding sequence
atgaagaagttcagcagaatgcccaagagcgagggcggcagcggcggcggcgccgccggcggcggcgccggcggcgccggcgccggcgccggctgcggcagcggcggcagcagcgtgggcgtgagagtgttcgccgtgggcagacaccaggtgaccctggaggagagcctggccgagggcggcttcagcaccgtgttcctggtgagaacccacggcggcatcagatgcgccctgaagagaatgtacgtgaacaacatgcccgacctgaacgtgtgcaagagagagatcaccatcatgaaggagctgagcggccacaagaacatcgtgggctacctggactgcgccgtgaacagcatcagcgacaacgtgtgggaggtgctgatcctgatggagtactgcagagccggccaggtggtgaaccagatgaacaagaagctgcagaccggcttcaccgagcccgaggtgctgcagatcttctgcgacacctgcgaggccgtggccagactgcaccagtgcaagacccccatcatccacagagacctgaaggtggagaacatcctgctgaacgacggcggcaactacgtgctgtgcgacttcggcagcgccaccaacaagttcctgaacccccagaaggacggcgtgaacgtggtggaggaggagatcaagaagtacaccaccctgagctacagagcccccgagatgatcaacctgtacggcggcaagcccatcaccaccaaggccgacatctgggccctgggctgcctgctgtacaagctgtgcttcttcaccctgcccttcggcgagagccaggtggccatctgcgacggcaacttcaccatccccgacaacagcagatacagcagaaacatccactgcctgatcagattcatgctggagcccgaccccgagcacagacccgacatcttccaggtgagctacttcgccttcaagttcgccaagaaggactgccccgtgagcaacatcaacaacagcagcatccccagcgccctgcccgagcccatgaccgccagcgaggccgccgccagaaagagccagatcaaggccagaatcaccgacaccatcggccccaccgagaccagcatcgcccccagacagagacccaaggccaacagcgccaccaccgccacccccagcgtgctgaccatccagagcagcgccacccccgtgaaggtgctggcccccggcgagttcggcaaccacagacccaagggcgccctgagacccggcaacggccccgagatcctgctgggccagggccccccccagcagcccccccagcagcacagagtgctgcagcagctgcagcagggcgactggagactgcagcagctgcacctgcagcacagacacccccaccagcagcagcagcagcagcagcagcagcagcagcagcagcagcagcagcagcagcagcagcagcagcagcagcagcagcagcaccaccaccaccaccaccaccacctgctgcaggacgcctacatgcagcagtaccagcacgccacccagcagcagcagatgctgcagcagcagttcctgatgcacagcgtgtaccagccccagcccagcgccagccagtaccccaccatgatgccccagtaccagcaggccttcttccagcagcagatgctggcccagcaccagcccagccagcagcaggccagccccgagtacctgaccagcccccaggagttcagccccgccctggtgagctacaccagcagcctgcccgcccaggtgggcaccatcatggacagcagctacagcgccaacagaagcgtggccgacaaggaggccatcgccaacttcaccaaccagaagaacatcagcaacccccccgacatgagcggctggaaccccttcggcgaggacaacttcagcaagctgaccgaggaggagctgctggacagagagttcgacctgctgagaagcaacagactggaggagagagccagcagcgacaagaacgtggacagcctgagcgccccccacaaccacccccccgaggaccccttcggcagcgtgcccttcatcagccacagcggcagccccgagaagaaggccgagcacagcagcatcaaccaggagaacggcaccgccaaccccatcaagaacggcaagaccagccccgccagcaaggaccagagaaccggcaagaagaccagcgtgcagggccaggtgcagaagggcaacgacgagagcgagagcgacttcgagagcgacccccccagccccaagagcagcgaggaggaggagcaggacgacgaggaggtgctgcagggcgagcagggcgacttcaacgacgacgacaccgagcccgagaacctgggccacagacccctgctgatggacagcgaggacgaggaggaggaggagaagcacagcagcgacagcgactacgagcaggccaaggccaagtacagcgacatgagcagcgtgtacagagacagaagcggcagcggccccacccaggacctgaacaccatcctgctgaccagcgcccagctgagcagcgacgtggccgtggagacccccaagcaggagttcgacgtgttcggcgccgtgcccttcttcgccgtgagagcccagcagccccagcaggagaagaacgagaagaacctgccccagcacagattccccgccgccggcctggagcaggaggagttcgacgtgttcaccaaggcccccttcagcaagaaggtgaacgtgcaggagtgccacgccgtgggccccgaggcccacaccatccccggctaccccaagagcgtggacgtgttcggcagcacccccttccagcccttcctgaccagcaccagcaagagcgagagcaacgaggacctgttcggcctggtgcccttcgacgagatcaccggcagccagcagcagaaggtgaagcagagaagcctgcagaagctgagcagcagacagagaagaaccaagcaggacatgagcaagagcaacggcaagagacaccacggcacccccaccagcaccaagaagaccctgaagcccacctacagaacccccgagagagccagaagacacaagaaggtgggcagaagagacagccagagcagcaacgagttcctgaccatcagcgacagcaaggagaacatcagcgtggccctgaccgacggcaaggacagaggcaacgtgctgcagcccgaggagagcctgctggaccccttcggcgccaagcccttccacagccccgacctgagctggcaccccccccaccagggcctgagcgacatcagagccgaccacaacaccgtgctgcccggcagacccagacagaacagcctgcacggcagcttccacagcgccgacgtgctgaagatggacgacttcggcgccgtgcccttcaccgagctggtggtgcagagcatcaccccccaccagagccagcagagccagcccgtggagctggaccccttcggcgccgcccccttccccagcaagcagtag

SEQ ID NO: 7648 - DNA, 1989 bp, Artificial Sequence
  Description of Artificial Sequence: Synthetic coding sequence
atgaagaagttcagcagaatgcccaagagcgagggcggcagcggcggcggcgccgccggcggcggcgccggcggcgccggcgccggcgccggctgcggcagcggcggcagcagcgtgggcgtgagagtgttcgccgtgggcagacaccaggtgaccctggaggagagcctggccgagggcggcttcagcaccgtgttcctggtgagaacccacggcggcatcagatgcgccctgaagagaatgtacgtgaacaacatgcccgacctgaacgtgtgcaagagagagatcaccatcatgaaggagctgagcggccacaagaacatcgtgggctacctggactgcgccgtgaacagcatcagcgacaacgtgtgggaggtgctgatcctgatggagtactgcagagccggccaggtggtgaaccagatgaacaagaagctgcagaccggcttcaccgagcccgaggtgctgcagatcttctgcgacacctgcgaggccgtggccagactgcaccagtgcaagacccccatcatccacagagacctgaaggtggagaacatcctgctgaacgacggcggcaactacgtgctgtgcgacttcggcagcgccaccaacaagttcctgaacccccagaaggacggcgtgaacgtggtggaggaggagatcaagaagtacaccaccctgagctacagagcccccgagatgatcaacctgtacggcggcaagcccatcaccaccaaggccgacatctgggccctgggctgcctgctgtacaagctgtgcttcttcaccctgcccttcggcgagagccaggtggccatctgcgacggcaacttcaccatccccgacaacagcagatacagcagaaacatccactgcctgatcagattcatgctggagcccgaccccgagcacagacccgacatcttccaggtgagctacttcgccttcaagttcgccaagaaggactgccccgtgagcaacatcaacaacagcagcatccccagcgccctgcccgagcccatgaccgccagcgaggccgccgccagaaagagccagatcaaggccagaatcaccgacaccatcggccccaccgagaccagcatcgcccccagacagagacccaaggccaacagcgccaccaccgccacccccagcgtgctgaccatccagagcagcgccacccccgtgaaggtgctggcccccggcgagttcggcaaccacagacccaagggcgccctgagacccggcaacggccccgagatcctgctgggccagggccccccccagcagcccccccagcagcacagagtgctgcagcagctgcagcagggcgactggagactgcagcagctgcacctgcagcacagacacccccaccagcagcagcagcagcagcagcagcagcagcagcagcagcagcagcagcagcagcagcagcagcagcagcagcagcagcagcaccaccaccaccaccaccaccacctgctgcaggacgcctacatgcagcagtaccagcacgccacccagcagcagcagatgctgcagcagcagttcctgatgcacagcgtgtaccagccccagcccagcgccagccagtaccccaccatgatgccccagtaccagcaggccttcttccagcagcagatgctggcccagcaccagcccagccagcagcaggccagccccgagtacctgaccagcccccaggagttcagccccgccctggtgagctacaccagcagcctgcccgcccaggtgggcaccatcatggacagcagctacagcgccaacagaagcgtggccgacaaggaggccatcgccaacttcaccaaccagaagaacatcagcaacccccccgacatgagcggctggaaccccttcggcgaggacaacttcagcaagctgaccgaggaggagctgctggacagagagttcgacctgctgagaagcagcaagggccacctgaaggcctacttcgccagccagtag

SEQ ID NO: 7649 - DNA, 3849 bp, Artificial Sequence
  Description of Artificial Sequence: Synthetic coding sequence
atggaggccaaggaccagaagaagcacagaaagaagaacagcggccccaaggccgccaagaagaagaagagactgctgcaggacctgcagctgggcgacgaggaggacgccagaaagagaaaccccaaggccttcgccgtgcagagcgccgtgagaatggccagaagcttccacagaacccaggacctgaagaccaagaagcaccacatccccgtggtggacagaacccccctggagcccccccccatcgtggtggtggtgatgggcccccccaaggtgggcaagagcaccctgatccagtgcctgatcagaaacttcaccagacagaagctgaccgagatcagaggccccgtgaccatcgtgagcggcaagaagagaagactgaccatcatcgagtgcggctgcgacatcaacatgatgatcgacctggccaaggtggccgacctggtgctgatgctgatcgacgccagcttcggcttcgagatggagaccttcgagttcctgaacatctgccaggtgcacggcttccccaagatcatgggcgtgctgacccacctggacagcttcaagcacaacaagcagctgaagaagaccaagaagagactgaagcacagattctggaccgaggtgtaccccggcgccaagctgttctacctgagcggcatggtgcacggcgagtaccagaaccaggagatccacaacctgggcagattcatcaccgtgatgaagttcagacccctgacctggcagaccagccacccctacatcctggccgacagaatggaggacctgaccaaccccgaggacatcagaaccaacatcaagtgcgacagaaaggtgagcctgtacggctacctgagaggcgcccacctgaagaacaagagccagatccacatgcccggcgtgggcgacttcgccgtgagcgacatcagcttcctgcccgacccctgcgccctgcccgagcagcagaagaagagatgcctgaacgagaaggagaagctggtgtacgcccccctgagcggcgtgggcggcgtgctgtacgacaaggacgccgtgtacgtggacctgggcggcagccacgtgttccaggacgaggtgggccccacccacgagctggtgcagagcctgatcagcacccacagcaccatcgacgccaagatggccagcagcagagtgaccctgttcagcgacagcaagcccctgggcagcgaggacatcgacaaccagggcctgatgatgcccaaggaggagaagcagatggacctgaacaccggcagaatgagaagaaaggccatcttcggcgacgaggacgagagcggcgacagcgacgacgaggaggacgacgagatgagcgaggacgacggcctggagaacggcagcagcgacgaggaggccgaggaggaggagaacgccgagatgaccgaccagtacatggccgtgaagggcatcaagagaagaaagctggagctggaggaggacagcgagatggacctgcccgccttcgccgacagcgacgacgacctggagagaagcagcgccgaggagggcgaggccgaggaggccgacgagagcagcgaggaggaggactgcaccgccggcgagaagggcatcagcggcagcaaggccgccggcgagggcagcaaggccggcctgagccccgccaactgccagagcgacagagtgaacctggagaagagcctgctgatgaagaaggccgccctgcccaccttcgacagcggccactgcaccgccgaggaggtgttcgccagcgaggacgagagcgaggagagcagcagcctgagcgccgaggaggaggacagcgagaacgaggaggccatcagaaagaagctgagcaagcccagccaggtgagcagcggccagaagctgggcccccagaacttcatcgacgagaccagcgacatcgagaacctgctgaaggaggaggaggactacaaggaggagaacaacgacagcaaggagaccagcggcgccctgaagtggaaggaggacctgagcagaaaggccgccgaggccttcctgagacagcagcaggccgcccccaacctgagaaagctgatctacggcaccgtgaccgaggacaacgaggaggaggacgacgacaccctggaggagctgggcggcctgttcagagtgaaccagcccgacagagagtgcaagcacaaggccgacagcctggactgcagcagattcctggtggaggccccccacgactgggacctggaggaggtgatgaacagcatcagagactgcttcgtgaccggcaagtgggaggacgacaaggacgccgccaaggtgctggccgaggacgaggagctgtacggcgacttcgaggacctggagaccggcgacgtgcacaagggcaagagcggccccaacacccagaacgaggacatcgagaaggaggtgaaggaggagatcgaccccgacgaggaggagagcgccaagaagaagcacctggacaagaagagaaagctgaaggagatgttcgacgccgagtacgacgagggcgagagcacctacttcgacgacctgaagggcgagatgcagaagcaggcccagctgaacagagccgagttcgaggaccaggacgacgaggccagagtgcagtacgagggcttcagacccggcatgtacgtgagaatcgagatcgagaacgtgccctgcgagttcgtgcagaacttcgacccccactaccccatcatcctgggcggcctgggcaacagcgagggcaacgtgggctacgtgcagatgagactgaagaagcacagatggtacaagaagatcctgaagagcagagaccccatcatcttcagcgtgggctggagaagattccagaccatccccctgtactacatcgaggaccacaacggcagacagagactgctgaagtacaccccccagcacatgcactgcggcgccgccttctggggccccatcaccccccagggcaccggcttcctggccatccagagcgtgagcggcatcatgcccgacttcagaatcgccgccaccggcgtggtgctggacctggacaagagcatcaagatcgtgaagaagctgaagctgaccggcttcccctacaagatcttcaagaacaccagcttcatcaagggcatgttcaacagcgccctggaggtggccaagttcgagggcgccgtgatcagaaccgtgagcggcatcagaggccagatcaagaaggccctgagagcccccgagggcgccttcagagccagcttcgaggacaagctgctgatgagcgacatcgtgttcatgagaacctggtaccccgtgagcatccccgccttctacaaccccgtgaccagcctgctgaagcccgtgggcgagaaggacacctggagcggcatgagaaccaccggccagctgagactggcccacggcgtgagactgaaggccaacaaggacagcctgtacaagcccatcctgagacagaagaagcacttcaacagcctgcacatccccaaggccctgcagaaggccctgcccttcaagaacaagcccaagacccaggccaaggccggcaaggtgcccaaggacagaagaagacccgccgtgatcagagagccccacgagagaaagatcctggccctgctggacgccctgagcaccgtgcacagccagaagatgaagaaggccaaggagcagagacacctgcacaacaaggagcacttcagagccaagcagaaggaggaggaggagaagctgaagagacagaaggacctgagaaagaagctgttcagaatccagggccagaaggagagaagaaaccagaagagcagcctgaagggcgccgagggccagctgcagtag

SEQ ID NO: 7650 - DNA, 909 bp, Artificial Sequence
  Description of Artificial Sequence: Synthetic coding sequence
atggtgagctaccacaagcaggcctgcgagatcccccccaccgtgaaccccagaaagaagctgtgggccttccccagcgacagcagcagagacctgcccagccccaagaaggccaagaccgaggagatgccccagctgaacttcggcatggccgaccccacccagatgggcggcctgagcatgctgctgctggccggcgagcacgccctgggcacccccgaggtgagcagcggcacctgcagacccgacgtgagcgagagccccgagctgagacagaagagccccctgttccagttcgccgagatcagcagcagcaccagccacagcgacgccagcaccaagcagtgccagaccagcgccctgttccagttcgccgagatcagcagcaacaccagccagctgggcggcgccgagcccgtgaagagatgcggcaagagcgccctgttccagctggccgagatgtgcctggccagcgagggcatgaagatggaggagagcaagctgatcaaggccaaggagagcgacggcggcagaatcaaggagctggagaagggcaaggaggagaaggagatcaagatggagaagaccgacgagaccagactgcagaaggaggccgagttcgagaagagcgccaaggagaacctgagagacagcaaggagctgagaaacttcgaggccctgcagatcgacgacatcatggccatcaagatggaggaccccaaggagatcagaaaggaggagctggaggaggaccacaagtgcagccacttccccgacttcagctacagcgccagcagcaagatcatcatcagcgacgtgcccagcagaaaggaccacatgtgccacccccacggcatcatgatcatcgaggaccccgccgccctgaacaagcccgagaagctgaagtag

SEQ ID NO: 7651 - DNA, 2826 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgaggacgacgagagccccgagcagagagccagaagacccatgaacgccttcctgctgttctgcaagagacacagaagcctggtgagacaggagcaccccagactggacaacagaggcgccaccaagatcctggccgactggtgggccgtgctggaccccaaggagaagcagaagtacaccgacatggccaaggagtacaaggacgccttcatgaaggccaaccccggctacaagtggtgccccaccaccaacaagcccgtgaagagccccacccccaccgtgaaccccagaaagaagctgtgggccttccccagcgacagcagcagagacctgcccagccccaagaaggccaagaccgaggagatgccccagctgaacttcggcatggccgaccccacccagatgggcggcctgagcatgctgctgctggccggcgagcacgccctgggcacccccgaggtgagcagcggcacctgcagacccgacgtgagcgagagccccgagctgagacagaagagccccctgttccagttcgccgagatcagcagcagcaccagccacagcgacgccagcaccaagcagtgccagaccagcgccctgttccagttcgccgagatcagcagcaacaccagccagctgggcggcgccgagcccgtgaagagatgcggcaagagcgccctgttccagctggccgagatgtgcctggccagcgagggcatgaagatggaggagagcaagctgatcaaggccaaggagagcgacggcggcagaatcaaggagctggagaagggcaaggaggagaaggagatcaagatggagaagaccgacgagaccagactgcagaaggaggccgagttcgagaagagcgccaaggagaacctgagagacagcaaggagctgagaaacttcgaggccctgcagatcgacgacatcatggccatcaagatggaggaccccaaggagatcagaaaggaggagctggaggaggaccacaagtgcagccacttccccgacttcagctacagcgccagcagcaagatcatcatcagcgacgtgcccagcagaaaggaccacatgtgccacccccacggcatcatgatcatcgaggaccccgccgccctgaacaagcccgagaagctgaagaagaagaagaagaagagcaagatggacagacacggcaacgacaagagcacccccaagaagacctgcaagaagagacagagcagcgagagcgacatcgagagcgtgatctacaccatcgaggccgtggccaagggcgactggggcatcgagaagctgggcgacacccccagaaagaaggtgagaaccagcagcagcggcaagggcagcatcctggacgccaagccccccaagaagaaggtgaagagcagagagaagaagatgagcaaggagaagagcagcgacaccaccaaggagagcagaccccccgacttcatcagcatcagcgccagcaagaacatcagcggcgagacccccgagggcatcaaggccgagcccctgacccccatggaggacgccctgccccccagcctgagcggccaggccaagcccgaggacagcgactgccacagaaagatcgagacctgcggcagcagaaagagcgagagaagctgcaagggcgccctgtacaagaccctggtgagcgagggcatgctgaccagcctgagagccaacgtggacagaggcaagagaagcagcggcaagggcaacagcagcgaccacgagggctgctggaacgaggagagctggaccttcagccagagcggcaccagcggcagcaagaagttcaagaagaccaagcccaaggaggactgcctgctgggcagcgccaagctggacgaggagttcgagaagaagttcaacagcctgccccagtacagccccgtgaccttcgacagaaagtgcgtgcccgtgcccagaaagaagaagaagaccggcaacgtgagcagcgagcccaccaagaccagcaagggccccttccagagccagaagaagaacctgttccacaagatcgtgagcaagtacaagcacaagaaggagaagcccaacgtgcccgagaagggcagcggcgacaagtggagcaacaagcagctgttcctggacgccatccaccccaccgaggccatcttcagcgaggacagaaacaccatggagcccgtgcacaaggtgaagaacatccccagcatcttcaacacccccgagcccaccaccacccaggagcccctggtgggcagccagaagagaaaggccagaaagaccaagatcacccacctggtgagaaccgccgacggcagagtgagccccgccggcggcaccctggacgacaagcccaaggagcagctgcagagaagcctgcccaaggccaccgagaccgactgcaacgacaagtgcagccacaacaccgaggtgggcgagaccagaagcagcacccccgagatgcccgccgtgagcgccttcttcagcctggccgccctggccgaggtggccgccatggagaacgtgcacagaggccagagaagcacccccctgacccacgacggccagcccaaggagatgccccaggcccccgtgctgatcagctgcgccgaccagtag

SEQ ID NO: 7652 - DNA, 1347 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgaggacgacgagagccccgagcagagagccagaagacccatgaacgccttcctgctgttctgcaagagacacagaagcctggtgagacaggagcaccccagactggacaacagaggcgccaccaagatcctggccgactggtgggccgtgctggaccccaaggagaagcagaagtacaccgacatggccaaggagtacaaggacgccttcatgaaggccaaccccggctacaagtggtgccccaccaccaacaagcccgtgaagagccccacccccaccgtgaaccccagaaagaagctgtgggccttccccagcgacagcagcagagacctgcccagccccaagaaggccaagaccgaggagatgccccagctgaacttcggcatggccgaccccacccagatgggcggcctgagcatgctgctgctggccggcgagcacgccctgggcacccccgaggtgagcagcggcacctgcagacccgacgtgagcgagagccccgagctgagacagaagagccccctgttccagttcgccgagatcagcagcagcaccagccacagcgacgccagcaccaagcagtgccagaccagcgccctgttccagttcgccgagatcagcagcaacaccagccagctgggcggcgccgagcccgtgaagagatgcggcaagagcgccctgttccagctggccgagatgtgcctggccagcgagggcatgaagatggaggagagcaagctgatcaaggccaaggagagcgacggcggcagaatcaaggagctggagaagggcaaggaggagaaggagatcaagatggagaagaccgacgagaccagactgcagaaggaggccgagttcgagaagagcgccaaggagaacctgagagacagcaaggagctgagaaacttcgaggccctgcagatcgacgacatcatggccatcaagatggaggaccccaaggagatcagaaaggaggagctggaggaggaccacaagtgcagccacttccccgacttcagctacagcgccagcagcaagatcatcatcagcgacgtgcccagcagaaaggaccacatgtgccacccccacggcatcatgatcatcgaggaccccgccgccctgaacaagcccgagtag

SEQ ID NO: 7653 - DNA, 2736 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgaggacgacgagagccccgagcagagagccagaagacccatgaacgccttcctgctgttctgcaagagacacagaagcctggtgagacaggagcaccccagactggacaacagaggcgccaccaagatcctggccgactggtgggccgtgctggaccccaaggagaagcagaagtacaccgacatggccaaggagtacaaggacgccttcatgaaggccaaccccggctacaagtggtgccccaccaccaacaagcccgtgaagagccccacccccaccgtgaaccccagaaagaagctgtgggccttccccagcgacagcagcagagacctgcccagccccaagaaggccaagaccgaggagatgccccagctgaacttcggcatggccgaccccacccagatgggcggcctgagcatgctgctgctggccggcgagcacgccctgggcacccccgaggtgagcagcggcacctgcagacccgacgtgagcgagagccccgagctgagacagaagagccccctgttccagttcgccgagatcagcagcagcaccagccacagcgacgccagcaccaagcagtgccagaccagcgccctgttccagttcgccgagatcagcagcaacaccagccagctgggcggcgccgagcccgtgaagagatgcggcaagagcgccctgttccagctggccgagatgtgcctggccagcgagggcatgaagatggaggagagcaagctgatcaaggccaaggagagcgacggcggcagaatcaaggagctggagaagggcaaggaggagaaggagatcaagatggagaagaccgacgagaccagactgcagaaggaggccgagttcgagaagagcgccaaggagaacctgagagacagcaaggagctgagaaacttcgaggccctgcagatcgacgacatcatggccatcaagatggaggaccccaaggagatcagaaaggaggagctggaggaggaccacaagtgcagccacttccccgacttcagctacagcgccagcagcaagatcatcatcagcgacgtgcccagcagaaaggaccacatgtgccacccccacggcatcatgatcatcgaggaccccgccgccctgaacaagcccgagaagctgaagaagaagaagaagaagagcaagatggacagacacggcaacgacaagagcacccccaagaagacctgcaagaagagacagagcagcgagagcgacatcgagagcgtgatctacaccatcgaggccgtggccaagggcgactggggcatcgagaagctgggcgacacccccagaaagaaggtgagaaccagcagcagcggcaagggcagcatcctggacgccaagccccccaagaagaaggtgaagagcagagagaagaagatgagcaaggagaagagcagcgacaccaccaaggagagcagaccccccgacttcatcagcatcagcgccagcaagaacatcagcggcgagacccccgagggcatcaaggccgagcccctgacccccatggaggacgccctgccccccagcctgagcggccaggccaagcccgaggacagcgactgccacagaaagatcgagacctgcggcagcagaaagagcgagagaagctgcaagggcgccctgtacaagaccctggtgagcgagggcatgctgaccagcctgagagccaacgtggacagaggcaagagaagcagcggcaagggcaacagcagcgaccacgagggctgctggaacgaggagagctggaccttcagccagagcggcaccagcggcagcaagaagttcaagaagaccaagcccaaggaggactgcctgctgggcagcgccaagctggacgaggagttcgagaagaagttcaacagcctgccccagtacagccccgtgaccttcgacagaaagtgcgtgcccgtgcccagaaagaagaagaagaccggcaacgtgagcagcgagcccaccaagaccagcaagggcagcggcgacaagtggagcaacaagcagctgttcctggacgccatccaccccaccgaggccatcttcagcgaggacagaaacaccatggagcccgtgcacaaggtgaagaacatccccagcatcttcaacacccccgagcccaccaccacccaggagcccctggtgggcagccagaagagaaaggccagaaagaccaagatcacccacctggtgagaaccgccgacggcagagtgagccccgccggcggcaccctggacgacaagcccaaggagcagctgcagagaagcctgcccaaggccaccgagaccgactgcaacgacaagtgcagccacaacaccgaggtgggcgagaccagaagcagcacccccgagatgcccgccgtgagcgccttcttcagcctggccgccctggccgaggtggccgccatggagaacgtgcacagaggccagagaagcacccccctgacccacgacggccagcccaaggagatgccccaggcccccgtgctgatcagctgcgccgaccagtag

SEQ ID NO: 7654 - DNA, 450 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgaggacgacgagagccccgagcagagagccagaagacccatgaacgccttcctgctgttctgcaagagacacagaagcctggtgagacaggagcaccccagactggacaacagaggcgccaccaagatcctggccgactggtgggccgtgctggaccccaaggagaagcagaagtacaccgacatggccaaggagtacaaggacgccttcatgaaggccaaccccggctacaagtggtag

SEQ ID NO: 7655 - DNA, 2736 bp, Artificial Sequence; identical to SEQ ID NO: 7653
  Description of Artificial Sequence: Synthetic coding sequence

SEQ ID NO: 7656 - DNA, 75 bp, Artificial Sequence
  Description of Artificial Sequence: Synthetic coding sequence
atgaagggcagcaacagaaacaaggaccacagcgccgagggcgagggcgtgggcaagagacccaagagaaagtag

SEQ ID NO: 7657 - DNA, 582 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgaggacgacgagagccccgagcagagagccagaagacccatgaacgccttcctgctgttctgcaagagacacagaagcctggtgagacaggagcaccccagactggacaacagaggcgccaccaagatcctggccgactggtgggccgtgctggaccccaaggagaagcagaagtacaccgacatggccaaggagtacaaggacgccttcatgaaggccaaccccggctacaagtggtgccccaccaccaacaagcccgtgaagagccccacccccaccgtgaaccccagaaagaagctgtgggccttccccagcgacagcagcagagacctgcccagccccaagaaggccaagaccgaggagatgccctag

SEQ ID NO: 7658 - DNA, 501 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgaggacgacgagagccccgagcagagagccagaagacccatgaacgccttcctgctgttctgcaagagacacagaagcctggtgagacaggagcaccccagactggacaacagaggcgccaccaagatcctggccgactggtgggccgtgctggaccccaaggagaagcagaagtacaccgacatggccaaggagtacaaggacgccttcatgaaggccaaccccggctacaagtggtgccccaccaccaacaagcccgtgaagagccccacccccaccgtgaacccctag

SEQ ID NO: 7659 - DNA, 312 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgaggacgacgagagccccgagcagagagccagaagacccatgaacgccttcctgctgttctgcaagagacacagaagcctggtgagacaggagcacccctag

SEQ ID NO: 7660 - DNA, 480 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgaggacgacgagagccccgagcagagagccagaagacccatgaacgccttcctgctgttctgcaagagacacagaagcctggtgagacaggagcaccccagactggacaacagaggcgccaccaagatcctggccgactggtgggccgtgctggaccccaaggagaagcagaagtacaccgacatggccaaggagtacaaggacgccttcatgaaggccaaccccggctacaagtggtgccccaccaccaacaagcccgtgaagagctag

SEQ ID NO: 7661 - DNA, 345 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgaggacgacgagagccccgagcagagagccagaagacccatgaacgccttcctgctgttctgcaagagacacagaagcctggtgagacaggagcaccccagactggacaacagaggcgccaccaagatcctgtag

SEQ ID NO: 7662 - DNA, 435 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgaggacgacgagagccccgagcagagagccagaagacccatgaacgccttcctgctgttctgcaagagacacagaagcctggtgagacaggagcaccccagactggacaacagaggcgccaccaagatcctggccgactggtgggccgtgctggaccccaaggagaagcagaagtacaccgacatggccaaggagtacaaggacgccttcatgaaggccaactag

SEQ ID NO: 7663 - DNA, 42 bp, Artificial Sequence
  Description of Artificial Sequence: Synthetic coding sequence
atgaagggcagcaacagaaacaaggaccacagcgccgagtag

SEQ ID NO: 7664 - DNA, 618 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgaggacgacgagagccccgagcagagagccagaagacccatgaacgccttcctgctgttctgcaagagacacagaagcctggtgagacaggagcaccccagactggacaacagaggcgccaccaagatcctggccgactggtgggccgtgctggaccccaaggagaagcagaagtacaccgacatggccaaggagtacaaggacgccttcatgaaggccaaccccggctacaagtggtgccccaccaccaacaagcccgtgaagagccccacccccaccgtgaaccccagaaagaagctgtgggccttccccagcgacagcagcagagacctgcccagccccaagaaggccaagaccgaggagatgccccagctgaacttcggcatggccgaccccacccagatgtag

SEQ ID NO: 7665 - DNA, 216 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgagtag

SEQ ID NO: 7666 - DNA, 258 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgaggacgacgagagccccgagcagagagccagaagacccatgaactag

SEQ ID NO: 7667 - DNA, 297 bp, Artificial Sequence
  Description of Artificial Sequence: Synthetic coding sequence
atgaagggcagcaacagaaacaaggaccacagcgccgagggcgagggcgtgggcaagagacccaagagaaagtgcctgcagtggcaccccctgctggccaagaagctgctggacttcagcgaggaggaggaggaggaggacgaggaggaggacatcgacaaggtgcagctgctgggcgccgacggcctggagcaggacgtgggcgagaccgaggacgacgagagccccgagcagagagccagaagacccatgaacgccttcctgctgttctgcaagagacacagaagcctggtgtag

SEQ ID NO: 7668 - DNA, 2466 bp, Artificial Sequence
  Description of Artificial Sequence: Synthetic coding sequence
atggaccccgagtgcgcccagctgctgcccgccctgtgcgccgtgctggtggaccccagacagcccgtggccgacgacacctgcctggagaagctgctggactggttcaagaccgtgaccgagggcgagagcagcgtggtgctgctgcaggagcacccctgcctggtggagctgctgagccacgtgctgaaggtgcaggacctgagcagcggcgtgctgagcttcagcctgagactggccggcaccttcgccgcccaggagaactgcttccagtacctgcagcagggcgagctgctgcccggcctgttcggcgagcccggccccctgggcagagccacctgggccgtgcccaccgtgagaagcggctggatccagggcctgagaagcctggcccagcaccccagcgccctgagattcctggccgaccacggcgccgtggacaccatcttcagcctgcagggcgacagcagcctgttcgtggccagcgccgccagccagctgctggtgcacgtgctggccctgagcatgagaggcggcgccgagggccagccctgcctgcccggcggcgactggcccgcctgcgcccagaagatcatggaccacgtggaggagagcctgtgcagcgccgccacccccaaggtgacccaggccctgaacgtgctgaccaccaccttcggcagatgccagagcccctggaccgaggccctgtgggtgagactgagccccagagtggcctgcctgctggagagagaccccatccccgccgcccacagcttcgtggacctgctgctgtgcgtggccagaagccccgtgttcagcagcagcgacggcagcctgtgggagaccgtggccagagccctgagctgcctgggccccacccacatgggccccctggccctgggcatcctgaagctggagcactgcccccaggccctgagaacccaggccttccaggtgctgctgcagcccctggcctgcgtgctgaaggccaccgtgcaggcccccggcccccccggcctgctggacggcaccgccgacgacgccaccaccgtggacaccctgctggccagcaagagcagctgcgccggcctgctgtgcagaaccctggcccacctggaggagctgcagcccctgccccagagacccagcccctggccccaggccagcctgctgggcgccaccgtgaccgtgctgagactgtgcgacggcagcgccgcccccgccagcagcgtgggcggccacctgtgcggcaccctggccggctgcgtgagagtgcagagagccgccctggacttcctgggcaccctgagccagggcaccggcccccaggagctggtgacccaggccctggccgtgctgctggagtgcctggagagccccggcagcagccccaccgtgctgaagaaggccttccaggccaccctgagatggctgctgagcagccccaagacccccggctgcagcgacctgggccccctgatcccccagttcctgagagagctgttccccgtgctgcagaagagactgtgccacccctgctgggaggtgagagacagcgccctggagttcctgacccagctgagcagacactggggcggccaggccgacttcagatgcgccctgctggccagcgaggtgccccagctggccctgcagctgctgcaggaccccgagagctacgtgagagccagcgccgtgaccgccatgggccagctgagcagccagggcctgcacgcccccaccagccccgagcacgccgaggccagacagagcctgttcctggagctgctgcacatcctgagcgtggacagcgagggcttccccagaagagccgtgatgcaggtgttcaccgagtggctgagagacggccacgccgacgccgcccaggacaccgagcagttcgtggccaccgtgctgcaggccgccagcagagacctggactgggaggtgagagcccagggcctggagctggccctggtgttcctgggccagaccctgggcccccccagaacccactgcccctacgccgtggccctgcccgaggtggcccccgcccagcccctgaccgaggccctgagagccctgtgccacgtgggcctgttcgacttcgccttctgcgccctgttcgactgcgacagacccgtggcccagaagagctgcgacctgctgctgttcctgagagacaagatcgccagctacagcagcctgagagaggccagaggcagccccaacaccgccagcgccgaggccaccctgcccagatggagagccggcgagcaggcccagccccccggcgaccaggagcccgaggccgtgctggccatgctgagaagcctggacctggagggcctgagaagcaccctggccgagagcagcgaccacgtggagaagagcccccagagcctgctgcaggacatgctggccaccggcggcttcctgcagggcgacgaggccgactgctactag

SEQ ID NO: 7669 - DNA, 720 bp, Artificial Sequence
  Description of Artificial Sequence: Synthetic coding sequence
atggccaagccctgcggcgtgagactgagcggcgaggccagaaagcaggtggaggtgttcagacagaacctgttccaggaggccgaggagttcctgtacagattcctgccccagaagatcatctacctgaaccagctgctgcaggaggacagcctgaacgtggccgacctgaccagcctgagagcccccctggacatccccatccccgaccccccccccaaggacgacgagatggagaccgacaagcaggagaagaaggaggtgcacaagtgcggcttcctgcccggcaacgagaaggtgctgagcctgctggccctggtgaagcccgaggtgtggaccctgaaggagaagtgcatcctggtgatcacctggatccagcacctgatccccaagatcgaggacggcaacgacttcggcgtggccatccaggagaaggtgctggagagagtgaacgccgtgaagaccaaggtggaggccttccagaccaccatcagcaagtacttcagcgagagaggcgacgccgtggccaaggccagcaaggagacccacgtgatggactacagagccctggtgcacgagagagacgaggccgcctacggcgagctgagagccatggtgctggacctgagagccttctacgccgagctgtaccacatcatcagcagcaacctggagaagatcgtgaaccccaagggcgaggagaagcccagcatgtactag

SEQ ID NO: 7670 - DNA, 828 bp, Artificial Sequence
  Description of Artificial Sequence: Synthetic coding sequence
atggacgacgaggactgcgagagaagaagaatggagtgcctggacgagatgagcaacctggagaagcagttcaccgacctgaaggaccagctgtacaaggagagactgagccaggtggacgccaagctgcaggaggtgatcgccggcaaggcccccgagtacctggagcccctggccaccctgcaggagaacatgcagatcagaaccaaggtggccggcatctacagagagctgtgcctggagagcgtgaagaacaagtacgagtgcgagatccaggccagcagacagcactgcgagagcgagaagctgctgctgtacgacaccgtgcagagcgagctggaggagaagatcagaagactggaggaggacagacacagcatcgacatcaccagcgagctgtggaacgacgagctgcagagcagaaagaagagaaaggaccccttcagccccgacaagaagaagcccgtggtggtgagcggcccctacatcgtgtacatgctgcaggacctggacatcctggaggactggaccaccatcagaaaggccatggccaccctgggcccccacagagtgaagaccgagccccccgtgaagctggagaagcacctgcacagcgccagaagcgaggagggcagactgtactacgacggcgagtggtacatcagaggccagaccatctgcatcgacaagaaggacgagtgccccaccagcgccgtgatcaccaccatcaaccacgacgaggtgtggttcaagagacccgacggcagcaagagcaagctgtacatcagccagctgcagaagggcaagtacagcatcaagcacagctag

SEQ ID NO: 7671 - DNA, 1614 bp, Artificial Sequence
  Description of Artificial Sequence: Synthetic coding sequence
atgggcgccaccggcgccgccgagcccctgcagagcgtgctgtgggtgaagcagcagagatgcgccgtgagcctggagcccgccagagccctgctgagatggtggagaagccccggccccggcgccggcgcccccggcgccgacgcctgcagcgtgcccgtgagcgagatcatcgccgtggaggagaccgacgtgcacggcaagcaccagggcagcggcaagtggcagaagatggagaagccctacgccttcaccgtgcactgcgtgaagagagccagaagacacagatggaagtgggcccaggtgaccttctggtgccccgaggagcagctgtgccacctgtggctgcagaccctgagagagatgctggagaagctgaccagcagacccaagcacctgctggtgttcatcaaccccttcggcggcaagggccagggcaagagaatctacgagagaaaggtggcccccctgttcaccctggccagcatcaccaccgacatcatcgtgaccgagcacgccaaccaggccaaggagaccctgtacgagatcaacatcgacaagtacgacggcatcgtgtgcgtgggcggcgacggcatgttcagcgaggtgctgcacggcctgatcggcagaacccagagaagcgccggcgtggaccagaaccaccccagagccgtgctggtgcccagcagcctgagaatcggcatcatccccgccggcagcaccgactgcgtgtgctacagcaccgtgggcaccagcgacgccgagaccagcgccctgcacatcgtggtgggcgacagcctggccatggacgtgagcagcgtgcaccacaacagcaccctgctgagatacagcgtgagcctgctgggctacggcttctacggcgacatcatcaaggacagcgagaagaagagatggctgggcctggccagatacgacttcagcggcctgaagaccttcctgagccaccactgctacgagggcaccgtgagcttcctgcccgcccagcacaccgtgggcagccccagagacagaaagccctgcagagccggctgcttcgtgtgcagacagagcaagcagcagctggaggaggagcagaagaaggccctgtacggcctggaggccgccgaggacgtggaggagtggcaggtggtgtgcggcaagttcctggccatcaacgccaccaacatgagctgcgcctgcagaagaagccccagaggcctgagccccgccgcccacctgggcgacggcagcagcgacctgatcctgatcagaaagtgcagcagattcaacttcctgagattcctgatcagacacaccaaccagcaggaccagttcgacttcaccttcgtggaggtgtacagagtgaagaagttccagttcaccagcaagcacatggaggacgaggacagcgacctgaaggagggcggcaagaagagattcggccacatctgcagcagccaccccagctgctgctgcaccgtgagcaacagcagctggaactgcgacggcgaggtgctgcacagccccgccatcgaggtgagagtgcactgccagctggtgagactgttcgccagaggcatcgaggagaaccccaagcccgacagccacagctag

SEQ ID NO: 7672 - DNA, 2355 bp, Artificial Sequence
  Description of Artificial Sequence: Synthetic coding sequence
atgcagagcagaaagtgcctgaagagagactgcgaccagcaggccgacggcctgtgcagattcggcagcttcgactgcttcagaagcagcagaagaagcagcagcaccaccagagcctggaccagcgccagcagaaccagaaccagcgacagactgaacagaatcgccaaccaggtggccatccagagaaagaagcagttcgtggagagagcccacagctactggctgctgaagagactgagcagaaacggcgcccccctgctgagaagactgcagagcagcctgcagagccagagaagcagccagcagagagagaacgacgaggagatgaaggccgccaaggagaagctgaagtactggcagagactgagacacgacctggagagagccagactgctgatcgagctgctgagaaagagagagaagctgaagagagagcaggtgaaggtggagcaggtggccatggagctgagactgacccccctgaccgtgctgctgagaagcgtgctggaccagctgcaggacaaggaccccgccagaatcttcgcccagcccgtgagcctgaaggaggtgcccgactacctggaccacatcaagcaccccatggacttcgccaccatgagaaagagactggaggcccagggctacaagaacctgcacgagttcgaggaggacttcgacctgatcatcgacaactgcatgaagtacaacgccagagacaccgtgttctacagagccgccgtgagactgagagaccagggcggcgtggtgctgagacaggccagaagagaggtggacagcatcggcctggaggaggccagcggcatgcacctgcccgagagacccgccgccgcccccagaagacccttcagctgggaggacgtggacagactgctggaccccgccaacagagcccacctgggcctggaggagcagctgagagagctgctggacatgctggacctgacctgcgccatgaagagcagcggcagcagaagcaagagagccaagctgctgaagaaggagatcgccctgctgagaaacaagctgagccagcagcacagccagcccctgcccaccggccccggcctggagggcttcgaggaggacggcgccgccctgggccccgaggccggcgaggagggcgacaagagcccccccaagctggagcccagcgacgccctgcccctgcccagcaacagcgagaccaacagcgagccccccaccctgaagcccgtggagctgaaccccgagcagagcaagctgttcaagagagtgaccttcgacaacgagagccacagcgcctgcacccagagcgccctggtgagcggcagaccccccgagcccaccagagccagcagcggcgacgtgcccgccgccgccgccagcgccgtggccgagcccgccagcgacgtgaacagaagaaccagcgtgctgttctgcaagagcaagagcgtgagcccccccaagagcgccaagaacaccgagacccagcccaccagcccccagctgggcaccaagaccttcctgagcgtggtgctgcccagactggagaccctgctgcagcccagaaagagaagcagaagcacctgcggcgacagcgaggtggaggaggagagccccggcaagagactggacgccggcctgaccaacggcttcggcggcgccagaagcgagcaggagcccggcggcggcctgggcagaaaggccacccccagaagaagatgcgccagcgagagcagcatcagcagcagcaacagccccctgtgcgacagcagcttcaacgcccccaagtgcggcagaggcaagcccgccctggtgagaagacacaccctggaggacagaagcgagctgatcagctgcatcgagaacggcaactacgccaaggccgccagaatcgccgccgaggtgggccagagcagcatgtggatcagcaccgacgccgccgccagcgtgctggagcccctgaaggtggtgtgggccaagtgcagcggctaccccagctaccccgccctgatcatcgaccccaagatgcccagagtgcccggccaccacaacggcgtgaccatccccgccccccccctggacgtgctgaagatcggcgagcacatgcagaccaagagcgacgagaagctgttcctggtgctgttcttcgacaacaagagaagctggcagtggctgcccaagagcaagatggtgcccctgggcatcgacgagaccatcgacaagctgaagatgatggagggcagaaacagcagcatcagaaaggccgtgagaatcgccttcgacagagccatgaaccacctgagcagagtgcacggcgagcccaccagcgacctgagcgacatcgactag

SEQ ID NO: 7673 - DNA, 3177 bp, Artificial Sequence
  Description of Artificial Sequence: Synthetic coding sequence
atgagaagaaagggcagatgccacagaggcagcgccgccagacaccccagcagcccctgcagcgtgaagcacagccccaccagagagaccctgacctacgcccaggcccagagaatggtggagatcgagatcgagggcagactgcacagaatcagcatcttcgaccccctggagatcatcctggaggacgacctgaccgcccaggagatgagcgagtgcaacagcaacaaggagaacagcgagagaccccccgtgtgcctgagaaccaagagacacaagaacaacagagtgaagaagaagaacgaggccctgcccagcgcccacggcacccccgccagcgccagcgccctgcccgagcccaaggtgagaatcgtggagtacagcccccccagcgcccccagaagaccccccgtgtactacaagttcatcgagaagagcgccgaggagctggacaacgaggtggagtacgacatggacgaggaggactacgcctggctggagatcgtgaacgagaagagaaagggcgactgcgtgcccgccgtgagccagagcatgttcgagttcctgatggacagattcgagaaggagagccactgcgagaaccagaagcagggcgagcagcagagcctgatcgacgaggacgccgtgtgctgcatctgcatggacggcgagtgccagaacagcaacgtgatcctgttctgcgacatgtgcaacctggccgtgcaccaggagtgctacggcgtgccctacatccccgagggccagtggctgtgcagacactgcctgcagagcagagccagacccgccgactgcgtgctgtgccccaacaagggcggcgccttcaagaagaccgacgacgacagatggggccacgtggtgtgcgccctgtggatccccgaggtgggcttcgccaacaccgtgttcatcgagcccatcgacggcgtgagaaacatcccccccgccagatggaagctgacctgctacctgtgcaagcagaagggcgtgggcgcctgcatccagtgccacaaggccaactgctacaccgccttccacgtgacctgcgcccagaaggccggcctgtacatgaagatggagcccgtgaaggagctgaccggcggcggcaccaccttcagcgtgagaaagaccgcctactgcgacgtgcacaccccccccggctgcaccagaagacccctgaacatctacggcgacgtggagatgaagaacggcgtgtgcagaaaggagagcagcgtgaagaccgtgagaagcaccagcaaggtgagaaagaaggccaagaaggccaagaaggccctggccgagccctgcgccgtgctgcccaccgtgtgcgccccctacatccccccccagagactgaacagaatcgccaaccaggtggccatccagagaaagaagcagttcgtggagagagcccacagctactggctgctgaagagactgagcagaaacggcgcccccctgctgagaagactgcagagcagcctgcagagccagagaagcagccagcagagagagaacgacgaggagatgaaggccgccaaggagaagctgaagtactggcagagactgagacacgacctggagagagccagactgctgatcgagctgctgagaaagagagagaagctgaagagagagcaggtgaaggtggagcaggtggccatggagctgagactgacccccctgaccgtgctgctgagaagcgtgctggaccagctgcaggacaaggaccccgccagaatcttcgcccagcccgtgagcctgaaggaggtgcccgactacctggaccacatcaagcaccccatggacttcgccaccatgagaaagagactggaggcccagggctacaagaacctgcacgagttcgaggaggacttcgacctgatcatcgacaactgcatgaagtacaacgccagagacaccgtgttctacagagccgccgtgagactgagagaccagggcggcgtggtgctgagacaggccagaagagaggtggacagcatcggcctggaggaggccagcggcatgcacctgcccgagagacccgccgccgcccccagaagacccttcagctgggaggacgtggacagactgctggaccccgccaacagagcccacctgggcctggaggagcagctgagagagctgctggacatgctggacctgacctgcgccatgaagagcagcggcagcagaagcaagagagccaagctgctgaagaaggagatcgccctgctgagaaacaagctgagccagcagcacagccagcccctgcccaccggccccggcctggagggcttcgaggaggacggcgccgccctgggccccgaggccggcgaggaggtgctgcccagactggagaccctgctgcagcccagaaagagaagcagaagcacctgcggcgacagcgaggtggaggaggagagccccggcaagagactggacgccggcctgaccaacggcttcggcggcgccagaagcgagcaggagcccggcggcggcctgggcagaaaggccacccccagaagaagatgcgccagcgagagcagcatcagcagcagcaacagccccctgtgcgacagcagcttcaacgcccccaagtgcggcagaggcaagcccgccctggtgagaagacacaccctggaggacagaagcgagctgatcagctgcatcgagaacggcaactacgccaaggccgccagaatcgccgccgaggtgggccagagcagcatgtggatcagcaccgacgccgccgccagcgtgctggagcccctgaaggtggtgtgggccaagtgcagcggctaccccagctaccccgccctgatcatcgaccccaagatgcccagagtgcccggccaccacaacggcgtgaccatccccgccccccccctggacgtgctgaagatcggcgagcacatgcagaccaagagcgacgagaagctgttcctggtgctgttcttcgacaacaagagaagctggcagtggctgcccaagagcaagatggtgcccctgggcatcgacgagaccatcgacaagctgaagatgatggagggcagaaacagcagcatcagaaaggccgtgagaatcgccttcgacagagccatgaaccacctgagcagagtgcacggcgagcccaccagcgacctgagcgacatcgactag

SEQ ID NO: 7674 - DNA, 1950 bp, Artificial Sequence
  Description of Artificial Sequence: Synthetic coding sequence
atgaaggccgccaaggagaagctgaagagagagcaggtgaaggtggagcaggtggccatggagctgagactgacccccctgaccgtgctgctgagaagcgtgctggaccagctgcaggacaaggaccccgccagaatcttcgcccagcccgtgagcctgaaggaggtgcccgactacctggaccacatcaagcaccccatggacttcgccaccatgagaaagagactggaggcccagggctacaagaacctgcacgagttcgaggaggacttcgacctgatcatcgacaactgcatgaagtacaacgccagagacaccgtgttctacagagccgccgtgagactgagagaccagggcggcgtggtgctgagacaggccagaagagaggtggacagcatcggcctggaggaggccagcggcatgcacctgcccgagagacccgccgccgcccccagaagacccttcagctgggaggacgtggacagactgctggaccccgccaacagagcccacctgggcctggaggagcagctgagagagctgctggacatgctggacctgacctgcgccatgaagagcagcggcagcagaagcaagagagccaagctgctgaagaaggagatcgccctgctgagaaacaagctgagccagcagcacagccagcccctgcccaccggccccggcctggagggcttcgaggaggacggcgccgccctgggccccgaggccggcgaggagggcgacaagagcccccccaagctggagcccagcgacgccctgcccctgcccagcaacagcgagaccaacagcgagccccccaccctgaagcccgtggagctgaaccccgagcagagcaagctgttcaagagagtgaccttcgacaacgagagccacagcgcctgcacccagagcgccctggtgagcggcagaccccccgagcccaccagagccagcagcggcgacgtgcccgccgccgccgccagcgccgtggccgagcccgccagcgacgtgaacagaagaaccagcgtgctgttctgcaagagcaagagcgtgagcccccccaagagcgccaagaacaccgagacccagcccaccagcccccagctgggcaccaagaccttcctgagcgtggtgctgcccagactggagaccctgctgcagcccagaaagagaagcagaagcacctgcggcgacagcgaggtggaggaggagagccccggcaagagactggacgccggcctgaccaacggcttcggcggcgccagaagcgagcaggagcccggcggcggcctgggcagaaaggccacccccagaagaagatgcgccagcgagagcagcatcagcagcagcaacagccccctgtgcgacagcagcttcaacgcccccaagtgcggcagaggcaagcccgccctggtgagaagacacaccctggaggacagaagcgagctgatcagctgcatcgagaacggcaactacgccaaggccgccagaatcgccgccgaggtgggccagagcagcatgtggatcagcaccgacgccgccgccagcgtgctggagcccctgaaggtggtgtgggccaagtgcagcggctaccccagctaccccgccctgatcatcgaccccaagatgcccagagtgcccggccaccacaacggcgtgaccatccccgccccccccctggacgtgctgaagatcggcgagcacatgcagaccaagagcgacgagaagctgttcctggtgctgttcttcgacaacaagagaagctggcagtggctgcccaagagcaagatggtgcccctgggcatcgacgagaccatcgacaagctgaagatgatggagggcagaaacagcagcatcagaaaggccgtgagaatcgccttcgacagagccatgaaccacctgagcagagtgcacggcgagcccaccagcgacctgagcgacatcgactag

SEQ ID NO: 7675 - DNA, 2988 bp, Artificial Sequence
  Description of Artificial Sequence: Synthetic coding sequence
atgagaagaaagggcagatgccacagaggcagcgccgccagacaccccagcagcccctgcagcgtgaagcacagccccaccagagagaccctgacctacgcccaggcccagagaatggtggagatcgagatcgagggcagactgcacagaatcagcatcttcgaccccctggagatcatcctggaggacgacctgaccgcccaggagatgagcgagtgcaacagcaacaaggagaacagcgagagaccccccgtgtgcctgagaaccaagagacacaagaacaacagagtgaagaagaagaacgaggccctgcccagcgcccacggcacccccgccagcgccagcgccctgcccgagcccaaggtgagaatcgtggagtacagcccccccagcgcccccagaagaccccccgtgtactacaagttcatcgagaagagcgccgaggagctggacaacgaggtggagtacgacatggacgaggaggactacgcctggctggagatcgtgaacgagaagagaaagggcgactgcgtgcccgccgtgagccagagcatgttcgagttcctgatggacagattcgagaaggagagccactgcgagaaccagaagcagggcgagcagcagagcctgatcgacgaggacgccgtgtgctgcatctgcatggacggcgagtgccagaacagcaacgtgatcctgttctgcgacatgtgcaacctggccgtgcaccaggagtgctacggcgtgccctacatccccgagggccagtggctgtgcagacactgcctgcagagcagagccagacccgccgactgcgtgctgtgccccaacaagggcggcgccttcaagaagaccgacgacgacagatggggccacgtggtgtgcgccctgtggatccccgaggtgggcttcgccaacaccgtgttcatcgagcccatcgacggcgtgagaaacatcccccccgccagatggaagctgacctgctacctgtgcaagcagaagggcgtgggcgcctgcatccagtgccacaaggccaactgctacaccgccttccacgtgacctgcgcccagaaggccggcctgtacatgaagatggagcccgtgaaggagctgaccggcggcggcaccaccttcagcgtgagaaagaccgcctactgcgacgtgcacaccccccccggctgcaccagaagacccctgaacatctacggcgacgtggagatgaagaacggcgtgtgcagaaaggagagcagcgtgaagaccgtgagaagcaccagcaaggtgagaaagaaggccaagaaggccaagaaggccctggccgagccctgcgccgtgctgcccaccgtgtgcgccccctacatccccccccagagactgaacagaatcgccaaccaggtggccatccagagaaagaagcagttcgtggagagagcccacagctactggctgctgaagagactgagcagaaacggcgcccccctgctgagaagactgcagagcagcctgcagagccagagaagcagccagcagagagagaacgacgaggagatgaaggccgccaaggagaagctgaagtactggcagagactgagacacgacctggagagagccagactgctgatcgagctgctgagaaagagagagaagctgaagagagagcaggtgaaggtggagcaggtggccatggagctgagactgacccccctgaccgtgctgctgagaagcgtgctggaccagctgcaggacaaggaccccgccagaatcttcgcccagcccgtgagcctgaaggaggtgcccgactacctggaccacatcaagcaccccatggacttcgccaccatgagaaagagactggaggcccagggctacaagaacctgcacgagttcgaggaggacttcgacctgatcatcgacaactgcatgaagtacaacgccagagacaccgtgttctacagagccgccgtgagactgagagaccagggcggcgtggtgctgagacaggccagaagagaggtggacagcatcggcctggaggaggccagcggcatgcacctgcccgagagacccgccgccgcccccagaagacccttcagctgggaggacgtggacagactgctggaccccgccaacagagcccacctgggcctggaggagcagctgagagagctgctggacatgctggacctgacctgcgccatgaagagcagcggcagcagaagcaagagagccaagctgctgaagaaggagatcgccctgctgagaaacaagctgagccagcagcacagccagcccctgcccaccggccccggcctggagggcttcgaggaggacggcgccgccctgggccccgaggccggcgaggagggcgacaagagcccccccaagctggagcccagcgacgccctgcccctgcccagcaacagcgagaccaacagcgagccccccaccctgaagcccgtggagctgaaccccgagcagagcaagctgttcaagagagtgaccttcgacaacgagagccacagcgcctgcacccagagcgccctggtgagcggcagaccccccgagcccaccagagccagcagcggcgacgtgcccgccgccgccgccagcgccgtggccgagcccgccagcgacgtgaacagaagaaccagcgtgctgttctgcaagagcaagagcagcttcagaggctggagactgttctgcagccagggcaagggcagaggcgcccacgccgagacccccagatggagaagaagcccccaggagagcgcctggacccaggtgagccccaccgccctgggcgtgagaggcgccagcagaagcagagccgccgcctggggcggcagaccccaccccgacgacgccgtgccccccagccccgccagcccccccgccaccgccagaagcgccaccagagccctgatgagacccaacgtgggcggcgccaacagactgctgtgcgacggcaccagatggagaaccgccgtgagctag

SEQ ID NO: 7676 - DNA, 2241 bp, Artificial Sequence
  Description of Artificial Sequence: Synthetic coding sequence
atgaagatggagcccgtgaaggagctgaccggcggcggcaccaccttcagcgtgagaaagaccgcctactgcgacgtgcacaccccccccggctgcaccagaagacccctgaacatctacggcgacgtggagatgaagaacggcgtgtgcagaaaggagagcagcgtgaagaccgtgagaagcaccagcaaggtgagaaagaaggccaagaaggccaagaaggccctggccgagccctgcgccgtgctgcccaccgtgtgcgccccctacatccccccccagagattcatcagaatgcagagcagaaagtgcctgaagagagactgcgaccagcaggccgacggcctgtgcagattcggcagcttcgactgcttcagaagcagcagaagaagcagcagcaccaccagagcctggaccagcgccagcagaaccagaaccagcgacagactgaacagaatcgccaaccaggtggccatccagagaaagaagcagttcgtggagagagcccacagctactggctgctgaagagactgagcagaaacggcgcccccctgctgagaagactgcagagcagcctgcagagccagagaagcagccagcagagagagaacgacgaggagatgaaggccgccaaggagaagctgaagtactggcagagactgagacacgacctggagagagccagactgctgatcgagctgctgagaaagagagagaagctgaagagagagcaggtgaaggtggagcaggtggccatggagctgagactgacccccctgaccgtgctgctgagaagcgtgctggaccagctgcaggacaaggaccccgccagaatcttcgcccagcccgtgcccgactacctggaccacatcaagcaccccatggacttcgccaccatgagaaagagactggaggcccagggctacaagaacctgcacgagttcgaggaggacttcgacctgatcatcgacaactgcatgaagtacaacgccagagacaccgtgttctacagagccgccgtgagactgagagaccagggcggcgtggtgctgagacaggccagaagagaggtggacagcatcggcctggaggaggccagcggcatgcacctgcccgagagacccgccgccgcccccagaagacccttcagctgggaggacgtggacagactgctggaccccgccaacagagcccacctgggcctggaggagcagctgagagagctgctggacatgctggacctgacctgcgccatgaagagcagcggcagcagaagcaagagagccaagctgctgaagaaggagatcgccctgctgagaaacaagctgagccagcagcacagccagcccctgcccaccggccccggcctggagggcttcgaggaggacggcgccgccctgggccccgaggccggcgaggaggtgctgcccagactggagaccctgctgcagcccagaaagagaagcagaagcacctgcggcgacagcgaggtggaggaggagagccccggcaagagactggacgccggcctgaccaacggcttcggcggcgccagaagcgagcaggagcccggcggcggcctgggcagaaaggccacccccagaagaagatgcgccagcgagagcagcatcagcagcagcaacagccccctgtgcgacagcagcttcaacgcccccaagtgcggcagaggcaagcccgccctggtgagaagacacaccctggaggacagaagcgagctgatcagctgcatcgagaacggcaactacgccaaggccgccagaatcgccgccgaggtgggccagagcagcatgtggatcagcaccgacgccgccgccagcgtgctggagcccctgaaggtggtgtgggccaagtgcagcggctaccccagctaccccgccctgatcatcgaccccaagatgcccagagtgcccggccaccacaacggcgtgaccatccccgccccccccctggacgtgctgaagatcggcgagcacatgcagaccaagagcgacgagaagctgttcctggtgctgttcttcgacaacaagagaagctggcagtggctgcccaagagcaagatggtgcccctgggcatcgacgagaccatcgacaagctgaagatgatggagggcagaaacagcagcatcagaaaggccgtgagaatcgccttcgacagagccatgaaccacctgagcagagtgcacggcgagcccaccagcgacctgagcgacatcgactag

SEQ ID NO: 7677 - DNA, 2181 bp, Artificial Sequence
  Description of Artificial Sequence: Synthetic coding sequence
atgagcaccgccaccaccgtggcccccgccggcatccccgccacccccggccccgtgaacccccccccccccgaggtgagcaaccccagcaagcccggcagaaagaccaaccagctgcagtacatgcagaacgtggtggtgaagaccctgtggaagcaccagttcgcctggcccttctaccagcccgtggacgccatcaagctgaacctgcccgactaccacaagatcatcaagaaccccatggacatgggcaccatcaagaagagactggagaacaactactactggagcgccagcgagtgcatgcaggacttcaacaccatgttcaccaactgctacatctacaacaagcccaccgacgacatcgtgctgatggcccaggccctggagaagatcttcctgcagaaggtggcccagatgccccaggaggaggtggagctgctgccccccgcccccaagggcaagggcagaaagcccgccgccggcgcccagagcgccggcacccagcaggtggccgccgtgagcagcgtgagccccgccacccccttccagagcgtgccccccaccgtgagccagacccccgtgatcgccgccacccccgtgcccaccatcaccgccaacgtgaccagcgtgcccgtgccccccgccgccgccccccccccccccgccacccccatcgtgcccgtggtgccccccaccccccccgtggtgaagaagaagggcgtgaagagaaaggccgacaccaccacccccaccaccagcgccatcaccgccagcagaagcgagagccccccccccctgagcgaccccaagcaggccaaggtggtggccagaagagagagcggcggcagacccatcaagccccccaagaaggacctggaggacggcgaggtgccccagcacgccggcaagaagggcaagctgagcgagcacctgagatactgcgacagcatcctgagagagatgctgagcaagaagcacgccgcctacgcctggcccttctacaagcccgtggacgccgaggccctggagctgcacgactaccacgacatcatcaagcaccccatggacctgagcaccgtgaagagaaagatggacggcagagagtaccccgacgcccagggcttcgccgccgacgtgagactgatgttcagcaactgctacaagtacaacccccccgaccacgaggtggtggccatggccagaaagctgcaggacgtgttcgagatgagattcgccaagatgcccgacgagcccgtggaggcccccgccctgcccgcccccgccgcccccatggtgagcaagggcgccgagagcagcagaagcagcgaggagagcagcagcgacagcggcagcagcgacagcgaggaggagagagccaccagactggccgagctgcaggagcagctgaaggccgtgcacgagcagctggccgccctgagccaggcccccgtgaacaagcccaagaagaagaaggagaagaaggagaaggagaagaagaagaaggacaaggagaaggagaaggagaagcacaaggtgaaggccgaggaggagaagaaggccaaggtggccccccccgccaagcaggcccagcagaagaaggcccccgccaagaaggccaacagcaccaccaccgccggcagacagctgaagaagggcggcaagcaggccagcgccagctacgacagcgaggaggaggaggagggcctgcccatgagctacgacgagaagagacagctgagcctggacatcaacagactgcccggcgagaagctgggcagagtggtgcacatcatccagagcagagagcccagcctgagagacagcaaccccgacgagatcgagatcgacttcgagaccctgaagcccaccaccctgagagagctggagagatacgtgaagagctgcctgcagaagaagcagagaaagcccttcagcgccagcggcaagaagcaggccgccaagagcaaggaggagctggcccaggagaagaagaaggagctggagaagagactgcaggacgtgagcggccagctgagcagcagcaagaagcccgccagaaaggagaagcccggcagcgcccccagcggcggccccagcagactgagcagcagcagcagcagcgagagcggcagcagcagcagcagcggcagcagcagcgacagcagcgacagcgagtag

SEQ ID NO: 7678 - DNA, 1671 bp, Artificial Sequence
  Description of Artificial Sequence: Synthetic coding sequence
atgagcaccgccaccaccgtggcccccgccggcatccccgccacccccggccccgtgaacccccccccccccgaggtgagcaaccccagcaagcccggcagaaagaccaaccagctgcagtacatgcagaacgtggtggtgaagaccctgtggaagcaccagttcgcctggcccttctaccagcccgtggacgccatcaagctgaacctgcccgactaccacaagatcatcaagaaccccatggacatgggcaccatcaagaagagactggagaacaactactactggagcgccagcgagtgcatgcaggacttcaacaccatgttcaccaactgctacatctacaacaagcccaccgacgacatcgtgctgatggcccaggccctggagaagatcttcctgcagaaggtggcccagatgccccaggaggaggtggagctgctgccccccgcccccaagggcaagggcagaaagcccgccgccggcgcccagagcgccggcacccagcaggtggccgccgtgagcagcgtgagccccgccacccccttccagagcgtgccccccaccgtgagccagacccccgtgatcgccgccacccccgtgcccaccatcaccgccaacgtgaccagcgtgcccgtgccccccgccgccgccccccccccccccgccacccccatcgtgcccgtggtgccccccaccccccccgtggtgaagaagaagggcgtgaagagaaaggccgacaccaccacccccaccaccagcgccatcaccgccagcagaagcgagagccccccccccctgagcgaccccaagcaggccaaggtggtggccagaagagagagcggcggcagacccatcaagccccccaagaaggacctggaggacggcgaggtgccccagcacgccggcaagaagggcaagctgagcgagcacctgagatactgcgacagcatcctgagagagatgctgagcaagaagcacgccgcctacgcctggcccttctacaagcccgtggacgccgaggccctggagctgcacgactaccacgacatcatcaagcaccccatggacctgagcaccgtgaagagaaagatggacggcagagagtaccccgacgcccagggcttcgccgccgacgtgagactgatgttcagcaactgctacaagtacaacccccccgaccacgaggtggtggccatggccagaaagctgcaggacgtgttcgagatgagattcgccaagatgcccgacgagcccgtggaggcccccgccctgcccgcccccgccgcccccatggtgagcaagggcgccgagagcagcagaagcagcgaggagagcagcagcgacagcggcagcagcgacagcgaggaggagagagccaccagactggccgagctgcaggagcagctgaaggccgtgcacgagcagctggccgccctgagccaggcccccgtgaacaagcccaagaagaagaaggagaagaaggagaaggagaagaagaagaaggacaaggagaaggagaaggagaagcacaaggtgaaggccgaggaggagaagaaggccaaggtggccccccccgccaagcaggcccagcagaagaaggcccccgccaagaaggccaacagcaccaccaccgccggcagagaccacttcctgacctgcggcgtgtag

SEQ ID NO: 7679 - DNA, 1671 bp, Artificial Sequence; identical to SEQ ID NO: 7678
  Description of Artificial Sequence: Synthetic coding sequence

SEQ ID NO: 7680 - DNA, 225 bp, Artificial Sequence
  Description of Artificial Sequence: Synthetic coding sequence
atgagcaccgccaccaccgtggcccccgccggcatccccgccacccccggccccgtgaacccccccccccccgaggtgagcaaccccagcaagcccggcagaaagaccaaccagctgcagtacatgcagaacgtggtggtgaagaccctgtggaagcaccagttcgcctggcccttctaccagcccgtggacgccatcaagctgaacctgcccgactaccactag

SEQ ID NO: 7681 - DNA, 63 bp, Artificial Sequence
  Description of Artificial Sequence: Synthetic coding sequence
atgagcaccgccaccaccgtggcccccgccggcatccccgccacccccggccccgtgaactag

SEQ ID NO: 7682 - DNA, 1218 bp, Artificial Sequence
  Description of Artificial Sequence: Synthetic coding sequence
atgctgagcaagaagcacgccgcctacgcctggcccttctacaagcccgtggacgccgaggccctggagctgcacgactaccacgacatcatcaagcaccccatggacctgagcaccgtgaagagaaagatggacggcagagagtaccccgacgcccagggcttcgccgccgacgtgagactgatgttcagcaactgctacaagtacaacccccccgaccacgaggtggtggccatggccagaaagctgcaggacgtgttcgagatgagattcgccaagatgcccgacgagcccgtggaggcccccgccctgcccgcccccgccgcccccatggtgagcaagggcgccgagagcagcagaagcagcgaggagagcagcagcgacagcggcagcagcgacagcgaggaggagagagccaccagactggccgagctgcaggagcagctgaaggccgtgcacgagcagctggccgccctgagccaggcccccgtgaacaagcccaagaagaagaaggagaagaaggagaaggagaagaagaagaaggacaaggagaaggagaaggagaagcacaaggtgaaggccgaggaggagaagaaggccaaggtggccccccccgccaagcaggcccagcagaagaaggcccccgccaagaaggccaacagcaccaccaccgccggcagacagctgaagaagggcggcaagcaggccagcgccagctacgacagcgaggaggaggaggagggcctgcccatgagctacgacgagaagagacagctgagcctggacatcaacagactgcccggcgagaagctgggcagagtggtgcacatcatccagagcagagagcccagcctgagagacagcaaccccgacgagatcgagatcgacttcgagaccctgaagcccaccaccctgagagagctggagagatacgtgaagagctgcctgcagaagaagcagagaaagcccttcagcgccagcggcaagaagcaggccgccaagagcaaggaggagctggcccaggagaagaagaaggagctggagaagagactgcaggacgtgagcggccagctgagcagcagcaagaagcccgccagaaaggagaagcccggcagcgcccccagcggcggccccagcagactgagcagcagcagcagcagcgagagcggcagcagcagcagcagcggcagcagcagcgacagcagcgacagcgagtag

SEQ ID NO: 7683 - DNA, 1062 bp, Artificial Sequence
  Description of Artificial Sequence: Synthetic coding sequence
atggccgccaccaagagaaagagaagaggcggcttcgccgtgcaggccaagaagcccaagagaaacgagatcgacgccgagccccccgccaagagacacgccaccgccgaggaggtggaggaggaggagagagacagaatccccggccccgtgtgcaagggcaagtggaagaacaaggagagaatcctgatcttcagcagcagaggcatcaacttcagaaccagacacctgatgcaggacctgagaatgctgatgccccacagcaaggccgacaccaagatggacagaaaggacaagctgttcgtgatcaacgaggtgtgcgagatgaagaactgcaacaagtgcatctacttcgaggccaagaagaagcaggacctgtacatgtggctgagcaacagcccccacggccccagcgccaagttcctggtgcagaacatccacaccctggccgagctgaagatgaccggcaactgcctgaagggcagcagacccctgctgagcttcgaccccgccttcgacgagctgccccactacgccctgctgaaggagctgctgatccagatcttcagcacccccagataccaccccaagagccagcccttcgtggaccacgtgttcaccttcaccatcctggacaacagaatctggttcagaaacttccagatcatcgaggaggacgccgccctggtggagatcggccccagattcgtgctgaacctgatcaagatcttccagggcagcttcggcggccccaccctgtacgagaacccccactaccagagccccaacatgcacagaagagtgatcagaagcatcaccgccgccaagtacagagagaagcagcaggtgaaggacgtgcagaagctgagaaagaaggagcccaagaccctgctgccccacgaccccaccgccgacgtgttcgtgacccccgccgaggagaagcccatcgagatccagtgggtgaagcccgagcccaaggtggacctgaaggccagaaagaagagaatctacaagagacagagaaagatgaagcagagaatggacagcggcaagaccaagtag

SEQ ID NO: 7684 - DNA, 1428 bp, Artificial Sequence
  Description of Artificial Sequence: Synthetic coding sequence
atggccggcagaccccacccctacgacggcaacagcagcgaccccgagaactgggacagaaagctgcacagcagacccagaaagctgtacaagcacagcagcaccagcagcagaatcgccaagggcggcgtggaccacaccaagatgagcctgcacggcgccagcggcggccacgagagaagcagagacagaagaagaagcagcgacagaagcagagacagcagccacgagagaaccgagagccagctgaccccctgcatcagaaacgtgaccagccccaccagacagcaccacgtggagagagagaaggaccacagcagcagcagacccagcagccccagaccccagaaggccagccccaacggcagcatcagcagcgccggcaacagcagcagaaacagcagccagagcagcagcgacggcagctgcaagaccgccggcgagatggtgttcgtgtacgagaacgccaaggagggcgccagaaacatcagaaccagcgagagagtgaccctgatcgtggacaacaccagattcgtggtggaccccagcatcttcaccgcccagcccaacaccatgctgggcagaatgttcggcagcggcagagagcacaacttcaccagacccaacgagaagggcgagtacgaggtggccgagggcatcggcagcaccgtgttcagagccatcctggactactacaagaccggcatcatcagatgccccgacggcatcagcatccccgagctgagagaggcctgcgactacctgtgcatcagcttcgagtacagcaccatcaagtgcagagacctgagcgccctgatgcacgagctgagcaacgacggcgccagaagacagttcgagttctacctggaggagatgatcctgcccctgatggtggccagcgcccagagcggcgagagagagtgccacatcgtggtgctgaccgacgacgacgtggtggactgggacgaggagtaccccccccagatgggcgaggagtacagccagatcatctacagcaccaagctgtacagattcttcaagtacatcgagaacagagacgtggccaagagcgtgctgaaggagagaggcctgaagaagatcagactgggcatcgagggctaccccacctacaaggagaaggtgaagaagagacccggcggcagacccgaggtgatctacaactacgtgcagagacccttcatcagaatgagctgggagaaggaggagggcaagagcagacacgtggacttccagtgcgtgaagagcaagagcatcaccaacctggccgccgccgccgccgacatcccccaggaccagctggtggtgatgcaccccaccccccaggtggacgagctggacatcctgcccatccacccccccagcggcaacagcgacctggaccccgacgcccagaaccccatgctgtag

SEQ ID NO: 7685 - DNA, 195 bp, Artificial Sequence
  Description of Artificial Sequence: Synthetic coding sequence
atggccggcagaccccacccctacgacggcaacagcagcgaccccgagaactgggacagaaagctgcacagcagacccagaaagctgtacaagcacagcagcaccagcagcagaatcgccaagggcggcgtggaccacaccaagatgagcctgcacggcgccagcggcggccacgagagaagcagagacagatag

SEQ ID NO: 7686 - DNA, 201 bp, Artificial Sequence
  Description of Artificial Sequence: Synthetic coding sequence
atggccggcagaccccacccctacgacggcaacagcagcgaccccgagaactgggacagaaagctgcacagcagacccagaaagctgtacaagcacagcagcaccagcagcagaatcgccaagggcggcgtggaccacaccaagatgagcctgcacggcgccagcggcggccacgagagaagcagagacagaagaagatag

SEQ ID NO: 7687 - DNA, 1137 bp, Artificial Sequence
  Description of Artificial Sequence: Synthetic coding sequence
atggccagatgcggcgagggcagcgccgcccccatggtgctgctgggcagcgccggcgtgtgcagcaagggcctgcagagaaagggcccctgcgagagaagaagactgaaggccaccgtgagcgagcagctgagccaggacctgctgagactgctgagagaggagttccacaccgacgtgaccttcagcgtgggctgcaccctgttcaaggcccacaaggccgtgctgctggccagagtgcccgacttctacttccacaccatcggccagaccagcaacagcctgaccaaccaggagcccatcgccgtggagaacgtggaggccctggagttcagaaccttcctgcagatcatctacagcagcaacagaaacatcaagaactacgaggaggagatcctgagaaagaagatcatggagatcggcatcagccagaagcagctggacatcagcttccccaagtgcgagaacagcagcgactgcagcctgcagaagcacgagatccccgaggacatcagcgacagagacgacgacttcatcagcaacgacaactacgacctggagcccgccagcgagctgggcgaggacctgctgaagctgtacgtgaagccctgctgccccgacatcgacatcttcgtggacggcaagagattcaaggcccacagagccatcctgagcgccagaagcagctacttcgccgccatgctgagcggctgctgggccgagagcagccaggagtacgtgaccctgcagggcatcagccacgtggagctgaacgtgatgatgcacttcatctacggcggcaccctggacatccccgacaagaccaacgtgggccagatcctgaacatggccgacatgtacggcctggagggcctgaaggaggtggccatctacatcctgagaagagactactgcaacttcttccagaagcccgtgcccagaaccctgaccagcatcctggagtgcctgatcatcgcccacagcgtgggcgtggagagcctgttcgccgactgcatgaagtggatcgtgaagcacttcgccagattctggagcgagagaagcttcgccaacatcccccccgagatccagaagagctgcctgaacatgctgatccagagcctggtgagcatcacctag

SEQ ID NO: 7688 - DNA, 918 bp, Artificial Sequence
  Description of Artificial Sequence: Synthetic coding sequence
atggccagatgcggcgagggcagcgccgcccccatggtgctgctgggcagcgccggcgtgtgcagcaagggcctgcagagaaagggcccctgcgagagaagaagactgaaggccaccgtgagcgagcagctgagccaggacctgctgagactgctgagagaggagttccacaccgacgtgaccttcagcgtgggctgcaccctgttcaaggcccacaaggccgtgctgctggccagagtgcccgacttctacttccacaccatcggccagaccagcaacagcctgaccaaccaggagcccatcgccgtggagaacgtggaggccctggagttcagaaccttcctgcagatcatctacagcagcaacagaaacatcaagaactacgaggaggagatcctgagaaagaagatcatggagatcggcatcagccagaagcagctggacatcagcttccccaagtgcgagaacagcagcgactgcagcctgcagaagcacgagatccccgaggacatcagcgacagagacgacgacttcatcagcaacgacaactacgacctggagcccgccagcgagctgggcgaggacctgctgaagctgtacgtgaagccctgctgccccgacatcgacatcttcgtggacggcaagagattcaaggcccacagagccatcctgagcgccagaagcagctacttcgccgccatgctgagcggctgctgggccgagagcagccaggagtacgtgaccctgcagggcatcagccacgtggagctgaacgtgatgatgcacttcatctacggcggcaccctggacatccccgacaagaccaacgtgggctacgtgttcctgttcaacaacctgaagtacaagagagtgagattctgcttcgtggagctgtgctgcaaggtgctgatgaagtag

SEQ ID NO: 7689 - DNA, 852 bp, Artificial Sequence
  Description of Artificial Sequence: Synthetic coding sequence
atggccagatgcggcgagggcagcgccgcccccatggtgctgctgggcagcgccggcgtgtgcagcaagggcctgcagagaaagggcccctgcgagagaagaagactgaaggccaccgtgagcgagcagctgagccaggacctgctgagactgctgagagaggagttccacaccgacgtgaccttcagcgtgggctgcaccctgttcaaggcccacaaggccgtgctgctggccagagtgcccgacttctacttccacaccatcggccagaccagcaacagcctgaccaaccaggagcccatcgccgtggagaacgtggaggccctggagttcagaaccttcctgcagatcatctacagcagcaacagaaacatcaagaactacgaggaggagatcctgagaaagaagatcatggagatcggcatcagccagaagcagctggacatcagcttccccaagtgcgagaacagcagcgactgcagcctgcagaagcacgagatccccgaggacatcagcgacagagacgacgacttcatcagcaacgacaactacgacctggagcccgccagcgagctgggcgaggacctgctgaagctgtacgtgaagccctgctgccccgacatcgacatcttcgtggacggcaagagattcaaggcccacagagccatcctgagcgccagaagcagctacttcgccgccatgctgagcggctgctgggccgagagcagccaggagtacgtgaccctgcagggcatcagccacgtggagctgaacgtgatgatgcacttcatctacggcggcaccctggacatccccgacaagaccaacgtgggcctgttccccgagcactag

SEQ ID NO: 7690 - DNA, 360 bp, Artificial Sequence
  Description of Artificial Sequence: Synthetic coding sequence
atggccggcctgatgaccatcgtgaccagcctgctgttcctgggcgtgtgcgcccaccacatcatccccaccggcagcgtggtgatccccagcccctgctgcatgttcttcgtgagcaagagaatccccgagaacagagtggtgagctaccagctgagcagcagaagcacctgcctgaaggccggcgtgatcttcaccaccaagaagggccagcagttctgcggcgaccccaagcaggagtgggtgcagagatacatgaagaacctggacgccaagcagaagaaggccagccccagagccagagccgtggccgtgaagggccccgtgcagagataccccggcaaccagaccacctgctag

SEQ ID NO: 7691 - DNA, 435 bp, Artificial Sequence
  Description of Artificial Sequence: Synthetic coding sequence
atgcccaaggtgaagagaagcagaaaggccccccccgacggctgggagctgatcgagcccaccctggacgagctggaccagaagatgagagaggccgagaccgagccccacgagggcaagagaaaggtggagagcctgtggcccatcttcagaatccaccaccagaagaccagatacatcttcgacctgttctacaagagaaaggccatcagcagagagctgtacgagtactgcatcaaggagggctacgccgacaagaacctgatcgccaagtggaagaagcagggctacgagaacctgtgctgcctgagatgcatccagaccagagacaccaacttcggcaccaactgcatctgcagagtgcccaagagcaagctggaggtgggcagaatcatcgagtgcacccactgcggctgcagaggctgcagcggctag

SEQ ID NO: 7692 - DNA, 312 bp, Artificial Sequence
  Description of Artificial Sequence: Synthetic coding sequence
atgcccaaggtgaagagaagcagaaaggccccccccgacggctgggagctgatcgagcccaccctggacgagctggaccagaagatgagagaggagctgtacgagtactgcatcaaggagggctacgccgacaagaacctgatcgccaagtggaagaagcagggctacgagaacctgtgctgcctgagatgcatccagaccagagacaccaacttcggcaccaactgcatctgcagagtgcccaagagcaagctggaggtgggcagaatcatcgagtgcacccactgcggctgcagaggctgcagcggctag

SEQ ID NO: 7693 - DNA, 1527 bp, Artificial Sequence
  Description of Artificial Sequence: Synthetic coding sequence
atgatctacgaggagagcaagatgaacctggagcaggagagacccttcgtgtgcagcgcccccggctgcagccagagattccccaccgaggaccacctgatgatccacagacacaagcacgagatgaccctgaagttccccagcatcaagaccgacaacatgctgagcgaccagacccccacccccaccagattcctgaagaactgcgaggaggtgggcctgttcagcgagctggactgcagcctggagcacgagttcagaaaggcccaggaggaggagagcagcaagagaaacatcagcatgcacaacgccgtgggcggcgccatgaccggccccggcacccaccagctgagcagcgccagactgcccaaccacgacaccaacgtggtgatccagcaggccatgcccagcccccagagcagcagcgtgatcacccaggcccccagcaccaacagacagatcggccccgtgcccggcagcctgagcagcctgctgcacctgcacaacagacagagacagcccatgcccgccagcatgcccggcaccctgcccaaccccaccatgcccggcagcagcgccgtgctgatgcccatggagagacagatgagcgtgaacagcagcatcatgggcatgcagggccccaacctgagcaacccctgcgccagcccccaggtgcagcccatgcacagcgaggccaagatgagactgaaggccgccctgacccaccaccccgccgccatgagcaacggcaacatgaacaccatgggccacatgatggagatgatgggcagcagacaggaccagaccccccaccaccacatgcacagccacccccaccagcaccagaccctgcccccccaccacccctacccccaccagcaccagcaccccgcccaccacccccacccccagccccaccaccagcagaaccacccccaccaccacagccacagccacctgcacgcccaccccgcccaccaccagaccagcccccacccccccctgcacaccggcaaccaggcccaggtgagccccgccacccagcagatgcagcccacccagaccatccagcccccccagcccaccggcggcagaagaagaagagtggtggacgaggaccccgacgagagaagaagaaagttcctggagagaaacagagccgccgccaccagatgcagacagaagagaaaggtgtgggtgatgagcctggagaagaaggccgaggagctgacccagaccaacatgcagctgcagaacgaggtgagcatgctgaagaacgaggtggcccagctgaagcagctgctgctgacccacaaggactgccccatcaccgccatgcagaaggagagccagggctacctgagccccgagagcagcccccccgccagccccgtgcccgcctgcagccagcagcaggtgatccagcacaacaccatcaccaccagcagcagcgtgagcgaggtggtgggcagcagcaccctgagccagctgaccacccacagaaccgacctgaaccccatcctgtag

SEQ ID NO: 7694 - DNA, 1110 bp, Artificial Sequence
  Description of Artificial Sequence: Synthetic coding sequence
atgttctgcaccagcggcggcaacagcgccagcgtgatgagcatgagacccgtgcccggcagcctgagcagcctgctgcacctgcacaacagacagagacagcccatgcccgccagcatgcccggcaccctgcccaaccccaccatgcccggcagcagcgccgtgctgatgcccatggagagacagatgagcgtgaacagcagcatcatgggcatgcagggccccaacctgagcaacccctgcgccagcccccaggtgcagcccatgcacagcgaggccaagatgagactgaaggccgccctgacccaccaccccgccgccatgagcaacggcaacatgaacaccatgggccacatgatggagatgatgggcagcagacaggaccagaccccccaccaccacatgcacagccacccccaccagcaccagaccctgcccccccaccacccctacccccaccagcaccagcaccccgcccaccacccccacccccagccccaccaccagcagaaccacccccaccaccacagccacagccacctgcacgcccaccccgcccaccaccagaccagcccccacccccccctgcacaccggcaaccaggcccaggtgagccccgccacccagcagatgcagcccacccagaccatccagcccccccagcccaccggcggcagaagaagaagagtggtggacgaggaccccgacgagagaagaagaaagttcctggagagaaacagagccgccgccaccagatgcagacagaagagaaaggtgtgggtgatgagcctggagaagaaggccgaggagctgacccagaccaacatgcagctgcagaacgaggtgagcatgctgaagaacgaggtggcccagctgaagcagctgctgctgacccacaaggactgccccatcaccgccatgcagaaggagagccagggctacctgagccccgagagcagcccccccgccagccccgtgcccgcctgcagccagcagcaggtgatccagcacaacaccatcaccaccagcagcagcgtgagcgaggtggtgggcagcagcaccctgagccagctgaccacccacagaaccgacctgaaccccatcctgtag

SEQ ID NO: 7695 - DNA, 1428 bp, Artificial Sequence
  Description of Artificial Sequence: Synthetic coding sequence
atgatccacagacacaagcacgagatgaccctgaagttccccagcatcaagaccgacaacatgctgagcgaccagacccccacccccaccagattcctgaagaactgcgaggaggtgggcctgttcagcgagctggactgcagcctggagcacgagttcagaaaggcccaggaggaggagagcagcaagagaaacatcagcatgcacaacgccgtgggcggcgccatgaccggccccggcacccaccagctgagcagcgccagactgcccaaccacgacaccaacgtggtgatccagcaggccatgcccagcccccagagcagcagcgtgatcacccaggcccccagcaccaacagacagatcggccccgtgcccggcagcctgagcagcctgctgcacctgcacaacagacagagacagcccatgcccgccagcatgcccggcaccctgcccaaccccaccatgcccggcagcagcgccgtgctgatgcccatggagagacagatgagcgtgaacagcagcatcatgggcatgcagggccccaacctgagcaacccctgcgccagcccccaggtgcagcccatgcacagcgaggccaagatgagactgaaggccgccctgacccaccaccccgccgccatgagcaacggcaacatgaacaccatgggccacatgatggagatgatgggcagcagacaggaccagaccccccaccaccacatgcacagccacccccaccagcaccagaccctgcccccccaccacccctacccccaccagcaccagcaccccgcccaccacccccacccccagccccaccaccagcagaaccacccccaccaccacagccacagccacctgcacgcccaccccgcccaccaccagaccagcccccacccccccctgcacaccggcaaccaggcccaggtgagccccgccacccagcagatgcagcccacccagaccatccagcccccccagcccaccggcggcagaagaagaagagtggtggacgaggaccccgacgagagaagaagaaagttcctggagagaaacagagccgccgccaccagatgcagacagaagagaaaggtgtgggtgatgagcctggagaagaaggccgaggagctgacccagaccaacatgcagctgcagaacgaggtgagcatgctgaagaacgaggtggcccagctgaagcagctgctgctgacccacaaggactgccccatcaccgccatgcagaaggagagccagggctacctgagccccgagagcagcccccccgccagccccgtgcccgcctgcagccagcagcaggtgatccagcacaacaccatcaccaccagcagcagcgtgagcgaggtggtgggcagcagcaccctgagccagctgaccacccacagaaccgacctgaaccccatcctgtag

SEQ ID NO: 7696 - DNA, 1506 bp, Artificial Sequence
  Description of Artificial Sequence: Synthetic coding sequence
atgaacctggagcaggagagacccttcgtgtgcagcgcccccggctgcagccagagattccccaccgaggaccacctgatgatccacagacacaagcacgagatgaccctgaagttccccagcatcaagaccgacaacatgctgagcgaccagacccccacccccaccagattcctgaagaactgcgaggaggtgggcctgttcagcgagctggactgcagcctggagcacgagttcagaaaggcccaggaggaggagagcagcaagagaaacatcagcatgcacaacgccgtgggcggcgccatgaccggccccggcacccaccagctgagcagcgccagactgcccaaccacgacaccaacgtggtgatccagcaggccatgcccagcccccagagcagcagcgtgatcacccaggcccccagcaccaacagacagatcggccccgtgcccggcagcctgagcagcctgctgcacctgcacaacagacagagacagcccatgcccgccagcatgcccggcaccctgcccaaccccaccatgcccggcagcagcgccgtgctgatgcccatggagagacagatgagcgtgaacagcagcatcatgggcatgcagggccccaacctgagcaacccctgcgccagcccccaggtgcagcccatgcacagcgaggccaagatgagactgaaggccgccctgacccaccaccccgccgccatgagcaacggcaacatgaacaccatgggccacatgatggagatgatgggcagcagacaggaccagaccccccaccaccacatgcacagccacccccaccagcaccagaccctgcccccccaccacccctacccccaccagcaccagcaccccgcccaccacccccacccccagccccaccaccagcagaaccacccccaccaccacagccacagccacctgcacgcccaccccgcccaccaccagaccagcccccacccccccctgcacaccggcaaccaggcccaggtgagccccgccacccagcagatgcagcccacccagaccatccagcccccccagcccaccggcggcagaagaagaagagtggtggacgaggaccccgacgagagaagaagaaagttcctggagagaaacagagccgccgccaccagatgcagacagaagagaaaggtgtgggtgatgagcctggagaagaaggccgaggagctgacccagaccaacatgcagctgcagaacgaggtgagcatgctgaagaacgaggtggcccagctgaagcagctgctgctgacccacaaggactgccccatcaccgccatgcagaaggagagccagggctacctgagccccgagagcagcccccccgccagccccgtgcccgcctgcagccagcagcaggtgatccagcacaacaccatcaccaccagcagcagcgtgagcgaggtggtgggcagcagcaccctgagccagctgaccacccacagaaccgacctgaaccccatcctgtag

SEQ ID NO: 7697 - DNA, 1428 bp, Artificial Sequence; identical to SEQ ID NO: 7695
  Description of Artificial Sequence: Synthetic coding sequence

SEQ ID NO: 7698 - DNA, 348 bp, Artificial Sequence
  Description of Artificial Sequence: Synthetic coding sequence
atgaacctggagcaggagagacccttcgtgtgcagcgcccccggctgcagccagagattccccaccgaggaccacctgatgatccacagacacaagcacgagatgaccctgaagttccccagcatcaagaccgacaacatgctgagcgaccagacccccacccccaccagattcctgaagaactgcgaggaggtgggcctgttcagcgagctggactgcagcctggagcacgagttcagaaaggcccaggaggaggagagcagcaagagaaacatcagcatgcacaacgccgtgggcggcgccatgaccggccccggcacccaccagctgagcagcgccagactgtag

SEQ ID NO: 7699 - DNA, 453 bp, Artificial Sequence
  Description of Artificial Sequence: Synthetic coding sequence
atgagcaagatcagccagcagaacagcacccccggcgtgaacggcatcagcgtgatccacacccaggcccacgccagcggcctgcagcaggtgccccagctggtgcccgccggccccggcggcggcggcaaggccgtggcccccagcaagcagagcaagaagagcagccccatggacagaaacagcgacgagtacagacagagaagagagagaaacaacatggccgtgaagaagagcagactgaagagcaagcagaaggcccaggacaccctgcagagagtgaaccagctgaaggaggagaacgagagactggaggccaagatcaagctgctgaccaaggagctgagcgtgctgaaggacctgttcctggagcacgcccacaacctggccgacaacgtgcagagcatcagcaccgagaacaccaccgccgacggcgacaacgccggccagtag

SEQ ID NO: 7700 - DNA, 1509 bp, Artificial Sequence
  Description of Artificial Sequence: Synthetic coding sequence
atggagaccctgcaggagagcctgaacaccctgctgaagcagctggaggaggagaagaagaccctggagagccaggtgaagtactacgccctgaagctggagcaggagagcaaggcctaccagaagatcaacaacgagagaagaacctacctggccgagatgagccagggcagcggcctgcaccaggtgagcaagagacagcaggtggaccagctgcccagaatgcaggagaacctggtgaagaccctgctgctgaaggaggagctggaccccctgaaggccaagatcgacatcctgctggtgggcgacgtgaccgtgggctacctggccgacaccgtgcagaagctgttcgccaacatcgccgaggtgaccatcaccatcagcgacaccaaggaggccgccgccctgctggacgactgcatcttcaacatggtgctgctgaaggtgcccagcagcctgagcgccgaggagctggaggccatcaagctgatcagattcggcaagaagaagaacacccacagcctgttcgtgttcatcatccccgagaacttcaagggctgcatcagcggccacggcatggacatcgccctgaccgagcccctgaccatggagaagatgagcaacgtggtgaagtactggaccacctgccccagcaacaccgtgaagaccgagaacgccaccggccccgaggagctgggcctgcccctgcagagaagctacagcgagcacctgggctacttccccaccgacctgttcgcctgcagcgagagcctgagaaacggcaacggcctggagctgaacgccagcctgagcgagttcgagaagaacaagaagatcagcctgctgcacagcagcaaggagaagctgagaagagagagaatcaagtactgctgcgagcagctgagaaccctgctgccctacgtgaagggcagaaagaacgacgccgccagcgtgctggaggccaccgtggactacgtgaagtacatcagagagaagatcagccccgccgtgatggcccagatcaccgaggccctgcagagcaacatgagattctgcaagaagcagcagacccccatcgagctgagcctgcccggcaccgtgatggcccagagagagaacagcgtgatgagcacctacagccccgagagaggcctgcagttcctgaccaacacctgctggaacggctgcagcacccccgacgccgagagcagcctggacgaggccgtgagagtgcccagcagcagcgccagcgagaacgccatcggcgacccctacaagacccacatcagcagcgccgccctgagcctgaacagcctgcacaccgtgagatactacagcaaggtgacccccagctacgacgccaccgccgtgaccaaccagaacatcagcatccacctgcccagcgccatgccccccgtgagcaagctgctgcccagacactgcaccagcggcctgggccagacctgcaccacccaccccaactgcctgcagcagttctgggcctactag

SEQ ID NO: 7701 - DNA, 1533 bp, Artificial Sequence
  Description of Artificial Sequence: Synthetic coding sequence
atggaggagccccaggccggcgacgccgccagattcagctgcccccccaacttcaccgccaagccccccgccagcgagagccccagattcagcctggaggccctgaccggccccgacaccgagctgtggctgatccaggcccccgccgacttcgcccccgagtgcttcaacggcagacacgtgcccctgagcggcagccagatcgtgaagggcaagctggccggcaagagacacagatacagagtgctgagcagctgcccccaggccggcgaggccaccctgctggcccccagcaccgaggccggcggcggcctgacctgcgccagcgccccccagggcaccctgagaatcctggagggcccccagcagagcctgagcggcagccccctgcagcccatccccgccagcccccccccccagatcccccccggcctgagacccagattctgcgccttcggcggcaacccccccgtgaccggccccagaagcgccctggcccccaacctgctgaccagcggcaagaagaagaaggagatgcaggtgaccgaggcccccgtgacccaggaggccgtgaacggccacggcgccctggaggtggacatggccctgggcagccccgagatggacgtgagaaagaagaagaagaagaagaaccagcagctgaaggagcccgaggccgccggccccgtgggcaccgagcccaccgtggagaccctggagcccctgggcgtgctgttccccagcaccaccaagaagagaaagaagcccaagggcaaggagaccttcgagcccgaggacaagaccgtgaagcaggagcagatcaacaccgagcccctggaggacaccgtgctgagccccaccaagaagagaaagagacagaagggcaccgagggcatggagcccgaggagggcgtgaccgtggagagccagccccaggtgaaggtggagcccctggaggaggccatccccctgccccccaccaagaagagaaagaaggagaagggccagatggccatgatggagcccggcaccgaggccatggagcccgtggagcccgagatgaagcccctggagagccccggcggcaccatggccccccagcagcccgagggcgccaagccccaggcccaggccgccctggccgcccccaagaagaagaccaagaaggagaagcagcaggacgccaccgtggagcccgagaccgaggtggtgggccccgagctgcccgacgacctggagccccaggccgcccccaccagcaccaagaagaagaagaagaagaaggagagaggccacaccgtgaccgagcccatccagcccctggagcccgagctgcccggcgagggccagcccgaggccagagccacccccggcagcaccaagaagagaaagaagcagagccaggagagcagaatgcccgagaccgtgccccaggaggagatgcccggcccccccctgaacagcgagagcggcgaggaggcccccaccggcagagacaagaagagaaagcagcagcagcagcagcccgtgtag

SEQ ID NO: 7702 - DNA, 1446 bp, Artificial Sequence
  Description of Artificial Sequence: Synthetic coding sequence
atgagacacagcaagagaacccactgccccgactgggacagcagagagagctggggccacgagagctacagaggcagccacaagagaaagagaagaagccacagcagcacccaggagaacagacactgcaagccccaccaccagttcaaggagagcgactgccactacctggaggccagaagcctgaacgagagagactacagagacagaagatacgtggacgagtacagaaacgactactgcgagggctacgtgcccagacactaccacagagacatcgagagcggctacagaatccactgcagcaagagcagcgtgagaagcagaagaagcagccccaagagaaagagaaacagacactgcagcagccaccagagcagaagcaagagccacagaagaaagagaagcagaagcatcgaggacgacgaggagggccacctgatctgccagagcggcgacgtgctgagagccagatacgagatcgtggacaccctgggcgagggcgccttcggcaaggtggtggagtgcatcgaccacggcatggacggcatgcacgtggccgtgaagatcgtgaagaacgtgggcagatacagagaggccgccagaagcgagatccaggtgctggagcacctgaacagcaccgaccccaacagcgtgttcagatgcgtgcagatgctggagtggttcgaccaccacggccacgtgtgcatcgtgttcgagctgctgggcctgagcacctacgacttcatcaaggagaacagcttcctgcccttccagatcgaccacatcagacagatggcctaccagatctgccagagcatcaacttcctgcaccacaacaagctgacccacaccgacctgaagcccgagaacatcctgttcgtgaagagcgactacgtggtgaagtacaacagcaagatgaagagagacgagagaaccctgaagaacaccgacatcaaggtggtggacttcggcagcgccacctacgacgacgagcaccacagcaccctggtgagcaccagacactacagagcccccgaggtgatcctggccctgggctggagccagccctgcgacgtgtggagcatcggctgcatcctgatcgagtactacctgggcttcaccgtgttccagacccacgacagcaaggagcacctggccatgatggagagaatcctgggccccatcccccagcacatgatccagaagaccagaaagagaaagtacttccaccacaaccagctggactgggacgagcacagcagcgccggcagatacgtgagaagaagatgcaagcccctgaaggagttcatgctgtgccacgacgaggagcacgagaagctgttcgacctggtgagaagaatgctggagtacgaccccacccagagaatcaccctggacgaggccctgcagcaccccttcttcgacctgctgaagaagaagtag

SEQ ID NO: 7703 - DNA, 165 bp, Artificial Sequence
  Description of Artificial Sequence: Synthetic coding sequence
atgagacacagcaagagaacccactgccccgactgggacagcagagagagctggggccacgagagctacagaggcagccacaagagaaagagaagaagccacagcagcacccaggagaacagacactgcaagccccaccaccagttcaaggagagcgactggtag

SEQ ID NO: 7704 - DNA, 162 bp, Artificial Sequence
  Description of Artificial Sequence: Synthetic coding sequence
atgagacacagcaagagaacccactgccccgactgggacagcagagagagctggggccacgagagctacagaggcagccacaagagaaagagaagaagccacagcagcacccaggagaacagacactgcaagccccaccaccagttcaaggagagcgactag

SEQ ID NO: 7705 - DNA, 432 bp, Artificial Sequence
  Description of Artificial Sequence: Synthetic coding sequence
atgagacacagcaagagaacccactgccccgactgggacagcagagagagctggggccacgagagctacagaggcagccacaagagaaagagaagaagccacagcagcacccaggagaacagacactgcaagccccaccaccagttcaaggagagcgactgccactacctggaggccagaagcctgaacgagagagactacagagacagaagatacgtggacgagtacagaaacgactactgcgagggctacgtgcccagacactaccacagagacatcgagagcggctacagaatccactgcagcaagagcagcgtgagaagcagaagaagcagccccaagagaaagagaaacagacactgcagcagccaccagagcagaagcatgaagagctggaccctgtgggtgaaggagcccctggccaagctgtag

SEQ ID NO: 7706 - DNA, 270 bp, Artificial Sequence
  Description of Artificial Sequence: Synthetic coding sequence
atgagacacagcaagagaacccactgccccgactgggacagcagagagagctggggccacgagagctacagaggcagccacaagagaaagagaagaagccacagcagcacccaggagaacagacactgcaagccccaccaccagttcaaggagagcgactggacctgcgtggacatcaagaccaacgccctgaccctgatcagactgggctacctgaagggctacagcgagatcttcaccggccacagcgtggacatcctgaagaactag

SEQ ID NO: 7707 - DNA, 1122 bp, Artificial Sequence
  Description of Artificial Sequence: Synthetic coding sequence
atgagacacagcaagagaacccactgccccgactgggacagcagagagagctggggccacgagagctacagaggcagccacaagagaaagagaagaagccacagcagcacccaggagaacagacactgcaagccccaccaccagttcaaggagagcgactgccactacctggaggccagaagcctgaacgagagagactacagagacagaagatacgtggacgagtacagaaacgactactgcgagggctacgtgcccagacactaccacagagacatcgagagcggctacagaatccactgcagcaagagcagcgtgagaagcagaagaagcagccccaagagaaagagaaacagacactgcagcagccaccagagcagaagcaagagccacagaagaaagagaagcagaagcatcgaggacgacgaggagggccacctgatctgccagagcggcgacgtgctgagagccagatacgagatcgtggacaccctgggcgagggcgccttcggcaaggtggtggagtgcatcgaccacggcatggacggcatgcacgtggccgtgaagatcgtgaagaacgtgggcagatacagagaggccgccagaagcgagatccaggtgctggagcacctgaacagcaccgaccccaacagcgtgttcagatgcgtgcagatgctggagtggttcgaccaccacggccacgtgtgcatcgtgttcgagctgctgggcctgagcacctacgacttcatcaaggagaacagcttcctgcccttccagatcgaccacatcagacagatggcctaccagatctgccagagcatcaacttcctgcaccacaacaagctgacccacaccgacctgaagcccgagaacatcctgttcgtgaagagcgactacgtggtgaagtacaacagcaagatgaagagagacgagcacagcagcgccggcagatacgtgagaagaagatgcaagcccctgaaggagttcatgctgtgccacgacgaggagcacgagaagctgttcgacctggtgagaagaatgctggagtacgaccccacccagagaatcaccctggacgaggccctgcagcaccccttcttcgacctgctgaagaagaagtag

SEQ ID NO: 7708 - DNA, 2613 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggccgtgagcagaggcctgcccccccagcagccccagcagcccctgctgaacctgcagggcaccaacagcgccagcctgctgaacggcagcatgctgcagagagccctgctgctgcagcagctgcagggcctggaccagttcgccatgccccccgccacctacgacaccgccggcctgaccatgcccaccgccaccctgggcaacctgagaggctacggcatggccagccccggcctggccgcccccagcctgacccccccccagctggccacccccaacctgcagcagttcttcccccaggccaccagacagagcctgctgggccccccccccgtgggcgtgcccatgaaccccagccagttcaacctgagcggcagaaacccccagaagcaggccagaaccagcagcagcaccacccccaacagaaaggacagcagcagccagaccatgcccgtggaggacaagagcgacccccccgagggcagcgaggaggccgccgagcccagaatggacacccccgaggaccaggacctgcccccctgccccgaggacatcgccaaggagaagagaacccccgcccccgagcccgagccctgcgaggccagcgagctgcccgccaagagactgagaagcagcgaggagcccaccgagaaggagccccccggccagctgcaggtgaaggcccagccccaggccagaatgaccgtgcccaagcagacccagacccccgacctgctgcccgaggccctggaggcccaggtgctgcccagattccagcccagagtgctgcaggtgcaggcccaggtgcagagccagacccagcccagaatccccagcaccgacacccaggtgcagcccaagctgcagaagcaggcccagacccagaccagccccgagcacctggtgctgcagcagaagcaggtgcagccccagctgcagcaggaggccgagccccagaagcaggtgcagccccaggtgcagccccaggcccacagccagggccccagacaggtgcagctgcagcaggaggccgagcccctgaagcaggtgcagccccaggtgcacacccaggcccagcccagcgtgcagccccaggagcacccccccgcccaggtgagcgtgcagccccccgagcagacccacgagcagccccacacccagccccaggtgagcctgctggcccccgagcagacccccgtggtggtgcacgtgtgcggcctggagatgccccccgacgccgtggaggccggcggcggcatggagaagaccctgcccgagcccgtgggcacccaggtgagcatggaggagatccagaacgagagcgcctgcggcctggacgtgggcgagtgcgagaacagagccagagagatgcccggcgtgtggggcgccggcggcagcctgaaggtgaccatcctgcagagcagcgacagcagagccttcagcaccgtgcccctgacccccgtgcccagacccagcgacagcgtgagcagcacccccgccgccaccagcacccccagcaagcaggccctgcagttcttctgctacatctgcaaggccagctgcagcagccagcaggagttccaggaccacatgagcgagccccagcaccagcagagactgggcgagatccagcacatgagccaggcctgcctgctgagcctgctgcccgtgcccagagacgtgctggagaccgaggacgaggagcccccccccagaagatggtgcaacacctgccagctgtactacatgggcgacctgatccagcacagaagaacccaggaccacaagatcgccaagcagagcctgagacccttctgcaccgtgtgcaacagatacttcaagacccccagaaagttcgtggagcacgtgaagagccagggccacaaggacaaggccaaggagctgaagagcctggagaaggagatcgccggccaggacgaggaccacttcatcaccgtggacgccgtgggctgcttcgagggcgacgaggaggaggaggaggacgacgaggacgaggaggagatcgaggtggaggaggagctgtgcaagcaggtgagaagcagagacatcagcagagaggagtggaagggcagcgagacctacagccccaacaccgcctacggcgtggacttcctggtgcccgtgatgggctacatctgcagaatctgccacaagttctaccacagcaacagcggcgcccagctgagccactgcaagagcctgggccacttcgagaacctgcagaagtacaaggccgccaagaaccccagccccaccaccagacccgtgagcagaagatgcgccatcaacgccagaaacgccctgaccgccctgttcaccagcagcggcagaccccccagccagcccaacacccaggacaagacccccagcaaggtgaccgccagacccagccagccccccctgcccagaagaagcaccagactgaagacctag

SEQ ID NO: 7709 - DNA, 759 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggccgtgagcagaggcctgcccccccagcagccccagcagcccctgctgaacctgcagggcaccaacagcgccagcctgctgaacggcagcatgctgcagagagccctgctgctgcagcagctgcagggcctggaccagttcgccatgccccccgccacctacgacaccgccggcctgaccatgcccaccgccaccctgggcaacctgagaggctacggcatggccagccccggcctggccgcccccagcctgacccccccccagctggccacccccaacctgcagcagttcttcccccaggccaccagacagagcctgctgggccccccccccgtgggcgtgcccatgaaccccagccagttcaacctgagcggcagaaacccccagaagcaggccagaaccagcagcagcaccacccccaacagaaaggacagcagcagccagaccatgcccgtggaggacaagagcgacccccccgagggcagcgaggaggccgccgagcccagaatggacacccccgaggaccaggacctgcccccctgccccgaggacatcgccaaggagaagagaacccccgcccccgagcccgagccctgctag

SEQ ID NO: 7710 - DNA, 2610 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggccgtgagcagaggcctgcccccccagcagccccagcagcccctgctgaacctgcagggcaccaacagcgccagcctgctgaacggcagcatgctgcagagagccctgctgctgcagcagctgcagggcaacctgagaggctacggcatggccagccccggcctggccgcccccagcctgacccccccccagctggccacccccaacctgcagcagttcttcccccaggccaccagacagagcctgctgggccccccccccgtgggcgtgcccatgaaccccagccagttcaacctgagcggcagaaacccccagaagcaggccagaaccagcagcagcaccacccccaacagaaagaccatgcccgtggaggacaagagcgacccccccgagggcagcgaggaggccgccgagcccagaatggacacccccgaggaccaggacctgcccccctgccccgaggacatcgccaaggagaagagaacccccgcccccgagcccgagccctgcgaggccagcgagctgcccgccaagagactgagaagcagcgaggagcccaccgagaaggagccccccggccagctgcaggtgaaggcccagccccaggccagaatgaccgtgcccaagcagacccagacccccgacctgctgcccgaggccctggaggcccaggtgctgcccagattccagcccagagtgctgcaggtgcaggcccaggtgcagagccagacccagcccagaatccccagcaccgacacccaggtgcagcccaagctgcagaagcaggcccagacccagaccagccccgagcacctggtgctgcagcagaagcaggtgcagccccagctgcagcaggaggccgagccccagaagcaggtgcagccccaggtgcagccccaggcccacagccagggccccagacaggtgcagctgcagcaggaggccgagcccctgaagcaggtgcagccccaggtgcagccccaggcccacagccagccccccagacaggtgcagctgcagctgcagaagcaggtgcagacccagacctacccccaggtgcacacccaggcccagcccagcgtgcagccccaggagcacccccccgcccaggtgagcgtgcagccccccgagcagacccacgagcagccccacacccagccccaggtgagcctgctggcccccgagcagacccccgtggtggtgcacgtgtgcggcctggagatgccccccgacgccgtggaggccggcggcggcatggagaagaccctgcccgagcccgtgggcacccaggtgagcatggaggagatccagaacgagagcgcctgcggcctggacgtgggcgagtgcgagaacagagccagagagatgcccggcgtgtggggcgccggcggcagcctgaaggtgaccatcctgcagagcagcgacagcagagccttcagcaccgtgcccctgacccccgtgcccagacccagcgacagcgtgagcagcacccccgccgccaccagcacccccagcaagcaggccctgcagttcttctgctacatctgcaaggccagctgcagcagccagcaggagttccaggaccacatgagcgagccccagcaccagcagagactgggcgagatccagcacatgagccaggcctgcctgctgagcctgctgcccgtgcccagagacgtgctggagaccgaggacgaggagcccccccccagaagatggtgcaacacctgccagctgtactacatgggcgacctgatccagcacagaagaacccaggaccacaagatcgccaagcagagcctgagacccttctgcaccgtgtgcaacagatacttcaagacccccagaaagttcgtggagcacgtgaagagccagggccacaaggacaaggccaaggagctgaagagcctggagaaggagatcgccggccaggacgaggaccacttcatcaccgtggacgccgtgggctgcttcgagggcgacgaggaggaggaggaggacgacgaggacgaggaggagatcgaggtggaggaggagctgtgcaagcaggtgagaagcagagacatcagcagagaggagtggaagggcagcgagacctacagccccaacaccgcctacggcgtggacttcctggtgcccgtgatgggctacatctgcagaatctgccacaagttctaccacagcaacagcggcgcccagctgagccactgcaagagcctgggccacttcgagaacctgcagaagtacaaggccgccaagaaccccagccccaccaccagacccgtgagcagaagatgcgccatcaacgccagaaacgccctgaccgccctgttcaccagcagcggcagaccccccagccagcccaacacccaggacaagacccccagcaaggtgaccgccagacccagccagccccccctgcccagaagaagcaccagactgaagacctag

SEQ ID NO: 7711 - DNA, 2613 bp, Artificial Sequence; identical to SEQ ID NO: 7708
  Description of Artificial Sequence: Synthetic coding sequence

SEQ ID NO: 7712 - DNA, 2697 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggccgtgagcagaggcctgcccccccagcagccccagcagcccctgctgaacctgcagggcaccaacagcgccagcctgctgaacggcagcatgctgcagagagccctgctgctgcagcagctgcagggcctggaccagttcgccatgccccccgccacctacgacaccgccggcctgaccatgcccaccgccaccctgggcaacctgagaggctacggcatggccagccccggcctggccgcccccagcctgacccccccccagctggccacccccaacctgcagcagttcttcccccaggccaccagacagagcctgctgggccccccccccgtgggcgtgcccatgaaccccagccagttcaacctgagcggcagaaacccccagaagcaggccagaaccagcagcagcaccacccccaacagaaaggacagcagcagccagaccatgcccgtggaggacaagagcgacccccccgagggcagcgaggaggccgccgagcccagaatggacacccccgaggaccaggacctgcccccctgccccgaggacatcgccaaggagaagagaacccccgcccccgagcccgagccctgcgaggccagcgagctgcccgccaagagactgagaagcagcgaggagcccaccgagaaggagccccccggccagctgcaggtgaaggcccagccccaggccagaatgaccgtgcccaagcagacccagacccccgacctgctgcccgaggccctggaggcccaggtgctgcccagattccagcccagagtgctgcaggtgcaggcccaggtgcagagccagacccagcccagaatccccagcaccgacacccaggtgcagcccaagctgcagaagcaggcccagacccagaccagccccgagcacctggtgctgcagcagaagcaggtgcagccccagctgcagcaggaggccgagccccagaagcaggtgcagccccaggtgcagccccaggcccacagccagggccccagacaggtgcagctgcagcaggaggccgagcccctgaagcaggtgcagccccaggtgcagccccaggcccacagccagccccccagacaggtgcagctgcagctgcagaagcaggtgcagacccagacctacccccaggtgcacacccaggcccagcccagcgtgcagccccaggagcacccccccgcccaggtgagcgtgcagccccccgagcagacccacgagcagccccacacccagccccaggtgagcctgctggcccccgagcagacccccgtggtggtgcacgtgtgcggcctggagatgccccccgacgccgtggaggccggcggcggcatggagaagaccctgcccgagcccgtgggcacccaggtgagcatggaggagatccagaacgagagcgcctgcggcctggacgtgggcgagtgcgagaacagagccagagagatgcccggcgtgtggggcgccggcggcagcctgaaggtgaccatcctgcagagcagcgacagcagagccttcagcaccgtgcccctgacccccgtgcccagacccagcgacagcgtgagcagcacccccgccgccaccagcacccccagcaagcaggccctgcagttcttctgctacatctgcaaggccagctgcagcagccagcaggagttccaggaccacatgagcgagccccagcaccagcagagactgggcgagatccagcacatgagccaggcctgcctgctgagcctgctgcccgtgcccagagacgtgctggagaccgaggacgaggagcccccccccagaagatggtgcaacacctgccagctgtactacatgggcgacctgatccagcacagaagaacccaggaccacaagatcgccaagcagagcctgagacccttctgcaccgtgtgcaacagatacttcaagacccccagaaagttcgtggagcacgtgaagagccagggccacaaggacaaggccaaggagctgaagagcctggagaaggagatcgccggccaggacgaggaccacttcatcaccgtggacgccgtgggctgcttcgagggcgacgaggaggaggaggaggacgacgaggacgaggaggagatcgaggtggaggaggagctgtgcaagcaggtgagaagcagagacatcagcagagaggagtggaagggcagcgagacctacagccccaacaccgcctacggcgtggacttcctggtgcccgtgatgggctacatctgcagaatctgccacaagttctaccacagcaacagcggcgcccagctgagccactgcaagagcctgggccacttcgagaacctgcagaagtacaaggccgccaagaaccccagccccaccaccagacccgtgagcagaagatgcgccatcaacgccagaaacgccctgaccgccctgttcaccagcagcggcagaccccccagccagcccaacacccaggacaagacccccagcaaggtgaccgccagacccagccagccccccctgcccagaagaagcaccagactgaagacctag

SEQ ID NO: 7713 - DNA, 1245 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggccgtgagcagaggcctgcccccccagcagccccagcagcccctgctgaacctgcagggcaccaacagcgccagcctgctgaacggcagcatgctgcagagagccctgctgctgcagcagctgcagggcaacctgagaggctacggcatggccagccccggcctggccgcccccagcctgacccccccccagctggccacccccaacctgcagcagttcttcccccaggccaccagacagagcctgctgggccccccccccgtgggcgtgcccatgaaccccagccagttcaacctgagcggcagaaacccccagaagcaggccagaaccagcagcagcaccacccccaacagaaaggacagcagcagccagaccatgcccgtggaggacaagagcgacccccccgagggcagcgaggaggccgccgagcccagaatggacacccccgaggaccaggacctgcccccctgccccgaggacatcgccaaggagaagagaacccccgcccccgagcccgagccctgcgaggccagcgagctgcccgccaagagactgagaagcagcgaggagcccaccgagaaggagccccccggccagctgcaggtgaaggcccagccccaggccagaatgaccgtgcccaagcagacccagacccccgacctgctgcccgaggccctggaggcccaggtgctgcccagattccagcccagagtgctgcaggtgcaggcccaggtgcagagccagacccagcccagaatccccagcaccgacacccaggtgcagcccaagctgcagaagcaggcccagacccagaccagccccgagcacctggtgctgcagcagaagcaggtgcagccccagctgcagcaggaggccgagccccagaagcaggtgcagccccaggtgcagccccaggcccacagccagggccccagacaggtgcagctgcagcaggaggccgagcccctgaagcaggtgcagccccaggtgcagccccaggcccacagccagccccacctgccccaggtgctgagccagcagctgagaggcaccgccctgcccctgcaggtgcccggccccctgtag

SEQ ID NO: 7714 - DNA, 2529 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggccgtgagcagaggcctgcccccccagcagccccagcagcccctgctgaacctgcagggcaccaacagcgccagcctgctgaacggcagcatgctgcagagagccctgctgctgcagcagctgcagggcctggaccagttcgccatgccccccgccacctacgacaccgccggcctgaccatgcccaccgccaccctgggcaacctgagaggctacggcatggccagccccggcctggccgcccccagcctgacccccccccagctggccacccccaacctgcagcagttcttcccccaggccaccagacagagcctgctgggccccccccccgtgggcgtgcccatgaaccccagccagttcaacctgagcggcagaaacccccagaagcaggccagaaccagcagcagcaccacccccaacagaaaggacagcagcagccagaccatgcccgtggaggacaagagcgacccccccgagggcagcgaggaggccgccgagcccagaatggacacccccgaggaccaggacctgcccccctgccccgaggacatcgccaaggagaagagaacccccgcccccgagcccgagccctgcgaggccagcgagctgcccgccaagagactgagaagcagcgaggagcccaccgagaaggagccccccggccagctgcaggtgaaggcccagccccaggccagaatgaccgtgcccaagcagacccagacccccgacctgctgcccgaggccctggaggcccaggtgctgcccagattccagcccagagtgctgcaggtgcaggcccaggtgcagagccagacccagcccagaatccccagcaccgacacccaggtgcagcccaagctgcagaagcaggcccagacccagaccagccccgagcacctggtgctgcagcagaagcaggtgcagccccagctgcagcaggaggccgagccccagaagcaggtgcagccccaggtgcacacccaggcccagcccagcgtgcagccccaggagcacccccccgcccaggtgagcgtgcagccccccgagcagacccacgagcagccccacacccagccccaggtgagcctgctggcccccgagcagacccccgtggtggtgcacgtgtgcggcctggagatgccccccgacgccgtggaggccggcggcggcatggagaagaccctgcccgagcccgtgggcacccaggtgagcatggaggagatccagaacgagagcgcctgcggcctggacgtgggcgagtgcgagaacagagccagagagatgcccggcgtgtggggcgccggcggcagcctgaaggtgaccatcctgcagagcagcgacagcagagccttcagcaccgtgcccctgacccccgtgcccagacccagcgacagcgtgagcagcacccccgccgccaccagcacccccagcaagcaggccctgcagttcttctgctacatctgcaaggccagctgcagcagccagcaggagttccaggaccacatgagcgagccccagcaccagcagagactgggcgagatccagcacatgagccaggcctgcctgctgagcctgctgcccgtgcccagagacgtgctggagaccgaggacgaggagcccccccccagaagatggtgcaacacctgccagctgtactacatgggcgacctgatccagcacagaagaacccaggaccacaagatcgccaagcagagcctgagacccttctgcaccgtgtgcaacagatacttcaagacccccagaaagttcgtggagcacgtgaagagccagggccacaaggacaaggccaaggagctgaagagcctggagaaggagatcgccggccaggacgaggaccacttcatcaccgtggacgccgtgggctgcttcgagggcgacgaggaggaggaggaggacgacgaggacgaggaggagatcgaggtggaggaggagctgtgcaagcaggtgagaagcagagacatcagcagagaggagtggaagggcagcgagacctacagccccaacaccgcctacggcgtggacttcctggtgcccgtgatgggctacatctgcagaatctgccacaagttctaccacagcaacagcggcgcccagctgagccactgcaagagcctgggccacttcgagaacctgcagaagtacaaggccgccaagaaccccagccccaccaccagacccgtgagcagaagatgcgccatcaacgccagaaacgccctgaccgccctgttcaccagcagcggcagaccccccagccagcccaacacccaggacaagacccccagcaaggtgaccgccagacccagccagccccccctgcccagaagaagcaccagactgaagacctag

SEQ ID NO: 7715 - DNA, 2457 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggccgtgagcagaggcctgcccccccagcagccccagcagcccctgctgaacctgcagggcaccaacagcgccagcctgctgaacggcagcatgctgcagagagccctgctgctgcagcagctgcagggcaacctgagaggctacggcatggccagccccggcctggccgcccccagcctgacccccccccagctggccacccccaacctgcagcagttcttcccccaggccaccagacagagcctgctgggccccccccccgtgggcgtgcccatgaaccccagccagttcaacctgagcggcagaaacccccagaagcaggccagaaccagcagcagcaccacccccaacagaaaggacagcagcagccagaccatgcccgtggaggacaagagcgacccccccgagggcagcgaggaggccgccgagcccagaatggacacccccgaggaccaggacctgcccccctgccccgaggacatcgccaaggagaagagaacccccgcccccgagcccgagccctgcgaggccagcgagctgcccgccaagagactgagaagcagcgaggagcccaccgagaaggagccccccggccagctgcaggtgaaggcccagccccaggccagaatgaccgtgcccaagcagacccagacccccgacctgctgcccgaggccctggaggcccaggtgctgcccagattccagcccagagtgctgcaggtgcaggcccaggtgcagagccagacccagcccagaatccccagcaccgacacccaggtgcagcccaagctgcagaagcaggcccagacccagaccagccccgagcacctggtgctgcagcagaagcaggtgcagccccagctgcagcaggaggccgagccccagaagcaggtgcagccccaggtgcacacccaggcccagcccagcgtgcagccccaggagcacccccccgcccaggtgagcgtgcagccccccgagcagacccacgagcagccccacacccagccccaggtgagcctgctggcccccgagcagacccccgtggtggtgcacgtgtgcggcctggagatgccccccgacgccgtggaggccggcggcggcatggagaagaccctgcccgagcccgtgggcacccaggtgagcatggaggagatccagaacgagagcgcctgcggcctggacgtgggcgagtgcgagaacagagccagagagatgcccggcgtgtggggcgccggcggcagcctgaaggtgaccatcctgcagagcagcgacagcagagccttcagcaccgtgcccctgacccccgtgcccagacccagcgacagcgtgagcagcacccccgccgccaccagcacccccagcaagcaggccctgcagttcttctgctacatctgcaaggccagctgcagcagccagcaggagttccaggaccacatgagcgagccccagcaccagcagagactgggcgagatccagcacatgagccaggcctgcctgctgagcctgctgcccgtgcccagagacgtgctggagaccgaggacgaggagcccccccccagaagatggtgcaacacctgccagctgtactacatgggcgacctgatccagcacagaagaacccaggaccacaagatcgccaagcagagcctgagacccttctgcaccgtgtgcaacagatacttcaagacccccagaaagttcgtggagcacgtgaagagccagggccacaaggacaaggccaaggagctgaagagcctggagaaggagatcgccggccaggacgaggaccacttcatcaccgtggacgccgtgggctgcttcgagggcgacgaggaggaggaggaggacgacgaggacgaggaggagatcgaggtggaggaggagctgtgcaagcaggtgagaagcagagacatcagcagagaggagtggaagggcagcgagacctacagccccaacaccgcctacggcgtggacttcctggtgcccgtgatgggctacatctgcagaatctgccacaagttctaccacagcaacagcggcgcccagctgagccactgcaagagcctgggccacttcgagaacctgcagaagtacaaggccgccaagaaccccagccccaccaccagacccgtgagcagaagatgcgccatcaacgccagaaacgccctgaccgccctgttcaccagcagcggcagaccccccagccagcccaacacccaggacaagacccccagcaaggtgaccgccagacccagccagccccccctgcccagaagaagcaccagactgaagacctag

SEQ ID NO: 7716 - DNA, 2697 bp, Artificial Sequence; identical to SEQ ID NO: 7712
  Description of Artificial Sequence: Synthetic coding sequence

SEQ ID NO: 7717 - DNA, 2463 bp, Artificial Sequence
  Description of Artificial Sequence: Synthetic coding sequence
cccctgcccatggccgtgagcagaggcctgcccccccagcagccccagcagcccctgctgaacctgcagggcaccaacagcgccagcctgctgaacggcagcatgctgcagagagccctgctgctgcagcagctgcagggcaacctgagaggctacggcatggccagccccggcctggccgcccccagcctgacccccccccagctggccacccccaacctgcagcagttcttcccccaggccaccagacagagcctgctgggccccccccccgtgggcgtgcccatgaaccccagccagttcaacctgagcggcagaaacccccagaagcaggccagaaccagcagcagcaccacccccaacagaaagaccatgcccgtggaggacaagagcgacccccccgagggcagcgaggaggccgccgagcccagaatggacacccccgaggaccaggacctgcccccctgccccgaggacatcgccaaggagaagagaacccccgcccccgagcccgagccctgcgaggccagcgagctgcccgccaagagactgagaagcagcgaggagcccaccgagaaggagccccccggccagctgcaggtgaaggcccagccccaggccagaatgaccgtgcccaagcagacccagacccccgacctgctgcccgaggccctggaggcccaggtgctgcccagattccagcccagagtgctgcaggtgcaggcccaggtgcagagccagacccagcccagaatccccagcaccgacacccaggtgcagcccaagctgcagaagcaggcccagacccagaccagccccgagcacctggtgctgcagcagaagcaggtgcagccccagctgcagcaggaggccgagccccagaagcaggtgcagccccaggtgcagccccaggcccacagccagggccccagacaggtgcagctgcagcaggaggccgagcccctgaagcaggtgcagccccaggtgcagccccaggcccacagccagccccccagacaggtgcagctgcagctgcagaagcaggtgcagacccagacctacccccaggtgcacacccaggcccagcccagcgtgcagccccaggagcacccccccgcccaggtgagcgtgcagccccccgagcagacccacgagcagccccacacccagccccaggtgagcctgctggcccccgagcagacccccgtggtggtgcacgtgtgcggcctggagatgccccccgacgccgtggaggccggcggcggcatggagaagaccctgcccgagcccgtgggcacccaggtgagcatggaggagatccagaacgagagcgcctgcggcctggacgtgggcgagtgcgagaacagagccagagagatgcccggcgtgtggggcgccggcggcagcctgaaggtgaccatcctgcagagcagcgacagcagagccttcagcaccgtgcccctgacccccgtgcccagacccagcgacagcgtgagcagcacccccgccgccaccagcacccccagcaagcaggccctgcagttcttctgctacatctgcaaggccagctgcagcagccagcaggagttccaggaccacatgagcgagccccagcaccagcagagactgggcgagatccagcacatgagccaggcctgcctgctgagcctgctgcccgtgcccagagacgtgctggagaccgaggacgaggagcccccccccagaagatggtgcaacacctgccagctgtactacatgggcgacctgatccagcacagaagaacccaggaccacaagatcgccaagcagagcctgagacccttctgcaccgtgtgcaacagatacttcaagacccccagaaagttcgtggagcacgtgaagagccagggccacaaggacaaggccaaggagctgaagagcctggagaaggagatcgccggccaggacgaggaccacttcatcaccgtggacgccgtgggctgcttcgagggcgacgaggaggaggaggaggacgacgaggacgaggaggagatcgaggtggaggaggagctgtgcaagcaggtgagaagcagagacatcagcagagaggagtggaagggcagcgagacctacagccccaacaccgcctacggcgtggacttcctggtgcccgtgatgggctacatctgcagaatctgccacaagttctaccacagcaacagcggcgcccagctgagccactgcaagagcctgggccacttcgagaacctgcagaagtacaaggccgccaagaaccccagccccaccaccagacccgtgagcagaagatgcgccatcaacgccagaaacgccctgaccgccctgttcaccagcagcggcagaccccccagccagcccaacacccaggacaagacccccagcaaggtgaccgccagacccagccagccccccctgcccagaagaagcaccagactgaagacctag

SEQ ID NO: 7718 - DNA, 507 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggccgtgagcagaggcctgcccccccagcagccccagcagcccctgctgaacctgcagggcaccaacagcgccagcctgctgaacggcagcatgctgcagagagccctgctgctgcagcagctgcagggcctggaccagttcgccatgccccccgccacctacgacaccgccggcctgaccatgcccaccgccaccctgggcaacctgagaggctacggcatggccagccccggcctggccgcccccagcctgacccccccccagctggccacccccaacctgcagcagttcttcccccaggccaccagacagagcctgctgggccccccccccgtgggcgtgccctag

SEQ ID NO: 7719 - DNA, 2514 bp, Artificial Sequence
  Description of Artificial Sequence: Synthetic coding sequence
atgttcagccagcagcagcagcagcagctgcagcagcagcagcaggcccccctgcccatggccgtgagcagaggcctgcccccccagcagccccagcagcccctgctgaacctgcagggcaccaacagcgccagcctgctgaacggcagcatgctgcagagagccctgctgctgcagcagctgcagggcctggaccagttcgccatgccccccgccacctacgacaccgccggcctgaccatgcccaccgccaccctgggcaacctgagaggctacggcatggccagccccggcctggccgcccccagcctgacccccccccagctggccacccccaacctgcagcagttcttcccccaggccaccagacagagcctgctgggccccccccccgtgggcgtgcccatgaaccccagccagttcaacctgagcggcagaaacccccagaagcaggccagaaccagcagcagcaccacccccaacagaaaggacagcagcagccagaccatgcccgtggaggacaagagcgacccccccgagggcagcgaggaggccgccgagcccagaatggacacccccgaggaccaggacctgcccccctgccccgaggacatcgccaaggagaagagaacccccgcccccgagcccgagccctgcgaggccagcgagctgcccgccaagagactgagaagcagcgaggagcccaccgagaaggagccccccggccagctgcaggtgaaggcccagccccaggccagaatgaccgtgcccaagcagacccagacccccgacctgctgcccgaggccctggaggcccaggtgctgcccagattccagcccagagtgctgcaggtgcaggcccaggtgcagagccagacccagcccagaatccccagcaccgacacccaggtgcagcccaagctgcagaagcaggcccagacccagaccagccccgagcacctggtgctgcagcagaagcaggtgcagccccagctgcagcaggaggccgagccccagaagcaggtgcagccccaggtgcagccccaggcccacagccagggccccagacaggtgcagctgcagcaggaggccgagcccctgaagcaggtgcagccccaggtgcacacccaggcccagcccagcgtgcagccccaggagcacccccccgcccaggtgagcgtgcagccccccgagcagacccacgagcagccccacacccagccccaggtgagcctgctggcccccgagcagacccccgtggtggtgcacgtgtgcggcctggagatgccccccgacgccgtggaggccggcggcggcatggagaagaccctgcccgagcccgtgggcacccaggtgagcatggaggagatccagaacgagagcgcctgcggcctggacgtgggcgagtgcgagaacagagccagagagatgcccggcgtgtggggcgccggcggcagcctgaaggtgaccatcctgcagagcagcgacagcagagccttcagcaccgtgcccctgacccccgtgcccagacccagcgacagcgtgagcagcacccccgccgccaccagcacccccagcaagcaggccctgcagttcttctgctacatctgcaaggccagctgcagcagccagcaggagttccaggaccacatgagcgagccccagcaccagcagagactgggcgagatccagcacatgagccaggcctgcctgctgagcctgctgcccgtgcccagagacgtgctggagaccgaggacgaggagcccccccccagaagatggtgcaacacctgccagctgtactacatgggcgacctgatccagcacagaagaacccaggaccacaagatcgccaagcagagcctgagacccttctgcaccgtgtgcaacagatacttcaagacccccagaaagttcgtggagcacgtgaagagccagggccacaaggacaaggccaaggagctgaagagcctggagaaggagatcgccggccaggacgaggaccacttcatcaccgtggacgccgtgggctgcttcgagggcgacgaggaggaggaggaggacgacgaggacgaggaggagatcgaggtggaggaggagctgtgcaagcaggtgagaagcagagacatcagcagagaggagtggaagggcagcgagacctacagccccaacaccgcctacggcgtggacttcctggtgcccgtgatgggctacatctgcagaatctgccacaagttctaccacagcaacagcggcgcccagctgagccactgcaagagcctgggccacttcgagaacctgcagaagtacaaggccgccaagaaccccagccccaccaccagacccgtgagcagaagatgcgccatcaacgccagaaacgccctgaccgccctgttcaccagcagcggcagaccccccagccagcccaacacccaggacaagacccccagcaaggtgaccgccagacccagccagccccccctgcccagaagaagcaccagactgaagacctag

SEQ ID NO: 7720 - DNA, 2775 bp, Artificial Sequence
  Description of Artificial Sequence: Synthetic coding sequence
atgttcagccagcagcagcagcagcagctgcagcagcagcagcagcagctgcagcagctgcagcagcagcagctgcagcagcagcagctgcagcagcagcagctgctgcagctgcagcagctgctgcagcagagccccccccaggcccccctgcccatggccgtgagcagaggcctgcccccccagcagccccagcagcccctgctgaacctgcagggcaccaacagcgccagcctgctgaacggcagcatgctgcagagagccctgctgctgcagcagctgcagggcctggaccagttcgccatgccccccgccacctacgacaccgccggcctgaccatgcccaccgccaccctgggcaacctgagaggctacggcatggccagccccggcctggccgcccccagcctgacccccccccagctggccacccccaacctgcagcagttcttcccccaggccaccagacagagcctgctgggccccccccccgtgggcgtgcccatgaaccccagccagttcaacctgagcggcagaaacccccagaagcaggccagaaccagcagcagcaccacccccaacagaaaggacagcagcagccagaccatgcccgtggaggacaagagcgacccccccgagggcagcgaggaggccgccgagcccagaatggacacccccgaggaccaggacctgcccccctgccccgaggacatcgccaaggagaagagaacccccgcccccgagcccgagccctgcgaggccagcgagctgcccgccaagagactgagaagcagcgaggagcccaccgagaaggagccccccggccagctgcaggtgaaggcccagccccaggccagaatgaccgtgcccaagcagacccagacccccgacctgctgcccgaggccctggaggcccaggtgctgcccagattccagcccagagtgctgcaggtgcaggcccaggtgcagagccagacccagcccagaatccccagcaccgacacccaggtgcagcccaagctgcagaagcaggcccagacccagaccagccccgagcacctggtgctgcagcagaagcaggtgcagccccagctgcagcaggaggccgagccccagaagcaggtgcagccccaggtgcagccccaggcccacagccagggccccagacaggtgcagctgcagcaggaggccgagcccctgaagcaggtgcagccccaggtgcagccccaggcccacagccagccccccagacaggtgcagctgcagctgcagaagcaggtgcagacccagacctacccccaggtgcacacccaggcccagcccagcgtgcagccccaggagcacccccccgcccaggtgagcgtgcagccccccgagcagacccacgagcagccccacacccagccccaggtgagcctgctggcccccgagcagacccccgtggtggtgcacgtgtgcggcctggagatgccccccgacgccgtggaggccggcggcggcatggagaagaccctgcccgagcccgtgggcacccaggtgagcatggaggagatccagaacgagagcgcctgcggcctggacgtgggcgagtgcgagaacagagccagagagatgcccggcgtgtggggcgccggcggcagcctgaaggtgaccatcctgcagagcagcgacagcagagccttcagcaccgtgcccctgacccccgtgcccagacccagcgacagcgtgagcagcacccccgccgccaccagcacccccagcaagcaggccctgcagttcttctgctacatctgcaaggccagctgcagcagccagcaggagttccaggaccacatgagcgagccccagcaccagcagagactgggcgagatccagcacatgagccaggcctgcctgctgagcctgctgcccgtgcccagagacgtgctggagaccgaggacgaggagcccccccccagaagatggtgcaacacctgccagctgtactacatgggcgacctgatccagcacagaagaacccaggaccacaagccccccacccccagaagagacgtgttcgcccacgtgcccgtgcagggctggagcaccgccagactggtgaccgacatgatcgccaagcagagcctgagacccttctgcaccgtgtgcaacagatacttcaagacccccagaaagttcgtggagcacgtgaagagccagggccacaaggacaaggccaaggagctgaagagcctggagaaggagatcgccggccaggacgaggaccacttcatcaccgtggacgccgtgggctgcttcgagggcgacgaggaggaggaggaggacgacgaggacgaggaggagatcgaggtggaggaggagctgtgcaagcaggtgagaagcagagacatcagcagagaggagtggaagggcagcgagacctacagccccaacaccgcctacggcgtggacttcctggtgcccgtgatgggctacatctgcagaatctgccacaagttctaccacagcaacagcggcgcccagctgagccactgcaagagcctgggccacttcgagaacctgcagaagtacaaggccgccaagaaccccagccccaccaccagacccgtgagcagaagatgcgccatcaacgccagaaacgccctgaccgccctgttcaccagcagcggcagaccccccagccagcccaacacccaggacaagacccccagcaaggtgaccgccagacccagccagccccccctgcccagaagaagcaccagactgaagacctag

SEQ ID NO: 7721 - DNA, 2394 bp, Artificial Sequence
  Description of Artificial Sequence: Synthetic coding sequence
atgccccccgccacctacgacaccgccggcctgaccatgcccaccgccaccctgggcaacctgagaggctacggcatggccagccccggcctggccgcccccagcctgacccccccccagctggccacccccaacctgcagcagttcttcccccaggccaccagacagagcctgctgggccccccccccgtgggcgtgcccatgaaccccagccagttcaacctgagcggcagaaacccccagaagcaggccagaaccagcagcagcaccacccccaacagaaaggacagcagcagccagaccatgcccgtggaggacaagagcgacccccccgagggcagcgaggaggccgccgagcccagaatggacacccccgaggaccaggacctgcccccctgccccgaggacatcgccaaggagaagagaacccccgcccccgagcccgagccctgcgaggccagcgagctgcccgccaagagactgagaagcagcgaggagcccaccgagaaggagccccccggccagctgcaggtgaaggcccagccccaggccagaatgaccgtgcccaagcagacccagacccccgacctgctgcccgaggccctggaggcccaggtgctgcccagattccagcccagagtgctgcaggtgcaggcccaggtgcagagccagacccagcccagaatccccagcaccgacacccaggtgcagcccaagctgcagaagcaggcccagacccagaccagccccgagcacctggtgctgcagcagaagcaggtgcagccccagctgcagcaggaggccgagccccagaagcaggtgcagccccaggtgcagccccaggcccacagccagggccccagacaggtgcagctgcagcaggaggccgagcccctgaagcaggtgcagccccaggtgcagccccaggcccacagccagccccccagacaggtgcagctgcagctgcagaagcaggtgcagacccagacctacccccaggtgcacacccaggcccagcccagcgtgcagccccaggagcacccccccgcccaggtgagcgtgcagccccccgagcagacccacgagcagccccacacccagccccaggtgagcctgctggcccccgagcagacccccgtggtggtgcacgtgtgcggcctggagatgccccccgacgccgtggaggccggcggcggcatggagaagaccctgcccgagcccgtgggcacccaggtgagcatggaggagatccagaacgagagcgcctgcggcctggacgtgggcgagtgcgagaacagagccagagagatgcccggcgtgtggggcgccggcggcagcctgaaggtgaccatcctgcagagcagcgacagcagagccttcagcaccgtgcccctgacccccgtgcccagacccagcgacagcgtgagcagcacccccgccgccaccagcacccccagcaagcaggccctgcagttcttctgctacatctgcaaggccagctgcagcagccagcaggagttccaggaccacatgagcgagccccagcaccagcagagactgggcgagatccagcacatgagccaggcctgcctgctgagcctgctgcccgtgcccagagacgtgctggagaccgaggacgaggagcccccccccagaagatggtgcaacacctgccagctgtactacatgggcgacctgatccagcacagaagaacccaggaccacaagatcgccaagcagagcctgagacccttctgcaccgtgtgcaacagatacttcaagacccccagaaagttcgtggagcacgtgaagagccagggccacaaggacaaggccaaggagctgaagagcctggagaaggagatcgccggccaggacgaggaccacttcatcaccgtggacgccgtgggctgcttcgagggcgacgaggaggaggaggaggacgacgaggacgaggaggagatcgaggtggaggaggagctgtgcaagcaggtgagaagcagagacatcagcagagaggagtggaagggcagcgagacctacagccccaacaccgcctacggcgtggacttcctggtgcccgtgatgggctacatctgcagaatctgccacaagttctaccacagcaacagcggcgcccagctgagccactgcaagagcctgggccacttcgagaacctgcagaagtacaaggccgccaagaaccccagccccaccaccagacccgtgagcagaagatgcgccatcaacgccagaaacgccctgaccgccctgttcaccagcagcggcagaccccccagccagcccaacacccaggacaagacccccagcaaggtgaccgccagacccagccagccccccctgcccagaagaagcaccagactgaagacctag

SEQ ID NO: 7722 - DNA, 1743 bp, Artificial Sequence
  Description of Artificial Sequence: Synthetic coding sequence
atggcccaggaggtgagcgagtacctgagccagaaccccagagtggccgcctgggtggaggccctgagatgcgacggcgagaccgacaagcactggagacacagaagagacttcctgctgagaaacgccggcgacctggcccccgccggcggcgccgccagcgccagcaccgacgaggccgccgacgccgagagcggcaccagaaacagacagctgcagcagctgatcagcttcagcatggcctgggccaaccacgtgttcctgggctgcagatacccccagaaggtgatggacaagatcctgagcatggccgagggcatcaaggtgaccgacgcccccacctacaccaccagagacgagctggtggccaaggtgaagaagagaggcatcagcagcagcaacgagggcgtggaggagcccagcaagaagagagtgatcgagggcaagaacagcagcgccgtggagcaggaccacgccaagaccagcgccaagaccgagagagccagcgcccagcaggagaacagcagcacctgcatcggcagcgccatcaagagcgagagcggcaacagcgccagaagcagcggcatcagcagccagaacagcagcaccagcgacggcgacagaagcgtgagcagccagagcagcagcagcgtgagcagccaggtgaccaccgccggcagcggcaaggccagcgaggccgaggcccccgacaagcacggcagcgccagcttcgtgagcctgctgaagagcagcgtgaacagccacatgacccagagcaccgacagcagacagcagagcggcagccccaagaagagcgccctggagggcagcagcgccagcgccagccagagcagcagcgagatcgaggtgcccctgctgggcagcagcggcagcagcgaggtggagctgcccctgctgagcagcaagcccagcagcgagaccgccagcagcggcctgaccagcaagaccagcagcgaggccagcgtgagcagcagcgtggccaagaacagcagcagcagcggcaccagcctgctgacccccaagagcagcagcagcaccaacaccagcctgctgaccagcaagagcaccagccaggtggccgccagcctgctggccagcaagagcagcagccagaccagcggcagcctggtgagcaagagcaccagcctggccagcgtgagccagctggccagcaagagcagcagccagaccagcaccagccagctgcccagcaagagcaccagccagagcagcgagagcagcgtgaagttcagctgcaagctgaccaacgaggacgtgaagcagaagcagcccttcttcaacagactgtacaagaccgtggcctggaagctggtggccgtgggcggcttcagccccaacgtgaaccacggcgagctgctgaacgccgccatcgaggccctgaaggccaccctggacgtgttcttcgtgcccctgaaggagctggccgacctgccccagaacaagagcagccaggagagcatcgtgtgcgagctgagatgcaagagcgtgtacctgggcaccggctgcggcaagagcaaggagaacgccaaggccgtggccagcagagaggccctgaagctgttcctgaagaagaaggtggtggtgaagatctgcaagagaaagtacagaggcagcgagatcgaggacctggtgctgctggacgaggagagcagacccgtgaacctgccccccgccctgaagcacccccaggagctgctgtag

SEQ ID NO: 7723 - DNA, 564 bp, Artificial Sequence
  Description of Artificial Sequence: Synthetic coding sequence
atgcccggcgagagacccaccgacgccaccgtgatccccagcgccaagagagagagaaaggccatcaccctggacctgaagctggaggtgctgagaagattcgaggccggcgagaagctgagccagatcgccaaggccctggacctggccatcagcaccgtggccaccatcagagacagcaaggagaagatcaaggccagcagccagatcgccacccccctgagagccagcagactgaccagacacagaagcgccgtgatggagagcatggagcagctgctgagcctgtggctggaggaccagagccagcccaacgccaccctgagcgccgccatcgtgcaggagaaggccgagttcgacgacctgcagagagagcacggcgagggcagccagaccgagagattccacgccagccagggctggctggtgagattcaaggagtgccactgcctgccccacttcaagatgaacagcgccgcccccagcaacaaggacatgtacaccgagatgctgaagagcatcatcgaggagggcgagtacaccccccaggtgagcctgacctag

SEQ ID NO: 7724 - DNA, 312 bp, Artificial Sequence
  Description of Artificial Sequence: Synthetic coding sequence
atggccctgagcaccatcgtgagccagagaaagcagatcaagagaaaggcccccagaggcttcctgaagagagtgttcaagagaaagaagccccagctgagactggagaagagcggcgacctgctggtgagattccaccccttcagcggctgggagtggggcaccggcgaggtgcacctgaactgcctgctgttcgtgcacagactggccgaggagagcagaaccaacgcctgcgccagcaagtgcagagtgatcaacaaggagcacgtgctggccgccgccaaggtgatcctgaagaagagcagaggctag

SEQ ID NO: 7725 - DNA, 204 bp, Artificial Sequence
  Description of Artificial Sequence: Synthetic coding sequence
atggccctgagcaccatcgtgagccagagaaagcagatcaagagaaaggcccccagaggcttcctgaagagagtgttcaagagaaagaagccccagctgagactggagaagagcggcgacctgctgaagagccccggccagaccctggtgagagtgaacgtggagagcctgaccagaagcatgtactggccccagcagagatag

SEQ ID NO: 7726 - DNA, 267 bp, Artificial Sequence
  Description of Artificial Sequence: Synthetic coding sequence
atggccctgagcaccatcgtgagccagagaaagcagatcaagagaaaggcccccagaggcttcctgaagagagtgttcaagagaaagaagccccagctgagactggagaagagcggcgacctgctggtgcacctgaactgcctgctgttcgtgcacagactggccgaggagagcagaaccaacgcctgcgccagcaagtgcagagtgatcaacaaggagcacgtgctggccgccgccaaggtgatcctgaagaagagcagaggctag

SEQ ID NO: 7727 - DNA, 3846 bp, Artificial Sequence
  Description of Artificial Sequence: Synthetic coding sequence
atggtgagaaagaagaacccccccctgagaaacgtggccagcgagggcgagggccagatcctggagcccatcggcaccgagagcaaggtgagcggcaagaacaaggagttcagcgccgaccagatgagcgagaacaccgaccagagcgacgccgccgagctgaaccacaaggaggagcacagcctgcacgtgcaggaccccagcagcagcagcaagaaggacctgaagagcgccgtgctgagcgagaaggccggcttcaactacgagagccccagcaagggcggcaacttccccagcttcccccacgacgaggtgaccgacagaaacatgctggccttcagcagccccgccgccggcggcgtgtgcgagcccctgaagagcccccagagagccgaggccgacgacccccaggacatggcctgcacccccagcggcgacagcctggagaccaaggaggaccagaagatgagccccaaggccaccgaggagaccggccaggcccagagcggccaggccaactgccagggcctgagccccgtgagcgtggccagcaagaacccccaggtgcccagcgacggcggcgtgagactgaacaagagcaagaccgacctgctggtgaacgacaaccccgaccccgcccccctgagccccgagctgcaggacttcaagtgcaacatctgcggctacggctactacggcaacgaccccaccgacctgatcaagcacttcagaaagtaccacctgggcctgcacaacagaaccagacaggacgccgagctggacagcaagatcctggccctgcacaacatggtgcagttcagccacagcaaggacttccagaaggtgaacagaagcgtgttcagcggcgtgctgcaggacatcaacagcagcagacccgtgctgctgaacggcacctacgacgtgcaggtgaccagcggcggcaccttcatcggcatcggcagaaagacccccgactgccagggcaacaccaagtacttcagatgcaagttctgcaacttcacctacatgggcaacagcagcaccgagctggagcagcacttcctgcagacccaccccaacaagatcaaggccagcctgcccagcagcgaggtggccaagcccagcgagaagaacagcaacaagagcatccccgccctgcagagcagcgacagcggcgacctgggcaagtggcaggacaagatcaccgtgaaggccggcgacgacacccccgtgggctacagcgtgcccatcaagcccctggacagcagcagacagaacggcaccgaggccaccagctactactggtgcaagttctgcagcttcagctgcgagagcagcagcagcctgaagctgctggagcactacggcaagcagcacggcgccgtgcagagcggcggcctgaaccccgagctgaacgacaagctgagcagaggcagcgtgatcaaccagaacgacctggccaagagcagcgagggcgagaccatgaccaagaccgacaagagcagcagcggcgccaagaagaaggacttcagcagcaagggcgccgaggacaacatggtgaccagctacaactgccagttctgcgacttcagatacagcaagagccacggccccgacgtgatcgtggtgggccccctgctgagacactaccagcagctgcacaacatccacaagtgcaccatcaagcactgccccttctgccccagaggcctgtgcagccccgagaagcacctgggcgagatcacctaccccttcgcctgcagaaagagcaactgcagccactgcgccctgctgctgctgcacctgagccccggcgccgccggcagcagcagagtgaagcaccagtgccaccagtgcagcttcaccacccccgacgtggacgtgctgctgttccactacgagagcgtgcacgagagccaggccagcgacgtgaagcaggaggccaaccacctgcagggcagcgacggccagcagagcgtgaaggagagcaaggagcacagctgcaccaagtgcgacttcatcacccaggtggaggaggagatcagcagacactacagaagagcccacagctgctacaagtgcagacagtgcagcttcaccgccgccgacacccagagcctgctggagcacttcaacaccgtgcactgccaggagcaggacatcaccaccgccaacggcgaggaggacggccacgccatcagcaccatcaaggaggagcccaagatcgacttcagagtgtacaacctgctgacccccgacagcaagatgggcgagcccgtgagcgagagcgtggtgaagagagagaagctggaggagaaggacggcctgaaggagaaggtgtggaccgagagcagcagcgacgacctgagaaacgtgacctggagaggcgccgacatcctgagaggcagccccagctacacccaggccagcctgggcctgctgacccccgtgagcggcacccaggagcagaccaagaccctgagagacagccccaacgtggaggccgcccacctggccagacccatctacggcctggccgtggagaccaagggcttcctgcagggcgcccccgccggcggcgagaagagcggcgccctgccccagcagtaccccgccagcggcgagaacaagagcaaggacgagagccagagcctgctgagaagaagaagaggcagcggcgtgttctgcgccaactgcctgaccaccaagaccagcctgtggagaaagaacgccaacggcggctacgtgtgcaacgcctgcggcctgtaccagaagctgcacagcacccccagacccctgaacatcatcaagcagaacaacggcgagcagatcatcagaagaagaaccagaaagagactgaaccccgaggccctgcaggccgagcagctgaacaagcagcagagaggcagcaacgaggagcaggtgaacggcagccccctggagagaagaagcgaggaccacctgaccgagagccaccagagagagatccccctgcccagcctgagcaagtacgaggcccagggcagcctgaccaagagccacagcgcccagcagcccgtgctggtgagccagaccctggacatccacaagagaatgcagcccctgcacatccagatcaagagcccccaggagagcaccggcgaccccggcaacagcagcagcgtgagcgagggcaagggcagcagcgagagaggcagccccatcgagaagtacatgagacccgccaagcaccccaactacagcccccccggcagccccatcgagaagtaccagtaccccctgttcggcctgcccttcgtgcacaacgacttccagagcgaggccgactggctgagattctggagcaagtacaagctgagcgtgcccggcaacccccactacctgagccacgtgcccggcctgcccaacccctgccagaactacgtgccctaccccaccttcaacctgcccccccacttcagcgccgtgggcagcgacaacgacatccccctggacctggccatcaagcacagcagacccggccccaccgccaacggcgccagcaaggagaagaccaaggccccccccaacgtgaagaacgagggccccctgaacgtggtgaagaccgagaaggtggacagaagcacccaggacgagctgagcaccaagtgcgtgcactgcggcatcgtgttcctggacgaggtgatgtacgccctgcacatgagctgccacggcgacagcggccccttccagtgcagcatctgccagcacctgtgcaccgacaagtacgacttcaccacccacatccagagaggcctgcacagaaacaacgcccaggtggagaagaacggcaagcccaaggagtag

SEQ ID NO: 7728 - DNA, 2871 bp, Artificial Sequence
  Description of Artificial Sequence: Synthetic coding sequence
atgctggaggagctggagtgcggcgcccccggcgccagaggcgccgccaccgccatggactgcaaggacagacccgccttccccgtgaagaagctgatccaggccagactgcccttcaagagactgaacctggtgcccaagggcaaggccgacgacatgagcgacgaccagggcaccagcgtgcagagcaagagccccgacctggaggccagcctggacaccctggagaacaactgccacgtgggcagcgacatcgacttcagacccaagctggtgaacggcaagggccccctggacaacttcctgagaaacagaatcgagaccagcatcggccagagcaccgtgatcatcgacctgaccgaggacagcaacgagcagcccgacagcctggtggaccacaacaagctgaacagcgaggccagccccagcagagaggccatcaacggccagagagaggacaccggcgaccagcagggcctgctgaaggccatccagaacgacaagctggccttccccggcgagaccctgagcgacatcccctgcaagaccgaggaggagggcgtgggctgcggcggcgccggcagaagaggcgacagccaggagtgcagccccagaagctgccccgagctgaccagcggccccagaatgtgccccagaaaggagcaggacagctggagcgaggccggcggcatcctgttcaagggcaaggtgcccatggtggtgctgcaggacatcctggccgtgagacccccccagatcaagagcctgcccgccaccccccagggcaagaacatgacccccgagagcgaggtgctggagagcttccccgaggaggacagcgtgctgagccacagcagcctgagcagccccagcagcaccagcagccccgagggcccccccgccccccccaagcagcacagcagcaccagccccttccccaccagcacccccctgagaagaatcaccaagaagttcgtgaagggcagcaccgagaagaacaagctgagactgcagagagaccaggagagactgggcaagcagctgaagctgagagccgagagagaggagaaggagaagctgaaggaggaggccaagagagccaaggaggaggccaagaagaagaaggaggaggagaaggagctgaaggagaaggagagaagagagaagagagagaaggacgagaaggagaaggccgagaagcagagactgaaggaggagagaagaaaggagagacaggaggccctggaggccaagctggaggagaagagaaagaaggaggaggagaagagactgagagaggaggagaagagaatcaaggccgagaaggccgagatcaccagattcttccagaagcccaagaccccccaggcccccaagaccctggccggcagctgcggcaagttcgcccccttcgagatcaaggagcacatggtgctggcccccagaagaagaaccgccttccaccccgacctgtgcagccagctggaccagctgctgcagcagcagagcggcgagttcagcttcctgaaggacctgaagggcagacagcccctgagaagcggccccacccacgtgagcaccagaaacgccgacatcttcaacagcgacgtggtgatcgtggagagaggcaagggcgacggcgtgcccgagagaagaaagttcggcagaatgaagctgctgcagttctgcgagaaccacagacccgcctactggggcacctggaacaagaagaccgccctgatcagagccagagacccctgggcccaggacaccaagctgctggactacgaggtggacagcgacgaggagtgggaggaggaggagcccggcgagagcctgagccacagcgagggcgacgacgacgacgacatgggcgaggacgaggacgaggacgacggcttcttcgtgccccacggctacctgagcgaggacgagggcgtgaccgaggagtgcgccgaccccgagaaccacaaggtgagacagaagctgaaggccaaggagtgggacgagttcctggccaagggcaagagattcagagtgctgcagcccgtgaagatcggctgcgtgtgggccgccgacagagactgcgccggcgacgacctgaaggtgctgcagcagttcgccgcctgcttcctggagaccctgcccgcccaggaggagcagacccccaaggccagcaagagagagagaagagacgagcagatcctggcccagctgctgcccctgctgcacggcaacgtgaacggcagcaaggtgatcatcagagagttccaggagcactgcagaagaggcctgctgagcaaccacaccggcagccccagaagccccagcaccacctacctgcacacccccacccccagcgaggacgccgccatccccagcaagagcagactgaagagactgatcagcgagaacagcgtgtacgagaagagacccgacttcagaatgtgctggtacgtgcacccccaggtgctgcagagcttccagcaggagcacctgcccgtgccctgccagtggagctacgtgaccagcgtgcccagcgcccccaaggaggacagcggcagcgtgcccagcaccggccccagccagggcacccccatcagcctgaagagaaagagcgccggcagcatgtgcatcacccagttcatgaagaagagaagacacgacggccagatcggcgccgaggacatggacggcttccaggccgacaccgaggaggaggaggaggaggagggcgactgcatgatcgtggacgtgcccgacgccgccgaggtgcaggccccctgcggcgccgccagcggcgccggcggcggcgtgggcgtggacaccggcaaggccaccctgaccagcagccccctgggcgccagctag

SEQ ID NO: 7729 - DNA, 2250 bp, Artificial Sequence
  Description of Artificial Sequence: Synthetic coding sequence
atgctggaggagctggagtgcggcgcccccggcgccagaggcgccgccaccgccatggactgcaaggacagacccgccttccccgtgaagaagctgatccaggccagactgcccttcaagagactgaacctggtgcccaagggcaaggccgacgacatgagcgacgaccagggcaccagcgtgcagagcaagagccccgacctggaggccagcctggacaccctggagaacaactgccacgtgggcagcgacatcgacttcagacccaagctggtgaacggcaagggccccctggacaacttcctgagaaacagaatcgagaccagcatcggccagagcaccgtgatcatcgacctgaccgaggacagcaacgagcagcccgacagcctggtggaccacaacaagctgaacagcgaggccagccccagcagagaggccatcaacggccagagagaggacaccggcgaccagcagggcctgctgaaggccatccagaacgacaagctggccttccccggcgagaccctgagcgacatcccctgcaagaccgaggaggagggcgtgggctgcggcggcgccggcagaagaggcgacagccaggagtgcagccccagaagctgccccgagctgaccagcggccccagaatgtgccccagaaaggagcaggacagctggagcgaggccggcggcatcctgttcaagggcaaggtgcccatggtggtgctgcaggacatcctggccgtgagacccccccagatcaagagcctgcccgccaccccccagggcaagaacatgacccccgagagcgaggtgctggagagcttccccgaggaggacagcgtgctgagccacagcagcctgagcagccccagcagcaccagcagccccgagggcccccccgccccccccaagcagcacagcagcaccagccccttccccaccagcacccccctgagaagaatcaccaagaagttcgtgaagggcagcaccgagaagaacaagctgagactgcagagagaccaggagagactgggcaagcagctgaagctgagagccgagagagaggagaaggagaagctgaaggaggaggccaagagagccaaggaggaggccaagaagaagaaggaggaggagaaggagctgaaggagaaggagagaagagagaagagagagaaggacgagaaggagaaggccgagaagcagagactgaaggaggagagaagaaaggagagacaggaggccctggaggccaagctggaggagaagagaaagaaggaggaggagaagagactgagagaggaggagaagagaatcaaggccgagaaggccgagatcaccagattcttccagaagcccaagaccccccaggcccccaagaccctggccggcagctgcggcaagttcgcccccttcgagatcaaggagcacatggtgctggcccccagaagaagaaccgccttccaccccgacctgtgcagccagctggaccagctgctgcagcagcagagcggcgagttcagcttcctgaaggacctgaagggcagacagcccctgagaagcggccccacccacgtgagcaccagaaacgccgacatcttcaacagcgacgtggtgatcgtggagagaggcaagggcgacggcgtgcccgagagaagaaagttcggcagaatgaagctgctgcagttctgcgagaaccacagacccgcctactggggcacctggaacaagaagaccgccctgatcagagccagagacccctgggcccaggacaccaagctgctggactacgaggtggacagcgacgaggagtgggaggaggaggagcccggcgagagcctgagccacagcgagggcgacgacgacgacgacatgggcgaggacgaggacgaggacgacggcttcttcgtgccccacggctacctgagcgaggacgagggcgtgaccgaggagtgcgccgaccccgagaaccacaaggtgagacagaagctgaaggccaaggagtgggacgagttcctggccaagggcaagagattcagagtgctgcagcccgtgaagatcggctgcgtgtgggccgccgacagagactgcgccggcgacgacctgaaggtgctgcagcagttcgccgcccactgggtgcaccccgagagcagaggcgacgtgtgcagaatgctgagagtgagcagcccccagagcagatacctgaacagactgaacagctgcgtgaagagcaccctgagctgcttcacctag

SEQ ID NO: 7730 - DNA, 2352 bp, Artificial Sequence
  Description of Artificial Sequence: Synthetic coding sequence
atgctggaggagctggagtgcggcgcccccggcgccagaggcgccgccaccgccatggactgcaaggacagacccgccttccccgtgaagaagctgatccaggccagactgcccttcaagagactgaacctggtgcccaagggcaaggccgacgacatgagcgacgaccagggcaccagcgtgcagagcaagagccccgacctggaggccagcctggacaccctggagaacaactgccacgtgggcagcgacatcgacttcagacccaagctggtgaacggcaagggccccctggacaacttcctgagaaacagaatcgagaccagcatcggccagagcaccgtgatcatcgacctgaccgaggacagcaacgagcagcccgacagcctggtggaccacaacaagctgaacagcgaggccagccccagcagagaggccatcaacggccagagagaggacaccggcgaccagcagggcctgctgaaggccatccagaacgacaagctggccttccccggcgagaccctgagcgacatcccctgcaagaccgaggaggagggcgtgggctgcggcggcgccggcagaagaggcgacagccaggagtgcagccccagaagctgccccgagctgaccagcggccccagaatgtgccccagaaaggagcaggacagctggagcgaggccggcggcatcctgttcaagggcaaggtgcccatggtggtgctgcaggacatcctggccgtgagacccccccagatcaagagcctgcccgccaccccccagggcaagaacatgacccccgagagcgaggtgctggagagcttccccgaggaggacagcgtgctgagccacagcagcctgagcagccccagcagcaccagcagccccgagggcccccccgccccccccaagcagcacagcagcaccagccccttccccaccagcacccccctgagaagaatcaccaagaagttcgtgaagggcagcaccgagaagaacaagctgagactgcagagagaccaggagagactgggcaagcagctgaagctgagagccgagagagaggagaaggagaagctgaaggaggaggccaagagagccaaggaggaggccaagaagaagaaggaggaggagaaggagctgaaggagaaggagagaagagagaagagagagaaggacgagaaggagaaggccgagaagcagagactgaaggaggagagaagaaaggagagacaggaggccctggaggccaagctggaggagaagagaaagaaggaggaggagaagagactgagagaggaggagaagagaatcaaggccgagaaggccgagatcaccagattcttccagaagcccaagaccccccaggcccccaagaccctggccggcagctgcggcaagttcgcccccttcgagatcaaggagcacatggtgctggcccccagaagaagaaccgccttccaccccgacctgtgcagccagctggaccagctgctgcagcagcagagcggcgagttcagcttcctgaaggacctgaagggcagacagcccctgagaagcggccccacccacgtgagcaccagaaacgccgacatcttcaacagcgacgtggtgatcgtggagagaggcaagggcgacggcgtgcccgagagaagaaagttcggcagaatgaagctgctgcagttctgcgagaaccacagacccgcctactggggcacctggaacaagaagaccgccctgatcagagccagagacccctgggcccaggacaccaagctgctggactacgaggtggacagcgacgaggagtgggaggaggaggagcccggcgagagcctgagccacagcgagggcgacgacgacgacgacatgggcgaggacgaggacgaggacgacggcttcttcgtgccccacggctacctgagcgaggacgagggcgtgaccgaggagtgcgccgaccccgagaaccacaaggtgagacagaagctgaaggccaaggagtgggacgagttcctggccaagggcaagagattcagagtgctgcagcccgtgaagatcggctgcgtgtgggccgccgacagagactgcgccggcgacgacctgaaggtgctgcagcagttcgccgcctgcttcctggagaccctgcccgcccaggaggagcagacccccaaggccagcaagagagagagaagagacgagcagatcctggcccagctgctgcccctgctgcacggcaacgtgaacggcagcaaggtgatcatcagagagttccaggagcactgcagaagaggcctgctgagcaaccacaccggcaaggccaccctgaccagcagccccctgggcgccagctag

SEQ ID NO: 7731 - DNA, 519 bp, Artificial Sequence
  Description of Artificial Sequence: Synthetic coding sequence
atgaccagcgccagcaccaaggtgggcgagatcttcagcgccgccggcgccgccttcaccaagctgggcgagctgaccatgcagctgcaccccgtggccgacagcagccccgccggcgccaagtggaccgagaccgagatcgagatgctgagagccgccgtgaagagattcggcgacgacctgaaccacatcagctgcgtgatcaaggagagaaccgtggcccagatcaaggccaccgtgaagagaaaggtgtacgaggacagcggcatccccctgcccgccgagagccccaagaagggccccaagaaggtggccagcggcgtgctgagccccccccccgccgcccccccccccagcagcagcagcgtgcccgaggccggcggcccccccatcaagaagcagaaggccgacgtgaccctgagcgccctgaacgacagcgacgccaacagcgacgtggtggacatcgagggcctgggcgagaccccccccgccaagaagctgaacttcgaccaggcctag

SEQ ID NO: 7732 - DNA, 579 bp, Artificial Sequence
  Description of Artificial Sequence: Synthetic coding sequence
atgaccagcgccagcaccaaggtgggcgagatcttcagcgccgccggcgccgccttcaccaagctgggcgagctgaccatgcagctgcaccccgtggccgacagcagccccgccggcgccaagtggaccgagaccgagatcgagatgctgagagccgccgtgaagagattcggcgacgacctgaaccacatcagctgcgtgatcaaggagagaaccgtggcccagatcaaggccaccgtgaagagaaaggtgtacgaggacagcggcatccccctgcccgccgagagccccaagaagggccccaagaaggtggccagcggcgtgctgagccccccccccgccgcccccccccccagcagcagcagcgtgcccgaggccggcggcccccccatcaagaagcagaaggccgacgtgaccctgagcgccctgaacgacagcgacgccaacagcgacgtggtggacatcgagggcctgggcgagaccccccccgccaagaagctgaacttcgaccaggacagcctgaccctggacagcggcctgctgatgaccagcgccgacccccccctgctgagctgctag

SEQ ID NO: 7733 - DNA, 417 bp, Artificial Sequence
  Description of Artificial Sequence: Synthetic coding sequence
atgaccagcgccagcaccaaggtgggcgagatcttcagcgccgccggcgccgccttcaccaagctgggcgagctgaccatgcagctgcaccccgtggccgacagcagccccgccggcgcccagatcaaggccaccgtgaagagaaaggtgtacgaggacagcggcatccccctgcccgccgagagccccaagaagggccccaagaaggtggccagcggcgtgctgagccccccccccgccgcccccccccccagcagcagcagcgtgcccgaggccggcggcccccccatcaagaagcagaaggccgacgtgaccctgagcgccctgaacgacagcgacgccaacagcgacgtggtggacatcgagggcctgggcgagaccccccccgccaagaagctgaacttcgaccaggcctag

SEQ ID NO: 7734 - DNA, 306 bp, Artificial Sequence
  Description of Artificial Sequence: Synthetic coding sequence
atggccagcaacaagaccaccctgcagaagatgggcaagaagcagaacggcaagagcaagaaggtggaggaggccgagcccgaggagttcgtggtggagaaggtgctggacagaagagtggtgaacggcaaggtggagtacttcctgaagtggaagggcttcaccgagaagctggccaagaagaagatggtgcagaaggagaacctgtacctgaccgtgaacctgatgaccgccaaccagagaagaaaggagatgctgctgaccaaccaggaggacctgcccgaggtgctgatcctgaaggagtag

SEQ ID NO: 7735 - DNA, 2049 bp, Artificial Sequence
  Description of Artificial Sequence: Synthetic coding sequence
atgacctgcccccccaccggcctgtacggccccgagggcatcctgcccgccagaagaaccctgagaccccagggcaagggcagatggcagcagctgtgggagacccccaccctgctgtgggaggcccccagactgggcctggacaccgcccagggcctggagctgctgagcctgctgggcgccctggtggccctgggcgccctgctgctgagccccctgagacaccccgtgatctacctgctgctgtgggccgcctacctgagcgcctgccaggtgggccaggtgttcctgtacttccagtgggacagcctgctgctggagaccggcttcctggccgtgctggtggcccccctgagacccgccagccacagaaaggaggccccccagggcagacaggccggcgccctgccccacgaggacctgcccttctggctggtgagatggctgctgttcagactgatgttcgccagcggcgtggtgaagctgaccagcagatgccccgcctggtggggcctgaccgccctgacctaccactacgagacccagtgcctgcccacccccgccgcctggttcgcccaccacctgcccgtgtggctgcacaagctgagcgtggtggccaccttcctgatcgagatcgccgtgccccccctgttcttcgcccccatcagaagactgagactggccgccttctacagccaggtgctgctgcaggtgctgatcatcatcaccggcaactacaacttcttcaacctgatgaccctggtgctgaccaccgccctgctggacgaccagcacctggccgccgagcccggccacggcagcagaaagaagaccgccaccagctggcccaaggccctgctggccaccctgagcctgctgctggagctggccgtgtacggcctgctggcctacggcaccgtgcactacttcggcctggaggtggactggcagcagagaaccatccacagcagaaccaccttcaccttccaccagttcagccagtggctgaagaccctgaccctgcccaccgtgtggctgggcgtggccagcctggtgtgggagctgctgagcgccctgtggagatggacccaggtgagaggctggctgagaaagctgagcgccgtggtgcagctgagcctggtgggcaccgccaccgtggccctgttcctgatcagcctggtgccctacagctacgtggagcccggcacccacggcagactgtggaccggcgcccacagactgttcggcgccgtggagcacctgcagctggccaacagctacggcctgttcagaagaatgaccggcctgggcggcagacccgaggtggtgctggagggcagctacgacggccaccactggaccgagatcgagttcatgtacaagcccggcaacctgagcagacccccccccgtggtggtgccccaccagcccagactggactggcagatgtggttcgccgccctgggcccccacacccacagcccctggttcaccagcctggtgctgagactgctgcagggcaaggagcccgtgatcagactggtgcagagccaggtggccagataccccttccacaagcagccccccacctacgtgagagcccagagatacaagtactggttcagccagcccggcgagcagggccagtggtggagaagacagtgggtggaggagttcttccccagcgtgagcctgggcgaccccaccctggagaccctgctgagacagttcggcctgcaggagaagagcccccccagaaccagaagcgccaacagcaccctggcccaggccctgcactggaccagaagccagctgagccccctggaggcccccgccctgctgtggggcctgctgatggccgtgggcgccgtgagattcgtgcaggccctgctggccccctgcagcctgagaagcagccccctggcccccgtgagcggcgagaagagaagacccgccagccagaaggacagcggcgccgccagcgagcaggccaccgccgcccccaacccctgcagcagcagcagcagaaccaccagaagaaagaagtag

SEQ ID NO: 7736 - DNA, 1239 bp, Artificial Sequence
  Description of Artificial Sequence: Synthetic coding sequence
atggagctgagcgccgtgggcgagagagtgttcgccgccgagagcatcatcaagagaagaatcagaaagggcagaatcgagtacctggtgaagtggaagggctgggccatcaagtacagcacctgggagcccgaggagaacatcctggacagcagactgatcgccgccttcgagcagaaggagagagagagagagctgtacggccccaagaagagaggccccaagcccaagaccttcctgctgaaggccagagcccaggccgaggccctgagaatcagcgacgtgcacttcagcgtgaagcccagcgccagcgccagcagccccaagctgcacagcagcgccgccgtgcacagactgaagaaggacatcagaagatgccacagaatgagcagaagacccctgcccagacccgacccccagggcggcagccccggcctgagaccccccatcagccccttcagcgagaccgtgagaatcatcaacagaaaggtgaagcccagagagcccaagagaaacagaatcatcctgaacctgaaggtgatcgacaagggcgccggcggcggcggcgccggccagggcgccggcgccctggccagacccaaggtgcccagcagaaacagagtgatcggcaagagcaagaagttcagcgagagcgtgctgagaacccagatcagacacatgaagttcggcgccttcgccctgtacaagcccccccccgcccccctggtggcccccagccccggcaaggccgaggccagcgcccccggccccggcctgctgctggccgcccccgccgccccctacgacgccagaagcagcggcagcagcggctgccccagccccaccccccagagcagcgaccccgacgacaccccccccaagctgctgcccgagaccgtgagccccagcgcccccagctggagagagcccgaggtgctggacctgagcctgccccccgagagcgccgccaccagcaagagagccccccccgaggtgaccgccgccgccggccccgccccccccaccgcccccgagcccgccggcgccagcagcgagcccgaggccggcgactggagacccgagatgagcccctgcagcaacgtggtggtgaccgacgtgaccagcaacctgctgaccgtgaccatcaaggagttctgcaaccccgaggacttcgagaaggtggccgccggcgtggccggcgccgccggcggcggcggcagcatcggcgccagcaagtag

SEQ ID NO: 7737 - DNA, 1170 bp, Artificial Sequence
  Description of Artificial Sequence: Synthetic coding sequence
atggagctgagcgccgtgggcgagagagtgttcgccgccgaggccctgctgaagagaagaatcagaaagggcagaatggagtacctggtgaagtggaagggctggagccagaagtacagcacctgggagcccgaggagaacatcctggacgccagactgctggccgccttcgaggagagagagagagagatggagctgtacggccccaagaagagaggccccaagcccaagaccttcctgctgaaggcccaggccaaggccaaggccaagacctacgagttcagaagcgacagcgccagaggcatcagaatcccctaccccggcagaagcccccaggacctggccagcaccagcagagccagagagggcctgagaaacatgggcctgagcccccccgccagcagcaccagcaccagcagcacctgcagagccgaggcccccagagacagagacagagacagagacagagacagagagagagacagagagagagagagagagagagagagagagagagagagagagagagagagagagagaggcaccagcagagtggacgacaagcccagcagccccggcgacagcagcaagaagagaggccccaagcccagaaaggagctgcccgaccccagccagagacccctgggcgagcccagcgccggcctgggcgagtacctgaagggcagaaagctggacgacacccccagcggcgccggcaagttccccgccggccacagcgtgatccagctggccagaagacaggacagcgacctggtgcagtgcggcgtgaccagccccagcagcgccgaggccaccggcaagctggccgtggacaccttccccgccagagtgatcaagcacagagccgccttcctggaggccaagggccagggcgccctggaccccaacggcaccagagtgagacacggcagcggcccccccagcagcggcggcggcctgtacagagacatgggcgcccagggcggcagacccagcctgatcgccagaatccccgtggccagaatcctgggcgaccccgaggaggagagctggagccccagcctgaccaacctggagaaggtggtggtgaccgacgtgaccagcaacttcctgaccgtgaccatcaaggagagcaacaccgaccagggcttcttcaaggagaagagatag

SEQ ID NO: 7738 - DNA, 2469 bp, Artificial Sequence
  Description of Artificial Sequence: Synthetic coding sequence
atgaagatgaagatccagaagaaggagaagcagctgagcaacctgaaggtgctgaaccacagccccatgagcgacgccagcgtgaacttcgactacaagagccccagccccttcgactgcagcaccgaccaggaggagaagatcgaggacgtggccagccactgcctgccccagaaggacctgtacaccgccgaggaggaggccgccaccctgttccccagaaagatgaccagccacaacggcatggaggacagcggcggcggcggcaccggcgtgaagaagaagagaaagaagaaggagcccggcgaccaggagggcgccgccaagggcagcaaggacagagagcccaagcccaagagaaagagagagcccaaggagcccaaggagcccagaaaggccaaggagcccaagaaggccaaggagcacaaggagcccaagcagaaggacggcgccaagaaggccagaaagcccagagaggccagcggcaccaaggaggccaaggagaagagaagctgcaccgacagcgccgccagaaccaagagcagaaaggccagcaaggagcagggccccacccccgtggagaagaagaagaagggcaagagaaagagcgagaccaccgtggagagcctggagctggaccagggcctgaccaaccccagcctgagaagccccgaggagagcaccgagagcaccgacagccagaagagaagaagcggcagacaggtgaagagaagaaagtacaacgaggacctggacttcaaggtggtggacgacgacggcgagaccatcgccgtgctgggcgccggcagaaccagcgccctgagcgccagcaccctggcctggcaggccgaggagccccccgaggacgacgccaacatcatcgagaagatcctggccagcaagaccgtgcaggaggtgcaccccggcgagccccccttcgacctggagctgttctacgtgaagtacagaaacttcagctacctgcactgcaagtgggccaccatggaggagctggagaaggaccccagaatcgcccagaagatcaagagattcagaaacaagcaggcccagatgaagcacatcttcaccgagcccgacgaggacctgttcaaccccgactacgtggaggtggacagaatcctggaggtggcccacaccaaggacgccgagaccggcgaggaggtgacccactacctggtgaagtggtgcagcctgccctacgaggagagcacctgggagctggaggaggacgtggaccccgccaaggtgaaggagttcgagagcctgcaggtgctgcccgagatcaagcacgtggagagacccgccagcgacagctggcagaagctggagaagagcagagagtacaagaacagcaaccagctgagagagtaccagctggagggcatgaactggctgctgttcaactggtacaacagaaagaactgcatcctggccgacgagatgggcctgggcaagaccatccagagcatcaccttcctgagcgagatcttcctgagaggcatccacggccccttcctgatcatcgcccccctgagcaccatcaccaactgggagagagagttcagaacctggaccgagatgaacgccatcgtgtaccacggcagccagatcagcagacagatgatccagcagtacgagatggtgtacagagacgcccagggcaaccccctgagcggcgtgttcaagttccacgtggtgatcaccaccttcgagatgatcctggccgactgccccgacctgaagaagatcttctggggcagatggaaggacatcctgacccacggcagattcaagtggcacctgaacgagaaggacatggagatgatctgcagagccctgctggtgtactgcgtgaagcactacaagggcgacgagaagatcaagagcttcatctgggagctgatcacccccaccaaggacggccaggcccagaccctgcagaaccacagcggcctgagcgcccccgtgcccagaggcagaaagggcaagaagaccaagaaccagctgctgatccccgagctgaaggacgccgactggctggccacctgcaaccccgaggtggtgctgcacgacgacggctacaagaagcacctgaagcagcactgcaacaaggtgctgctgagagtgagaatgctgtactacctgaaggccgagatcctgggcgaggccgccgagaaggccttcgagggcagccccgccagagagctggacgtgcccctgcccgacatcgactacatggagatccccgtggactggtgggacgccgaggccgacaagagcctgctgatcggcgtgttcaagcacggctacgagagatacaacgccatgagagccgaccccgccctgtgcttcctggagaaggtgggcatgcccgacgagaagagcctgagcgccgagcagggcgtgaccgacggcaccagcgacatccccgagagacagcacagatag

SEQ ID NO: 7739 - DNA, 1122 bp, Artificial Sequence
  Description of Artificial Sequence: Synthetic coding sequence
atgtgccagagccacatgatcggcttctgcaccagcagcgtgaacgaggagaccgagacccagggcgaccagatcagctgccccaaccccaccaccctggtgttcagaacccagatcagcagcctgcccagcctgcagctgagcaacctgaaggtgctgaaccacagccccatgagcgacgccagcgtgaacttcgactacaagagccccagccccttcgactgcagcaccgaccaggaggagaagatcgaggacgtggccagccactgcctgccccagaaggacctgtacaccgccgaggaggaggccgccaccctgttccccagaaagatgaccagccacaacggcatggaggacagcggcggcggcggcaccggcgtgaagaagaagagaaagaagaaggagcccggcgaccaggagggcgccgccaagggcagcaaggacagagagcccaagcccaagagaaagagagagcccaaggagcccaaggagcccagaaaggccaaggagcccaagaaggccaaggagcacaaggagcccaagcagaaggacggcgccaagaaggccagaaagcccagagaggccagcggcaccaaggaggccaaggagaagagaagctgcaccgacagcgccgccagaaccaagagcagaaaggccagcaaggagcagggccccacccccgtggagaagaagaagaagggcaagagaaagagcgagaccaccgtggagagcctggagctggaccagggcctgaccaaccccagcctgagaagccccgaggagagcaccgagagcaccgacagccagaagagaagaagcggcagacaggtgaagagaagaaagtacaacgaggacctggacttcaaggtggtggacgacgacggcgagaccatcgccgtgctgggcgccggcagaaccagcgccctgagcgccagcaccctggcctggcaggccgaggagccccccgaggacgacgccaacatcatcgagaagatcctggccagcaagaccgtgcaggaggtgcaccccggcgagccccccttcgacctggagctgttctacgtgaagtacagaaacctgtacgtgtacctgaagtacagcctgtacctgggcttcatctag

SEQ ID NO: 7740 - DNA, 8148 bp, Artificial Sequence
  Description of Artificial Sequence: Synthetic coding sequence
atgaagatgaagatccagaagaaggagaagcagctgagcaacctgaaggtgctgaaccacagccccatgagcgacgccagcgtgaacttcgactacaagagccccagccccttcgactgcagcaccgaccaggaggagaagatcgaggacgtggccagccactgcctgccccagaaggacctgtacaccgccgaggaggaggccgccaccctgttccccagaaagatgaccagccacaacggcatggaggacagcggcggcggcggcaccggcgtgaagaagaagagaaagaagaaggagcccggcgaccaggagggcgccgccaagggcagcaaggacagagagcccaagcccaagagaaagagagagcccaaggagcccaaggagcccagaaaggccaaggagcccaagaaggccaaggagcacaaggagcccaagcagaaggacggcgccaagaaggccagaaagcccagagaggccagcggcaccaaggaggccaaggagaagagaagctgcaccgacagcgccgccagaaccaagagcagaaaggccagcaaggagcagggccccacccccgtggagaagaagaagaagggcaagagaaagagcgagaccaccgtggagagcctggagctggaccagggcctgaccaaccccagcctgagaagccccgaggagagcaccgagagcaccgacagccagaagagaagaagcggcagacaggtgaagagaagaaagtacaacgaggacctggacttcaaggtggtggacgacgacggcgagaccatcgccgtgctgggcgccggcagaaccagcgccctgagcgccagcaccctggcctggcaggccgaggagccccccgaggacgacgccaacatcatcgagaagatcctggccagcaagaccgtgcaggaggtgcaccccggcgagccccccttcgacctggagctgttctacgtgaagtacagaaacttcagctacctgcactgcaagtgggccaccatggaggagctggagaaggaccccagaatcgcccagaagatcaagagattcagaaacaagcaggcccagatgaagcacatcttcaccgagcccgacgaggacctgttcaaccccgactacgtggaggtggacagaatcctggaggtggcccacaccaaggacgccgagaccggcgaggaggtgacccactacctggtgaagtggtgcagcctgccctacgaggagagcacctgggagctggaggaggacgtggaccccgccaaggtgaaggagttcgagagcctgcaggtgctgcccgagatcaagcacgtggagagacccgccagcgacagctggcagaagctggagaagagcagagagtacaagaacagcaaccagctgagagagtaccagctggagggcatgaactggctgctgttcaactggtacaacagaaagaactgcatcctggccgacgagatgggcctgggcaagaccatccagagcatcaccttcctgagcgagatcttcctgagaggcatccacggccccttcctgatcatcgcccccctgagcaccatcaccaactgggagagagagttcagaacctggaccgagatgaacgccatcgtgtaccacggcagccagatcagcagacagatgatccagcagtacgagatggtgtacagagacgcccagggcaaccccctgagcggcgtgttcaagttccacgtggtgatcaccaccttcgagatgatcctggccgactgccccgagctgaagaagatccactggagctgcgtgatcatcgacgaggcccacagactgaagaacagaaactgcaagctgctggagggcctgaagctgatggccctggagcacaaggtgctgctgaccggcacccccctgcagaacagcgtggaggagctgttcagcctgctgaacttcctggagcccagccagttccccagcgagaccgccttcctggaggagttcggcgacctgaagaccgaggagcaggtgaagaagctgcagagcatcctgaagcccatgatgctgagaagactgaaggacgacgtggagaagaacctggcccccaagcaggagaccatcatcgaggtggagctgaccaacatccagaagaagtactacagagccatcctggagaagaacttcagcttcctgaccaagggcgccaaccagcacaacatgcccaacctgatcaacaccatgatggagctgagaaagtgctgcaaccacccctacctgatcaacggcgccgaggagaagatcctggaggacttcagaaagacccacagccccgacgcccccgacttccagctgcaggccatgatccaggccgccggcaagctggtgctgatcgacaagctgctgcccaagctgatcgccggcggccacaaggtgctgatcttcagccagatggtgagatgcctggacatcctggaggactacctgatccagagaagatacacctacgagagaatcgacggcagagtgagaggcaacctgagacaggccgccatcgacagattctgcaagcccgacagcgacagattcgtgttcctgctgtgcaccagagccggcggcctgggcatcaacctgaccgccgccgacacctgcatcatcttcgacagcgactggaacccccagaacgacctgcaggcccaggccagatgccacagaatcggccagagcaaggccgtgaaggtgtacagactgatcaccagaaacagctacgagagagagatgttcgacaaggccagcctgaagctgggcctggacaaggccgtgctgcaggacatcaacagaaagggcggcaccaacggcgtgcagcagctgagcaagatggaggtggaggacctgctgagaaagggcgcctacggcgccctgatggacgaggaggacgagggcagcaagttctgcgaggaggacatcgaccagatcctgcagagaagaacccacaccatcaccatccagagcgagggcaagggcagcaccttcgccaaggccagcttcgtggccagcggcaacagaaccgacatcagcctggacgaccccaacttctggcagaagtgggccaagatcgccgagctggacaccgaggccaagaacgagaaggagagcctggtgatcgacagacccagagtgagaaagcagaccaagcactacaacagcttcgaggaggacgagctgatggagttcagcgagctggacagcgacagcgacgagagacccaccagaagcagaagactgaacgacaaggccagaagatacctgagagccgagtgcttcagagtggagaagaacctgctgatcttcggctggggcagatggaaggacatcctgacccacggcagattcaagtggcacctgaacgagaaggacatggagatgatctgcagagccctgctggtgtactgcgtgaagcactacaagggcgacgagaagatcaagagcttcatctgggagctgatcacccccaccaaggacggccaggcccagaccctgcagaaccacagcggcctgagcgcccccgtgcccagaggcagaaagggcaagaagaccaagaaccagctgctgatccccgagctgaaggacgccgactggctggccacctgcaaccccgaggtggtgctgcacgacgacggctacaagaagcacctgaagcagcactgcaacaaggtgctgctgagagtgagaatgctgtactacctgaaggccgagatcctgggcgaggccgccgagaaggccttcgagggcagccccgccagagagctggacgtgcccctgcccgacatcgactacatggagatccccgtggactggtgggacgccgaggccgacaagagcctgctgatcggcgtgttcaagcacggctacgagagatacaacgccatgagagccgaccccgccctgtgcttcctggagaaggtgggcatgcccgacgagaagagcctgagcgccgagcagggcgtgaccgacggcaccagcgacatccccgagagaggcaacaccgacaaggaggacaacgccgaggacaaggtggacggcctgcagaagcagaccgagagcagcagcgacggcggcgacggcgtgttcagcgagaagaaggacgacagcagagccgcccaggacggcagcgaccccgacaagagcccctggcccgtgagcagcgccctgaccgccagactgagaagactggtgaccgtgtaccagagatgcaacagaaaggagctgtgcagacccgagatcctgggccccggcaaccagggctactgggtgcaggaggagatgttcagaagaaccagcgagatggacctgatcaacaaggaggcccagaagagatggaccagaagagagcaggccgacttctacagaaccgtgagcagcttcggcgtggtgtacgaccaggagaagaagaccttcgactggacccagttcagaatcatcagcagactggacaagaagagcgacgagagcctggagcagtacttctacagcttcgtggccatgtgcagaaacgtgtgcagactgcccacctggaaggacggcggcccccccgacaccaccatctacgtggagcccatcaccgaggagagagccgccagaaccctgtacagaatcgagctgctgagaaaggtgagagagcaggtgctgaagtgcccccagctgcacgagagactgcagctgtgcagacccagcctgtacctgcccgtgtggtgggagtgcggcaagcacgacagagacctgctgatcggcaccgccaagcacggcctgaacagaaccgactgctacatcatgaacgacccccagctgagcttcctggacgcctacagaaactacgcccagcacaagagaagcggcacccaggcccccggcaacctgtgctgcctgtaccagaccaacagcaagctgtacgagagcctgacctacagccagatgagcagaaccagcgagagcctggagaacgagcccgagaacctggtgagagtggagagcagagacgaccacctgagcctgcccgacgtgacctgcgagaacttcatcagcaaggtgcaggacgtgatcagcatcaaccacgacgagagcctgctgcccgagagcctggagagcatgatgtacggcaagaaggtgctgagccaggagcccagcagcttccaggagagccccagcaccaacaccgagagcagaaaggacgtgatcaccatcagcatcagcaaggacggcaactgccagagcggcggccccgaggccgagatcgccagcggccccaccttcatgggcagcctggaggccggcggcgtggcccaggccaacatcaagaacggcaagcacctgctgatgagcatcagcaaggagggcgagctgtgctgcagcgaggccggccagagacccgagaacatcggccagctggaggccaagtgcctggccagccccagcctgaaccccggcaacgagagcggcttcgtggacatgtgcagcctgagcgtgtgcgacagcaagagaaacctgagcagcgaccagcagctgatcgacctgctggagaacaagagcctggagagcaagctgatcctgagccagaaccacagcgacgaggaggaggaggaggaggagaacgaggaggagaacctggccatggccgtgggcatgggcgagagacccgaggtgctgcacctgaccgagcccaccaccaacatcagcagagagaagaaccagggcttccaggacgagaccaagaagggcagcctggaggtggccaaccagacccccggcctgcagagagccttccccgcccccgccgcctgccagtgccactgcaagcacatggagagatggatgcacggcctggagaacgacgagttcgagatcgagaagcccaaggcctacatccccgacctgttcaagagcaagaccaacaccatcgccatggagggcgagcccaccgccatccccagccagcccttcaaggtgaagcacgagctgctgaaggagccctggaaggagagcgccgagggccagaacgtgttccccacctaccccctggagggcagcgagctgaagagcgaggacatggacttcgagaacaaggacgactacgacagagacggcaactgccacagccaggactaccccggcaagtacagcgaggaggagagcaagagcagcaccagcggcatcaccggcgacatcggcgacgagctgcaggaggccagagcccccaccatcgcccagctgctgcaggagaagaccctgtacagcttcagcgagtggcccaaggacagagtgatcatcaacagactggacaacatctgccacgtggtgctgaagggcaagtggcccagcagccagcagtacgagcccagcggcaccctgcccacccccgtgctgaccagcagcgccggcagcagaaccagcctgagcgagcccgaggccgccgagcacagcttcagcaacggcgccgccctggccgcccagatccacaaggagagcttcctggcccccgtgttcaccaaggacgagcagaagcacagaagaccctacgagttcgaggtggagagagacgccaaggccagaggcctggagcagttcagcgccacccacggccacacccccatcatcctgaacggctggcacggcgagagcgccatggacctgagctgcagcagcgagggcagccccggcgccaccagccccttccccgtgagcgccagcacccccaagatcggcgccatcagcagcctgcagggcgccctgggcatggacctgagcggcatcctgcaggccggcctgatccaccccgtgaccggccagatcgtgaacggcagcctgagaagagacgacgccgccaccagaagaagaagaggcagaagaaagcacgtggagggcggcatggacctgatcttcctgaaggagcagaccctgcaggccggcatcctggaggtgcacgaggaccccggccaggccaccctgagcaccacccaccccgagggccccggccccgccaccagcgcccccgagcccgccaccgccgccagcagccaggccgagaagagcatccccagcaagagcctgctggactggctgagacagcaggccgactacagcctggaggtgcccggcttcggcgccaacttcagcgacaagcccaagcagagaagacccagatgcaaggagcccggcaagctggacgtgagcagcctgagcggcgaggagagagtgcccgccatccccaaggagcccggcctgagaggcttcctgcccgagaacaagttcaaccacaccctggccgagcccatcctgagagacaccggccccagaagaagaggcagaagacccagaagcgagctgctgaaggcccccagcatcgtggccgacagccccagcggcatgggccccctgttcatgaacggcctgatcgccggcatggacctggtgggcctgcagaacatgagaaacatgcccggcatccccctgaccggcctggtgggcttccccgccggcttcgccaccatgcccaccggcgaggaggtgaagagcaccctgagcatgctgcccatgatgctgcccggcatggccgccgtgccccagatgttcggcgtgggcggcctgctgagcccccccatggccaccacctgcaccagcaccgcccccgccagcctgagcagcaccaccaagagcggcaccgccgtgaccgagaagaccgccgaggacaagcccagcagccacgacgtgaagaccgacaccctggccgaggacaagcccggccccggccccttcagcgaccagagcgagcccgccatcaccaccagcagccccgtggccttcaaccccttcctgatccccggcgtgagccccggcctgatctaccccagcatgttcctgagccccggcatgggcatggccctgcccgccatgcagcaggccagacacagcgagatcgtgggcctggagagccagaagagaaagaagaagaagaccaagggcgacaaccccaacagccaccccgagcccgcccccagctgcgagagagagcccagcggcgacgagaactgcgccgagcccagcgcccccctgcccgccgagagagagcacggcgcccaggccggcgagggcgccctgaaggacagcaacaacgacaccaactag

SEQ ID NO: 7741 - DNA, 450 bp, Artificial Sequence
  Description of Artificial Sequence: Synthetic coding sequence
atgaagatgaagatccagaagaaggagaagcagctgagcaacctgaaggtgctgaaccacagccccatgagcgacgccagcgtgaacttcgactacaagagccccagccccttcgactgcagcaccgaccaggaggagaagatcgaggacgtggccagccactgcctgccccagaaggacctgtacaccgccgaggaggaggccgccaccctgttccccagaaagatgaccagccacaacggcatggaggacagcggcggcggcggcaccggcgtgaagaagaagagaaagaagaaggagcccggcgaccaggagggcgccgccaagggcagcaaggacagagagcccaagcccaagagaaagagagagcccaaggagcccaaggagcccagaaaggccaaggagcccaagaaggccaaggagcacaaggagcccaagcagaaggactag

SEQ ID NO: 7742 - DNA, 1578 bp, Artificial Sequence
  Description of Artificial Sequence: Synthetic coding sequence
tgagccagcaagaccgtgcaggaggtgcaccccggcgagccccccttcgacctggagctgttctacgtgaagtacagaaacttcagctacctgcactgcaagtgggccaccatggaggagctggagaaggaccccagaatcgcccagaagatcaagagattcagaaacaagcaggcccagatgaagcacatcttcaccgagcccgacgaggacctgttcaaccccgactacgtggaggtggacagaatcctggaggtggcccacaccaaggacgccgagaccggcgaggaggtgacccactacctggtgaagtggtgcagcctgccctacgaggagagcacctgggagctggaggaggacgtggaccccgccaaggtgaaggagttcgagagcctgcaggtgctgcccgagatcaagcacgtggagagacccgccagcgacagctggcagaagctggagaagagcagagagtacaagaacagcaaccagctgagagagtaccagctggagggcatgaactggctgctgttcaactggtacaacagaaagaactgcatcctggccgacgagatgggcctgggcaagaccatccagagcatcaccttcctgagcgagatcttcctgagaggcatccacggccccttcctgatcatcgcccccctgagcaccatcaccaactgggagagagagttcagaacctggaccgagatgaacgccatcgtgtaccacggcagccagatcagcagacagatgatccagcagtacgagatggtgtacagagacgcccagggcaaccccctgagcggcgtgttcaagttccacgtggtgatcaccaccttcgagatgatcctggccgactgccccgagctgaagaagatccactggggcagatggaaggacatcctgacccacggcagattcaagtggcacctgaacgagaaggacatggagatgatctgcagagccctgctggtgtactgcgtgaagcactacaagggcgacgagaagatcaagagcttcatctgggagctgatcacccccaccaaggacggccaggcccagaccctgcagaaccacagcggcctgagcgcccccgtgcccagaggcagaaagggcaagaagaccaagaaccagctgctgatccccgagctgaaggacgccgactggctggccacctgcaaccccgaggtggtgctgcacgacgacggctacaagaagcacctgaagcagcactgcaacaaggtgctgctgagagtgagaatgctgtactacctgaaggccgagatcctgggcgaggccgccgagaaggccttcgagggcagccccgccagagagctggacgtgcccctgcccgacatcgactacatggagatccccgtggactggtgggacgccgaggccgacaagagcctgctgatcggcgtgttcaagcacggctacgagagatacaacgccatgagagccgaccccgccctgtgcttcctggagaaggtgggcatgcccgacgagaagagcctgagcgccgagcagggcgtgaccgacggcaccagcgacatccccgagagacagcacagatag

SEQ ID NO: 7743 - DNA, 1521 bp, Artificial Sequence
  Description of Artificial Sequence: Synthetic coding sequence
atggccagcggcgacctgtacgaggtggagagaatcgtggacaagagaaagaacaagaagggcaagtgggagtacctgatcagatggaagggctacggcagcaccgaggacacctgggagcccgagcaccacctgctgcactgcgaggagttcatcgacgagttcaacggcctgcacatgagcaaggacaagagaatcaagagcggcaagcagagcagcaccagcaagctgctgagagacagcagaggccccagcgtggagaagctgagccacagacccagcgaccccggcaagagcaagggcaccagccacaagagaaagagaatcaacccccccctggccaagcccaagaagggctacagcggcaagcccagcagcggcggcgacagagccaccaagaccgtgagctacagaaccacccccagcggcctgcagatcatgcccctgaagaagagccagaacggcatggagaacggcgacgccggcagcgagaaggacgagagacacttcggcaacggcagccaccagcccggcctggacctgaacgaccacgtgggcgagcaggacatgggcgagtgcgacgtgaaccacgccaccctggccgagaacggcctgggcagcgccctgaccaacggcggcctgaacctgcacagccccgtgaagagaaagctggaggccgagaaggactacgtgttcgacaagagactgagatacagcgtgagacagaacgagagcaactgcagattcagagacatcgtggtgagaaaggaggagggcttcacccacatcctgctgagcagccagaccagcgacaacaacgccctgacccccgagatcatgaaggaggtgagaagagccctgtgcaacgccgccaccgacgacagcaagctgctgctgctgagcgccgtgggcagcgtgttctgcagcggcctggactacagctacctgatcggcagactgagcagcgacagaagaaaggagagcaccagaatcgccgaggccatcagagacttcgtgaaggccttcatccagttcaagaagcccatcgtggtggccatcaacggccccgccctgggcctgggcgccagcatcctgcccctgtgcgacatcgtgtgggccagcgagaaggcctggttccagaccccctacgccaccatcagactgacccccgccggctgcagcagctacaccttcccccagatcctgggcgtggccctggccaacgagatgctgttctgcggcagaaagctgaccgcccaggaggcctgcagcagaggcctggtgagccaggtgttctggcccaccaccttcagccaggaggtgatgctgagagtgaaggagatggccagctgcagcgccgtggtgctggaggagagcaagtgcctggtgagaagcttcctgaagagcgtgctggaggacgtgaacgagaaggagtgcctgatgctgaagcagctgtggagcagcagcaagggcctggacagcctgttcagctacctgcaggacaagatctacgaggtgtag

SEQ ID NO: 7744 - DNA, 1665 bp, Artificial Sequence
  Description of Artificial Sequence: Synthetic coding sequence
atggccagccaggagttcgaggtggaggccatcgtggacaagagacaggacaagaacggcaacacccagtacctggtgagatggaagggctacgacaagcaggacgacacctgggagcccgagcagcacctgatgaactgcgagaagtgcgtgcacgacttcaacagaagacagaccgagaagcagaagaagctgacctggaccaccaccagcagaatcttcagcaacaacgccagaagaagaaccagcagaagcaccaaggccaactacagcaagaacagccccaagacccccgtgaccgacaagcaccacagaagcaagaacagaaagctgttcgccgccagcaagaacgtgagaagaaaggccgccagcatcctgagcgacaccaagaacatggagatcatcaacagcaccatcgagaccctggcccccgacagccccttcgaccacaagaccgtgagcggcttccagaagctggagaagctggaccccatcgccgccgaccagcaggacaccgtggtgttcaaggtgaccgagggcaagctgctgagagaccccctgagcagacccggcgccgagcagaccggcatccagaacaagacccagatccaccccctgatgagccagatgagcggcagcgtgaccgccagcatggccaccggcagcgccaccagaaagggcatcgtggtgctgatcgaccccctggccgccaacggcaccaccgacatgcacaccagcgtgcccagagtgaagggcggccagagaaacatcaccgacgacagcagagaccagcccttcatcaagaagatgcacttcaccatcagactgaccgagagcgccagcacctacagagacatcgtggtgaagaaggaggacggcttcacccagatcgtgctgagcaccagaagcaccgagaagaacgccctgaacaccgaggtgatcaaggagatcgtgaacgccctgaacagcgccgccgccgacgacagcaagctggtgctgttcagcgccgccggcagcgtgttctgctgcggcctggacttcggctacttcgtgaagcacctgagaaacaacagaaacaccgccagcctggagatggtggacaccatcaagaacttcgtgaacaccttcatccagttcaagaagcccatcgtggtgagcgtgaacggccccgccatcggcctgggcgccagcatcctgcccctgtgcgacctggtgtgggccaacgagaaggcctggttccagaccccctacaccaccttcggccagagccccgacggctgcagcagcatcaccttccccaagatgatgggcaaggccagcgccaacgagatgctgatcgccggcagaaagctgaccgccagagaggcctgcgccaagggcctggtgagccaggtgttcctgaccggcaccttcacccaggaggtgatgatccagatcaaggagctggccagctacaaccccatcgtgctggaggagtgcaaggccctggtgagatgcaacatcaagctggagctggagcaggccaacgagagagagtgcgaggtgctgagaaagatctggagcagcgcccagggcatcgagagcatgctgaagatccccctgctgggctacaaggccgccttcccccccagaaagacccagaacgaccagagatggtgcccctag

SEQ ID NO: 7745 - DNA, 1623 bp, Artificial Sequence
  Description of Artificial Sequence: Synthetic coding sequence
atggccagccaggagttcgaggtggaggccatcgtggacaagagacaggacaagaacggcaacacccagtacctggtgagatggaagggctacgacaagcaggacgacacctgggagcccgagcagcacctgatgaactgcgagaagtgcgtgcacgacttcaacagaagacagaccgagaagcagaagaagctgacctggaccaccaccagcagaatcttcagcaacaacgccagaagaagaaccagcagaagcaccaaggccaactacagcaagaacagccccaagacccccgtgaccgacaagcaccacagaagcaagaacagaaagctgttcgccgccagcaagaacgtgagaagaaaggccgccagcatcctgagcgacaccaagaacatggagatcatcaacagcaccatcgagaccctggcccccgacagccccttcgaccacaagaccgtgagcggcttccagaagctggagaagctggaccccatcgccgccgaccagcaggacaccgtggtgttcaaggtgaccgagggcaagctgctgagagaccccctgagcagacccggcgccgagcagaccggcatccagaacaagacccagatccaccccctgatgagccagatgagcggcagcgtgaccgccagcatggccaccggcagcgccaccagaaagggcatcgtggtgctgatcgaccccctggccgccaacggcaccaccgacatgcacaccagcgtgcccagagtgaagggcggccagagaaacatcaccgacgacagcagagaccagcccttcatcaagaagatgcacttcaccatcagactgaccgagagcgccagcacctacagagacatcgtggtgaagaaggaggacggcttcacccagatcgtgctgagcaccagaagcaccgagaagaacgccctgaacaccgaggtgatcaaggagatcgtgaacgccctgaacagcgccgccgccgacgacagcaagctggtgctgttcagcgccgccggcagcgtgttctgctgcggcctggacttcggctacttcgtgaagcacctgagaaacaacagaaacaccgccagcctggagatggtggacaccatcaagaacttcgtgaacaccttcatccagttcaagaagcccatcgtggtgagcgtgaacggccccgccatcggcctgggcgccagcatcctgcccctgtgcgacctggtgtgggccaacgagaaggcctggttccagaccccctacaccaccttcggccagagccccgacggctgcagcagcatcaccttccccaagatgatgggcaaggccagcgccaacgagatgctgatcgccggcagaaagctgaccgccagagaggcctgcgccaagggcctggtgagccaggtgttcctgaccggcaccttcacccaggaggtgatgatccagatcaaggagctggccagctacaaccccatcgtgctggaggagtgcaaggccctggtgagatgcaacatcaagctggagctggagcaggccaacgagagagagtgcgaggtgctgagaaagatctggagcagcgcccagggcatcgagagcatgctgaagtacgtggagaacaagatcgacgagttctag

SEQ ID NO: 7746 - DNA, 1626 bp, Artificial Sequence
  Description of Artificial Sequence: Synthetic coding sequence
atggccagccaggagttcgaggtggaggccatcgtggacaagagacaggacaagaacggcaacacccagtacctggtgagatggaagggctacgacaagcaggacgacacctgggagcccgagcagcacctgatgaactgcgagaagtgcgtgcacgacttcaacagaagacagaccgagaagcagaagaagctgacctggaccaccaccagcagaatcttcagcaacaacgccagaagaagaaccagcagaagcaccaaggccaactacagcaagaacagccccaagacccccgtgaccgacaagcaccacagaagcaagaactgcaagctgttcgccgccagcaagaacgtgagaagaaaggccgccagcaccctgagcgacaccaagaacatggagatcatcaacagcaccatcgagaccctggcccccgacagccccttcgaccacaagaagaccgtgagcggcttccagaagctggagaagctggaccccatcgccgccgaccagcaggacaccgtggtgttcaaggtgaccgagggcaagctgctgagagaccccctgagccaccccggcgccgagcagaccggcatccagaacaagacccagatgcaccccctgatgagccagatgagcggcagcgtgaccgccagcatggccaccggcagcgccaccagaaagggcatcgtggtgctgatcgaccccctggccgccaacggcaccaccgacatgcacaccagcgtgcccagagtgaagggcggccagagaaacatcaccgacgacagcagaggccagcccttcatcaagaagatgcacttcaccatcagactgaccgagagcgccatcacctacagagacatcgtggtgaagaaggaggacggcttcacccagatcgtgctgagcaccagaagcaccgagaagaacgccctgaacaccgaggtgatcaaggagatggtgaacgccctgaacagcgccgccgccgacgacagcaagctggtgctgttcagcgccgccggcagcgtgttctgctgcggcctggacttcggctacttcgtgagacacctgagaaacgacagaaacaccgccagcctggagatggtggacaccatcaagaacttcgtgaacaccttcatccagttcaagaagcccatcgtggtgagcgtgaacggccccgccatcggcctgggcgccagcatcctgcccctgtgcgacctggtgtgggccaacgagaaggcctggttccagaccccctacaccaccttcggccagagccccgacggctgcagcagcatcaccttccccaagatgatgggcaaggccagcgccaacgagatgctgatcgccggcagaaagctgaccgccagagaggcctgcgccaagggcctggtgagccaggtgttcctgaccggcaccttcacccaggaggtgatgatccagatcaaggagctggccagctacaacgccatcgtgctggaggagtgcaaggccctggtgagatgcaacatcaagctggagctggagcaggccaacgagagagagtgcgaggtgctgagaaagatctggagcagcgcccagggcatcgagagcatgctgaagtacgtggagaacaagatcgacgagttctag

SEQ ID NO: 7747 - DNA, 1668 bp, Artificial Sequence
  Description of Artificial Sequence: Synthetic coding sequence
atggccagccaggagttcgaggtggaggccatcgtggacaagagacaggacaagaacggcaacacccagtacctggtgagatggaagggctacgacaagcaggacgacacctgggagcccgagcagcacctgatgaactgcgagaagtgcgtgcacgacttcaacagaagacagaccgagaagcagaagaagctgacctggaccaccaccagcagaatcttcagcaacaacgccagaagaagaaccagcagaagcaccaaggccaactacagcaagaacagccccaagacccccgtgaccgacaagcaccacagaagcaagaactgcaagctgttcgccgccagcaagaacgtgagaagaaaggccgccagcaccctgagcgacaccaagaacatggagatcatcaacagcaccatcgagaccctggcccccgacagccccttcgaccacaagaagaccgtgagcggcttccagaagctggagaagctggaccccatcgccgccgaccagcaggacaccgtggtgttcaaggtgaccgagggcaagctgctgagagaccccctgagccaccccggcgccgagcagaccggcatccagaacaagacccagatgcaccccctgatgagccagatgagcggcagcgtgaccgccagcatggccaccggcagcgccaccagaaagggcatcgtggtgctgatcgaccccctggccgccaacggcaccaccgacatgcacaccagcgtgcccagagtgaagggcggccagagaaacatcaccgacgacagcagaggccagcccttcatcaagaagatgcacttcaccatcagactgaccgagagcgccatcacctacagagacatcgtggtgaagaaggaggacggcttcacccagatcgtgctgagcaccagaagcaccgagaagaacgccctgaacaccgaggtgatcaaggagatggtgaacgccctgaacagcgccgccgccgacgacagcaagctggtgctgttcagcgccgccggcagcgtgttctgctgcggcctggacttcggctacttcgtgagacacctgagaaacgacagaaacaccgccagcctggagatggtggacaccatcaagaacttcgtgaacaccttcatccagttcaagaagcccatcgtggtgagcgtgaacggccccgccatcggcctgggcgccagcatcctgcccctgtgcgacctggtgtgggccaacgagaaggcctggttccagaccccctacaccaccttcggccagagccccgacggctgcagcagcatcaccttccccaagatgatgggcaaggccagcgccaacgagatgctgatcgccggcagaaagctgaccgccagagaggcctgcgccaagggcctggtgagccaggtgttcctgaccggcaccttcacccaggaggtgatgatccagatcaaggagctggccagctacaacgccatcgtgctggaggagtgcaaggccctggtgagatgcaacatcaagctggagctggagcaggccaacgagagagagtgcgaggtgctgagaaagatctggagcagcgcccagggcatcgagagcatgctgaagatccccctgctgggctacaaggccgccttcccccccagaaagacccagaacgaccagagatggtgcccctag

SEQ ID NO: 7748 - DNA, 423 bp, Artificial Sequence
  Description of Artificial Sequence: Synthetic coding sequence
ggcccccccgagcagagcctgctgctgaccgaggcctggagctgggccagcaagaagaagcagccccacctgttcagcggcgtgatcgtgggcggccacctgtggctgctgggcttcagccccggcgccggcggcttctgcaccaccctgccccccagcttcctgagagtggacgacagagccaccagcagcaccaccgacagcagcagagcccccagcagccccagaccccccggcagcaccagccactgcggcatcagcaccagatgcaccgagagatgcctgtgcgtgctgcccctgagaaccagccaggtgcccgacgtgatggccccccagcacgaccaggagcccaagagaagaatgtacttcatctggctgggctggatccccagcgacaagcccagccagctgaccgagagatag

SEQ ID NO: 7749 - DNA, 510 bp, Artificial Sequence
  Description of Artificial Sequence: Synthetic coding sequence
ccccccgagcagagcctgctgctgaccgaggcctggagctgggccagcaagaagaagcagccccacctgttcagcggcgtgatcgtgggcggccacctgtggctgctgggcttcagccccggcgccggcggcttctgcaccaccctgccccccagcttcctgagagtggacgacagagccaccagcagcaccaccgacagcagcagagcccccagcagccccagaccccccggcagcaccagccactgcggcatcagcaccagatgcaccgagagatgcctgtgcgtgctgcccctgagaaccagccaggtgcccgacgtgatggccccccagcacgaccaggagaagttccacgacctggcctacagctgcctgggcaagagcttcagcatgagcaaccaggacctgtacggctacagcaccagcagcctggccctgggcctggcctggctgagctgggagaccaagaagaagaacgtgctgcacctggtgggcctggacagcctgtag

SEQ ID NO: 7750 - DNA, 567 bp, Artificial Sequence
  Description of Artificial Sequence: Synthetic coding sequence
tgagcccagagaggccccggcaaggccggcctgaccggcggcagagagagactggagagaggcgccagagccgccagaaccgaccagcaccagagaatccaggaggaggagagagacctgaccggcagcggcgacatcagccccccccagcaccccagcagacacagcttcagccccggcgccggcggcttctgcaccaccctgccccccagcttcctgagagtggacgacagagccaccagcagcaccaccgacagcagcagagcccccagcagccccagaccccccggcagcaccagccactgcggcatcagcaccagatgcaccgagagatgcctgtgcgtgctgcccctgagaaccagccaggtgcccgacgtgatggccccccagcacgaccaggagaagttccacgacctggcctacagctgcctgggcaagagcttcagcatgagcaaccaggacctgtacggctacagcaccagcagcctggccctgggcctggcctggctgagctgggagaccaagaagaagaacgtgctgcacctggtgggcctggacagcctgtag

SEQ ID NO: 7751 - DNA, 471 bp, Artificial Sequence
  Description of Artificial Sequence: Synthetic coding sequence
atgttcctgaccgaggacctgatcaccttcaacctgagaaacttcctgctgttccagctgtgggagagcagcttcagccccggcgccggcggcttctgcaccaccctgccccccagcttcctgagagtggacgacagagccaccagcagcaccaccgacagcagcagagcccccagcagccccagaccccccggcagcaccagccactgcggcatcagcaccagatgcaccgagagatgcctgtgcgtgctgcccctgagaaccagccaggtgcccgacgtgatggccccccagcacgaccaggagaagttccacgacctggcctacagctgcctgggcaagagcttcagcatgagcaaccaggacctgtacggctacagcaccagcagcctggccctgggcctggcctggctgagctgggagaccaagaagaagaacgtgctgcacctggtgggcctggacagcctgtag

SEQ ID NO: 7752 - DNA, 201 bp, Artificial Sequence
  Description of Artificial Sequence: Synthetic coding sequence
tgacagccccagggcccccccgagcagagcctgctgctgaccgaggcctggagctgggccagcaagaagaagcagccccacctgttcagcggcgtgatcgtgggcggccacctgtggctgctgggccccaagagaagaatgtacttcatctggctgggctggatccccagcgacaagcccagccagctgaccgagagatag

SEQ ID NO: 7753 - DNA, 3615 bp, Artificial Sequence
  Description of Artificial Sequence: Synthetic coding sequence
atgggcgacgccaaggaggccggcgccgagggcccccccgccggcgccgccgccagaggcggcctgagcctgctgagccagggcgagagcgaggagagcagcgcccagggcagcgccctgttcctgggcggcaacgaggtgaagagcagagccgtggtgaagtacagcagcgccccccccagaaccgccttcgccagactggaggagaagaccgacctgaagctgccccccgccaactggctgagagagagcgccaagctgggccccgccggcaccaccatcctgggcaacagcaagaagagcaagcccttcagcagcttcggcatggcctacgacttcatcgacagcgtgggcaacgacgtggacgtggtgagcgacagcgagaacatcaagaagctgctgaagatcccctacagcaagagccacgtgagcatggccgtgcacagaatcggcagaaccctgctgctggacgagctggacatccaggagctgttcatgagaagcagccagaccggcgactggacctggctgaaggagttctaccagagactgatcgaccagaagtggcagagaaagaagaagagcaaggagcactggtaccagaaggccatcctgagcaagttcctgtactacagcatcaacggcgacggcgccgcccagcccgtgagcagcaccgccgagcagcaggagagcagcagcagcgaccagaccaacgacagcgagggcgccagctggcccgcccccttcgagatgcccagcagcgtgagcgaggaccccagcgccagcagccagggcctgaagaacgacttcgtgagaaacatcctgtggaccttcgaggacatccacatgctggtgggcagcaacatgcccatcttcggcggcggcagataccccgccgtgagcctgagactgagagacaacaacaagcccatcaacgtgctgaccggcatcgactactggctggacaacctgatctgcaacgtgcccgagctggtgatgtgcttccacgtgaacggcatcgtgcagaagtacgagatgatcaagaccgaggagatccccaacctggagaacagcaacttcagcaccaaggtgatcaaggacatcgcccagaacatcctgagcttcctgaagagcaactgcaccaaggagggccacacctactggctgttcaaggccagcggcagcgacatcgtgaagctgtacgacctgaccaccctgtgcgaggagaccgaggacaagtaccagaaccccttcaccatgcccgtggccatcctgctgtacaaggtggcctgcaacatgatgatgaagaagaaccagaacaagaagcactacggcaccatcagaaccctgctgctgaactgcctgaagctgctggacaagagcagacacccccagatcatcgccagcgccaactacatgctgagcgagctgttccagctggacgagcccaagaaggaggagaacagcgagagccccctgaacgagaacagcgacgagagctacagcgaggaggaggaggagatgcccgacagcgacgagaacggcagctacagcaccagcagcgaccccagcgacgacagcaaggccgtggccatcatcaagagcgtgggcgagctgagcgtgcccgagaagtacaagagcatccaccagatcagacccagctgcgccttccccgtgtgccacgacaccgaggagagatgcagactggtgctgagctacgtgctggagggcctgaagagcgtggacagcagcatcaagaaggagagcgacctgcccgccgccgaccccagcacccccatccccctgaagtacgaggacgagagcagcagaggcggccccgagggcctggagaagcagatggccctgttcctggacaagatgggcagcctgcagaagggcaactacagcagccagagcggcatgatccccggcagctggcagcacaagatgaagctgcagctgatcctgaagagcagcaaggcctactacgtgctgagcgacgccgccatgagcctgcagaagtacggcagagccctgagatacatcaagctggccctgcagagccacgacacctactgctgcctgtgcaccaacatgctgagcgaggtgctgctgttcctgagccagtacctgaccctgtgcggcgacatccagctgatgctggcccagaacgccaacaacagagccgcccacctggaggagttccactaccagaccaaggaggaccaggagatcctgcacagcctgcacagagagagcagctgccagggcttcgcctgggccaccgacctgagcaccgacctggagagccagctgagcgtgagctgcaagtgctacgaggccgccaacgagatcctgcagttcagcgacctgaagagccagaaccccgagcactacgtgcaggtgctgaagagaatgggcaacatcagaaacgagatcggcgtgttctacatgaaccaggccgccgccctgcagagcgagagactggtgagcaagagcgtgagcgccgccgagcagcagctgtggaagaagagcttcagctgcttcgagaagggcatccacaacttcgagagcatcgaggacgccaccaacgccgccctgctgctgtgcaacaccggcagactgatgagaatctgcgcccaggcccactgcggcgccggcgacgagctgaagagagagttcagccccgaggagggcctgtactacaacaaggccatcgactactacctgaaggccctgagaagcctgggcaccagagacatccaccccgccgtgtgggacagcgtgaactgggagctgagcaccacctacttcaccatggccaccctgcagcaggactacgcccccctgagcagaaaggcccaggagcagatcgagaaggaggtgagcgaggccatgatgaagagcctgaagtactgcgacgtggacagcgtgagcgccagacagcccctgtgccagtacagagccgccaccatccaccacagactggccagcatgtaccacagctgcctgagaaaccaggtgggcgacgagcacctgagaaagcagcacagagtgctggccgacctgcactacagcaaggccgccaagctgttccagctgctgaaggacgccccctgcgagctgctgagagtgcagctggagagagtggccttcgccgagttccagatgaccagccagaacagcaacgtgggcaagctgaagaccctgagcggcgccctggacatcatggtgagaaccgagcacgccttccagctgatccagaaggagctgatcgaggagttcggccagcccaagagcggcgacgccgccgccgccgccgacgccagccccagcctgaacagagaggaggtgatgaagctgctgagcatcttcgagagcagactgagcttcctgctgctgcagagcatcaagctgctgagcagcaccaagaagaagaccagcaacaacatcgaggacgacaccatcctgaagaccaacaagcacatctacagccagctgctgagagccaccgccaacaagaccgccaccctgctggagagaatcaacgtgatcgtgcacctgctgggccagctggccgccggcagcgccgccagcagcaacgccgtgcagtag

SEQ ID NO: 7754 - DNA, 3717 bp, Artificial Sequence
  Description of Artificial Sequence: Synthetic coding sequence
atgggcgacgccaaggaggccggcgccgagggcccccccgccggcgccgccgccagaggcggcctgagcctgctgagccagggcgagagcgaggagagcagcgcccagggcagcgccctgttcctgggcggcaacgaggtgaagagcagagccgtggtgaagtacagcagcgccccccccagaaccgccttcgccagactggaggagaagaccgacctgaagctgccccccgccaactggctgagagagagcgccaagctgggccccgccggcaccaccatcctgggcaacagcaagaagagcaagcccttcagcagcttcggcatggcctacgacttcatcgacagcgtgggcaacgacgtggacgtggtgagcgacagcgagaacatcaagaagctgctgaagatcccctacagcaagagccacgtgagcatggccgtgcacagaatcggcagaaccctgctgctggacgagctggacatccaggagctgttcatgagaagcagccagaccggcgactggacctggctgaaggagttctaccagagactgatcgaccagaagtggcagagaaagaagaagagcaaggagcactggtaccagaaggccatcctgagcaagttcctgtactacagcatcaacggcgacggcgccgcccagcccgtgagcagcaccgccgagcagcaggagagcagcagcagcgaccagaccaacgacagcgagggcgccagctggcccgcccccttcgagatgcccagcagcgtgagcgaggaccccagcgccagcagccagggcagcgagcccctggagcccagctacatcgtgggccacgtggccagcgcccccaaggagcagaacctgatcaccctgttcaacgacggcgagcacagccagggcctgaagaacgacttcgtgagaaacatcctgtggaccttcgaggacatccacatgctggtgggcagcaacatgcccatcttcggcggcggcagataccccgccgtgagcctgagactgagagacaacaacaagcccatcaacgtgctgaccggcatcgactactggctggacaacctgatctgcaacgtgcccgagctggtgatgtgcttccacgtgaacggcatcgtgcagaagtacgagatgatcaagaccgaggagatccccaacctggagaacagcaacttcagcaccaaggtgatcaaggacatcgcccagaacatcctgagcttcctgaagagcaactgcaccaaggagggccacacctactggctgttcaaggccagcggcagcgacatcgtgaagctgtacgacctgaccaccctgtgcgaggagaccgaggacaagtaccagaaccccttcaccatgcccgtggccatcctgctgtacaaggtggcctgcaacatgatgatgaagaagaaccagaacaagaagcactacggcaccatcagaaccctgctgctgaactgcctgaagctgctggacaagagcagacacccccagatcatcgccagcgccaactacatgctgagcgagctgttccagctggacgagcccaagaaggaggagaacagcgagagccccctgaacgagaacagcgacgagagctacagcgaggaggaggaggagatgcccgacagcgacgagaacggcagctacagcaccagcagcgaccccagcgacgacagcaaggccgtggccatcatcaagagcgtgggcgagctgagcgtgcccgagaagtacaagagcatccaccagatcagacccagctgcgccttccccgtgtgccacgacaccgaggagagatgcagactggtgctgagctacgtgctggagggcctgaagagcgtggacagcagcatcaagaaggagagcgacctgcccgccgccgaccccagcacccccatccccctgaagtacgaggacgagagcagcagaggcggccccgagggcctggagaagcagatggccctgttcctggacaagatgggcagcctgcagaagggcaactacagcagccagagcggcatgatccccggcagctggcagcacaagatgaagctgcagctgatcctgaagagcagcaaggcctactacgtgctgagcgacgccgccatgagcctgcagaagtacggcagagccctgagatacatcaagctggccctgcagagccacgacacctactgctgcctgtgcaccaacatgctgagcgaggtgctgctgttcctgagccagtacctgaccctgtgcggcgacatccagctgatgctggcccagaacgccaacaacagagccgcccacctggaggagttccactaccagaccaaggaggaccaggagatcctgcacagcctgcacagagagagcagctgccagggcttcgcctgggccaccgacctgagcaccgacctggagagccagctgagcgtgagctgcaagtgctacgaggccgccaacgagatcctgcagttcagcgacctgaagagccagaaccccgagcactacgtgcaggtgctgaagagaatgggcaacatcagaaacgagatcggcgtgttctacatgaaccaggccgccgccctgcagagcgagagactggtgagcaagagcgtgagcgccgccgagcagcagctgtggaagaagagcttcagctgcttcgagaagggcatccacaacttcgagagcatcgaggacgccaccaacgccgccctgctgctgtgcaacaccggcagactgatgagaatctgcgcccaggcccactgcggcgccggcgacgagctgaagagagagttcagccccgaggagggcctgtactacaacaaggccatcgactactacctgaaggccctgagaagcctgggcaccagagacatccaccccgccgtgtgggacagcgtgaactgggagctgagcaccacctacttcaccatggccaccctgcagcaggactacgcccccctgagcagaaaggcccaggagcagatcgagaaggaggtgagcgaggccatgatgaagagcctgaagtactgcgacgtggacagcgtgagcgccagacagcccctgtgccagtacagagccgccaccatccaccacagactggccagcatgtaccacagctgcctgagaaaccaggtgggcgacgagcacctgagaaagcagcacagagtgctggccgacctgcactacagcaaggccgccaagctgttccagctgctgaaggacgccccctgcgagctgctgagagtgcagctggagagagtggccttcgccgagttccagatgaccagccagaacagcaacgtgggcaagctgaagaccctgagcggcgccctggacatcatggtgagaaccgagcacgccttccagctgatccagaaggagctgatcgaggagttcggccagcccaagagcggcgacgccgccgccgccgccgacgccagccccagcctgaacagagaggaggtgatgaagctgctgagcatcttcgagagcagactgagcttcctgctgctgcagagcatcaagctgctgagcagcaccaagaagaagaccagcaacaacatcgaggacgacaccatcctgaagaccaacaagcacatctacagccagctgctgagagccaccgccaacaagaccgccaccctgctggagagaatcaacgtgatcgtgcacctgctgggccagctggccgccggcagcgccgccagcagcaacgccgtgcagtag

SEQ ID NO: 7755 - DNA, 954 bp, Artificial Sequence
  Description of Artificial Sequence: Synthetic coding sequence
agcatccaccagatcagacccagctgcgccttccccgtgtgccacgacaccgaggagagatgcagactggtgctgagctacgtgctggagggcctgaagagcgtggacagcagcatcaagaaggagagcgacctgcccgccgccgaccccagcacccccatccccctgaagtacgaggacgagagcagcagaggcggccccgagggcctggagaagcagatggccctgttcctggacaagatgggcagcctgcagaagggcaactacagcagccagagcggcatgatccccggcagctggcagcacaagatgaagctgcagctgatcctgaagagcagcaaggcctactacgtgctgagcgacgccgccatgagcctgcagaagtacggcagagccctgagatacatcaagctggccctgcagagccacgacacctactgctgcctgtgcaccaacatgctgagcgaggtgctgctgttcctgagccagtacctgaccctgtgcggcgacatccagctgatgctggcccagaacgccaacaacagagccgcccacctggaggagttccactaccagaccaaggaggaccaggagatcctgcacagcctgcacagagagagcagctgccagggcgtgccccaggcctggaccacctggttcaccgtgggcctgtgcagcctggcccacgcctacctgagcatccagaagagaggcagaaacatcagagtgctgatcttcgccctgtacctgttcatctacttcctgagaagaagcttcgccctggtggcccaggccggcgtgcagtggtgcaacctgggcagcctgaagccccccccccccggcttcaagcagttcagctgcctgagcctgcccagcagctggaactacagacacgcccccccctgccccgccagccccccctggccccccaaggtgctgggcctgcaggtgtag

SEQ ID NO: 7756 - DNA, 2391 bp, Artificial Sequence
  Description of Artificial Sequence: Synthetic coding sequence
atgggcgacgccaaggaggccggcgccgagggcccccccgccggcgccgccgccagaggcggcctgagcctgctgagccagggcgagagcgaggagagcagcgcccagggcagcgccctgttcctgggcggcaacgaggtgaagagcagagccgtggtgaagtacagcagcgccccccccagaaccgccttcgccagactggaggagaagaccgacctgaagctgccccccgccaactggctgagagagagcgccaagctgggccccgccggcaccaccatcctgggcaacagcaagaagagcaagcccttcagcagcttcggcatggcctacgacttcatcgacagcgtgggcaacgacgtggacgtggtgagcgacagcgagaacatcaagaagctgctgaagatcccctacagcaagagccacgtgagcatggccgtgcacagaatcggcagaaccctgctgctggacgagctggacatccaggagctgttcatgagaagcagccagaccggcgactggacctggctgaaggagttctaccagagactgatcgaccagaagtggcagagaaagaagaagagcaaggagcactggtaccagaaggccatcctgagcaagttcctgtactacagcatcaacggcgacggcgccgcccagcccgtgagcagcaccgccgagcagcaggagagcagcagcagcgaccagaccaacgacagcgagggcgccagctggcccgcccccttcgagatgcccagcagcgtgagcgaggaccccagcgccagcagccagggcagcgagcccctggagcccagctacatcgtgggccacgtggccagcgcccccaaggagcagaacctgatcaccctgttcaacgacggcgagcacagccagggcctgaagaacgacttcgtgagaaacatcctgtggaccttcgaggacatccacatgctggtgggcagcaacatgcccatcttcggcggcggcagataccccgccgtgagcctgagactgagagacaacaacaagcccatcaacgtgctgaccggcatcgactactggctggacaacctgatctgcaacgtgcccgagctggtgatgtgcttccacgtgaacggcatcgtgcagaagtacgagatgatcaagaccgaggagatccccaacctggagaacagcaacttcagcaccaaggtgatcaaggacatcgcccagaacatcctgagcttcctgaagagcaactgcaccaaggagggccacacctactggctgttcaaggccagcggcagcgacatcgtgaagctgtacgacctgaccaccctgtgcgaggagaccgaggacaagtaccagaaccccttcaccatgcccgtggccatcctgctgtacaaggtggcctgcaacatgatgatgaagaagaaccagaacaagaagcactacggcaccatcagaaccctgctgctgaactgcctgaagctgctggacaagagcagacacccccagatcatcgccagcgccaactacatgctgagcgagctgttccagctggacgagcccaagaaggaggagaacagcgagagccccctgaacgagaacagcgacgagagctacagcgaggaggaggaggagatgcccgacagcgacgagaacggcagctacagcaccagcagcgaccccagcgacgacagcaaggccgtggccatcatcaagagcgtgggcgagctgagcgtgcccgagaagtacaagagcatccaccagatcagacccagctgcgccttccccgtgtgccacgacaccgaggagagatgcagactggtgctgagctacgtgctggagggcctgaagagcgtggacagcagcatcaagaaggagagcgacctgcccgccgccgaccccagcacccccatccccctgaagtacgaggacgagagcagcagaggcggccccgagggcctggagaagcagatggccctgttcctggacaagatgggcagcctgcagaagggcaactacagcagccagagcggcatgatccccggcagctggcagcacaagatgaagctgcagctgatcctgaagagcagcaaggcctactacgtgctgagcgacgccgccatgagcctgcagaagtacggcagagccctgagatacatcaagctggccctgcagagccacgacacctactgctgcctgtgcaccaacatgctgagcgaggtgctgctgttcctgagccagtacctgaccctgtgcggcgacatccagctgatgctggcccagaacgccaacaacagagccgcccacctggaggagttccactaccagaccaaggaggaccaggagatcctgcacagcctgcacagagagagcagctgccaggtgttcagaaagggcgtgtag

SEQ ID NO: 7757 - DNA, 2490 bp, Artificial Sequence
  Description of Artificial Sequence: Synthetic coding sequence
atgggcgacctgaagagcggcttcgaggaggtggacggcgtgagactgggctacctgatcatcaagggcaagcagatgttcgccctgagccaggtgttcaccgacctgctgaagaacatccccagaaccaccgtgcacaagagaatggaccacctgaaggtgaagaagcaccactgcgacctggaggagctgagaaagctgaaggccatcaacagcatcgccttccacgccgccaagtgcaccctgatcagcagagaggacgtggaggccctgtacaccagctgcaagaccgagagagtgctgaagaccaagagaagaagagtgggcagagccctggccaccaaggcccccccccccgagagagccgccgccgccagccccagacccggcttctggaaggacaagcaccagctgtggagaggcctgagcggcgccgccagacccctgcccatcagcgcccagagccagagacccggcgccgccgccgccagacccgccgcccacctgccccagatcttcagcaagtaccccggcagccactaccccgagatcgtgagaagcccctgcaagccccccctgaactacgagaccgcccccctgcagggcaactacgtggccttccccagcgaccccgcctacttcagaagcctgctgtgcagcaagcaccccgccgccgccgccgccgccgccgccgccgccgccgccgccgccgccgccggcgccacctgcctggagagattccacctggtgaacggcttctgcccccccccccaccaccaccaccaccaccaccaccaccaccaccaccaccaccacagagcccagcccccccagcagagccaccaccccccccaccaccacagaccccagccccacctgggcagcttccccgagagctgcagcagcgacagcgagagcagcagctacagcgaccacgccgccaacgacagcgacttcggcagcagcctgagcagcagcagcaacagcgtgagcagcgaggaggaggaggaggagggcgaggaggaggaggaggaggaggaggaggagggcggcagcggcgccagcgacagcagcgaggtgagcagcgaggaggaggacagcagcaccgagagcgacagcagcagcggcagcagccaggtgagcgtgcagagcatcagattcagaagaaccagcttctgcaagccccccagcgtgcaggcccaggccaacttcctgtaccacctggccagcgccgccgccgccaccaagcccgccgccttcgaggacgccggcagactgcccgacctgaagagcagcgtgaaggccgagagccccgccgagtggaacctgcagagctgggcccccaaggccagccccgtgtactgccccgccagcctgggcagctgcttcgccgagatcagaaacgacagagtgagcgagatcaccttcccccacagcgagatcagcaacgccgtgaagagaaccgacctgaccatcaactgcctggccgagggcgccagcagccccagccccaagaccaacaacgccttcccccagcagagaatcctgagagaggccagaaagtgcctgcagaccacccccaccacccactgcgccgacaacaacaccatcgccgccagattcctgaacaacgacagcagcggcgccgaggccaacagcgagaagtacagcaagatcctgcactgccccgagttcgccaccgacctgcccagcagccagaccgaccccgaggtgaacgccgccggcgccgccgccaccaaggccgagaacccctgcaccgacaccggcgacaagaccctgcccttcctgcacaacatcaagatcaaggtggaggacagcagcgccaacgaggagtacgagccccacctgttcaccaacaagctgaagtgcgagtgcaacgacaccaagggcgagttctacagcgtgaccgagagcaaggaggaggacgccctgctgaccaccgccaaggagggcttcgcctgccccgagaaggagacccccagcctgaaccccctggcccagagccagggcctgagctgcaccctgggcagccccaagcccgaggacggcgagtacaagttcggcgccagagtgagaaagaactacagaaccctggtgctgggcaagagacccgtgctgcagaccccccccgtgaagcccaacctgaagagcgccagaagccccagacccaccggcaagaccgagaccaacgagggcaccctggacgacttcaccgtgatcaacagaagaaagaaggtggccagcaacgtggccagcgccgtgaagagacccttccacttcatggccaacttcccctgcccccccagcctgatcatcggcagagacggcgacctgtggcccgcctacagcctgaacaccaccaaggacagccagaccccccacaaggcccaccccatctggaagtggcagctgggcggcagcgccatccccctgccccccagccacaagttcagaaagttcaacagctag

SEQ ID NO: 7758 - DNA, 2727 bp, Artificial Sequence
  Description of Artificial Sequence: Synthetic coding sequence
atgggcgacctgaagagcggcttcgaggaggtggacggcgtgagactgggctacctgatcatcaagggcaagcagatgttcgccctgagccaggtgttcaccgacctgctgaagaacatccccagaaccaccgtgcacaagagaatggaccacctgaaggtgaagaagcaccactgcgacctggaggagctgagaaagctgaaggccatcaacagcatcgccttccacgccgccaagtgcaccctgatcagcagagaggacgtggaggccctgtacaccagctgcaagaccgagagagtgctgaagaccaagagaagaagagtgggcagagccctggccaccaaggcccccccccccgagagagccgccgccgccagccccagacccggcttctggaaggacaagcaccagctgtggagaggcctgagcggcgccgccagacccctgcccatcagcgcccagagccagagacccggcgccgccgccgccagacccgccgcccacctgccccagatcttcagcaagtaccccggcagccactaccccgagatcgtgagaagcccctgcaagccccccctgaactacgagaccgcccccctgcagggcaactacgtggccttccccagcgaccccgcctacttcagaagcctgctgtgcagcaagcaccccgccgccgccgccgccgccgccgccgccgccgccgccgccgccgccgccgccgccgccgccgcctactaccaggtgagcgccgccggcccccagcccaaggccgccgccggcgccggcggccccggcagcctgagctacagatgcaagagaaagagaggcggcgccaaggactgcctgctggccccccacgccggcgccagaagactgctgctgctgcccagaagctacaaggccaaggccgccgccgccgccgccgccgccgccgccgccgccgccgccgccgccggcgccacctgcctggagagattccacctggtgaacggcttctgcccccccccccaccaccaccaccaccaccaccaccaccaccaccaccaccaccacagagcccagcccccccagcagagccaccaccccccccaccaccacagaccccagccccacctgggcagcttccccgagagctgcagcagcgacagcgagagcagcagctacagcgaccacgccgccaacgacagcgacttcggcagcagcctgagcagcagcagcaacagcgtgagcagcgaggaggaggaggaggagggcgaggaggaggaggaggaggaggaggaggagggcggcagcggcgccagcgacagcagcgaggtgagcagcgaggaggaggacagcagcaccgagagcgacagcagcagcggcagcagccaggtgagcgtgcagagcatcagattcagaagaaccagcttctgcaagccccccagcgtgcaggcccaggccaacttcctgtaccacctggccagcgccgccgccgccaccaagcccgccgccttcgaggacgccggcagactgcccgacctgaagagcagcgtgaaggccgagagccccgccgagtggaacctgcagagctgggcccccaaggccagccccgtgtactgccccgccagcctgggcagctgcttcgccgagatcagaaacgacagagtgagcgagatcaccttcccccacagcgagatcagcaacgccgtgaagagaaccgacctgaccatcaactgcctggccgagggcgccagcagccccagccccaagaccaacaacgccttcccccagcagagaatcctgagagaggccagaaagtgcctgcagaccacccccaccacccactgcgccgacaacaacaccatcgccgccagattcctgaacaacgacagcagcggcgccgaggccaacagcgagaagtacagcaagatcctgcactgccccgagttcgccaccgacctgcccagcagccagaccgaccccgaggtgaacgccgccggcgccgccgccaccaaggccgagaacccctgcaccgacaccggcgacaagaccctgcccttcctgcacaacatcaagatcaaggtggaggacagcagcgccaacgaggagtacgagccccacctgttcaccaacaagctgaagtgcgagtgcaacgacaccaagggcgagttctacagcgtgaccgagagcaaggaggaggacgccctgctgaccaccgccaaggagggcttcgcctgccccgagaaggagacccccagcctgaaccccctggcccagagccagggcctgagctgcaccctgggcagccccaagcccgaggacggcgagtacaagttcggcgccagagtgagaaagaactacagaaccctggtgctgggcaagagacccgtgctgcagaccccccccgtgaagcccaacctgaagagcgccagaagccccagacccaccggcaagaccgagaccaacgagggcaccctggacgacttcaccgtgatcaacagaagaaagaaggtggccagcaacgtggccagcgccgtgaagagacccttccacttcatggccaacttcccctgcccccccagcctgatcatcggcagagacggcgacctgtggcccgcctacagcctgaacaccaccaaggacagccagaccccccacaaggcccaccccatctggaagtggcagctgggcggcagcgccatccccctgccccccagccacaagttcagaaagttcaacagctag

SEQ ID NO: 7759 - DNA, 453 bp, Artificial Sequence
  Description of Artificial Sequence: Synthetic coding sequence
atggccgccagccagtgcctgtgctgcagcaagttcctgttccagagacagaacctggcctgcttcctgaccaacccccactgcggcagcctggtgaacgccgacggccacggcgaggtgtggaccgactggaacaacatgagcaagttcttccagtacggctggagatgcaccaccaacgagaacacctacagcaacagaaccctgatgggcaactggaaccaggagagatacgacctgagaaacatcgtgcagcccaagcccctgcccagccagttcggccactacttcgagaccacctacgacaccagctacaacaacaagatgcccctgagcacccacagattcaagagagagccccactggttccccggccaccagcccgagctggacccccccagatacaagtgcaccgagaagagcacctacatgaacagctacagcaagccctag

SEQ ID NO: 7760 - DNA, 948 bp, Artificial Sequence
  Description of Artificial Sequence: Synthetic coding sequence
atggcctgcgccgagttcagcttccacgtgcccagcctggaggagctggccggcgtgatgcagaagggcctgaaggacaacttcgccgacgtgcaggtgagcgtggtggactgccccgacctgaccaaggagcccttcaccttccccgtgaagggcatctgcggcaagaccagaatcgccgaggtgggcggcgtgccctacctgctgcccctggtgaaccagaagaaggtgtacgacctgaacaagatcgccaaggagatcaagctgcccggcgccttcatcctgggcgccggcgccggccccttccagaccctgggcttcaacagcgagttcatgcccgtgatccagaccgagagcgagcacaagccccccgtgaacggcagctacttcgcccacgtgaaccccgccgacggcggctgcctgctggagaagtacagcgagaagtgccacgacttccagtgcgccctgctggccaacctgttcgccagcgagggccagcccggcaaggtgatcgaggtgaaggccaagagaagaaccggccccctgaacttcgtgacctgcatgagagagaccctggagaagcactacggcaacaagcccatcggcatgggcggcaccttcatcatccagaagggcaaggtgaagagccacatcatgcccgccgagttcagcagctgccccctgaacagcgacgaggaggtgaacaagtggctgcacttctacgagatgaaggcccccctggtgtgcctgcccgtgttcgtgagcagagaccccggcttcgacctgagactggagcacacccacttcttcagcagacacggcgagggcggccactaccactacgacaccacccccgacatcgtggagtacctgggctacttcctgcccgccgagttcctgtacagaatcgaccagcccaaggagacccacagcatcggcagagactag

SEQ ID NO: 7761 - DNA, 948 bp, Artificial Sequence; identical to SEQ ID NO: 7760
  Description of Artificial Sequence: Synthetic coding sequence

SEQ ID NO: 7762 - DNA, 891 bp, Artificial Sequence
  Description of Artificial Sequence: Synthetic coding sequence
atgcagaagggcctgaaggacaacttcgccgacgtgcaggtgagcgtggtggactgccccgacctgaccaaggagcccttcaccttccccgtgaagggcatctgcggcaagaccagaatcgccgaggtgggcggcgtgccctacctgctgcccctggtgaaccagaagaaggtgtacgacctgaacaagatcgccaaggagatcaagctgcccggcgccttcatcctgggcgccggcgccggccccttccagaccctgggcttcaacagcgagttcatgcccgtgatccagaccgagagcgagcacaagccccccgtgaacggcagctacttcgcccacgtgaaccccgccgacggcggctgcctgctggagaagtacagcgagaagtgccacgacttccagtgcgccctgctggccaacctgttcgccagcgagggccagcccggcaaggtgatcgaggtgaaggccaagagaagaaccggccccctgaacttcgtgacctgcatgagagagaccctggagaagcactacggcaacaagcccatcggcatgggcggcaccttcatcatccagaagggcaaggtgaagagccacatcatgcccgccgagttcagcagctgccccctgaacagcgacgaggaggtgaacaagtggctgcacttctacgagatgaaggcccccctggtgtgcctgcccgtgttcgtgagcagagaccccggcttcgacctgagactggagcacacccacttcttcagcagacacggcgagggcggccactaccactacgacaccacccccgacatcgtggagtacctgggctacttcctgcccgccgagttcctgtacagaatcgaccagcccaaggagacccacagcatcggcagagactag

SEQ ID NO: 7763 - DNA, 450 bp, Artificial Sequence
  Description of Artificial Sequence: Synthetic coding sequence
atggcctgcgccgagttcagcttccacgtgcccagcctggaggagctggccggcgtgatgcagaagggcctgaaggacaacttcgccgacgtgcaggtgagcgtggtggactgccccgacctgaccaaggagcccttcaccttccccgtgaagggcatctgcggcaagaccagaatcgccgaggtgggcggcgtgccctacctgctgcccctggtgaaccagaagaaggtgtacgacctgaacaagatcgccaaggagatcaagctgcccggcgccttcatcctgggcgccggcgccggccccttccagaccctgggcttcaacagcgagttcatgcccgtgatccagaccgagagcgagcacaagccccccgtgaacggcagctacttcgcccacgtgaaccccgccgacggcggctgcctgctggagaagtacagcgagaagtgctag

SEQ ID NO: 7764 - DNA, 234 bp, Artificial Sequence
  Description of Artificial Sequence: Synthetic coding sequence
atggcctgcgccgagttcagcttccacgtgcccagcctggaggagctggccggcgtgatgcagaagggcctgaaggacaacttcgccgacgtgcaggtgagcgtggtggactgccccgacctgaccaaggagcccttcaccttccccgtgaagggcatctgcggcaagaccagaatcgccgaggtgggcggcgtgccctacctgctgcccctggtgaaccagaagaaggtgtag

SEQ ID NO: 7765 - DNA, 516 bp, Artificial Sequence
  Description of Artificial Sequence: Synthetic coding sequence
atggcctgcgccgagttcagcttccacgtgcccagcctggaggagctggccggcgtgatgcagaagggcctgaaggacaacttcgccgacgtgcaggtgagcgtggtggactgccccgacctgaccaaggagcccttcaccttccccgtgaagggcatctgcggcaagaccagaatcgccgaggtgggcggcgtgccctacctgctgcccctggtgaaccagaagaaggtgtacgacctgaacaagatcgccaaggagatcaagctgcccggcgccttcatcctgggcgccggcgccggccccttccagaccctgggcttcaacagcgagttcatgcccgtgatccagaccgagagcgagcacaagccccccgtgaacggcagctacttcgcccacgtgaaccccgccgacggcggctgcctgctggagaagtacagcgagaagtgccacgacttccagtgcgccctgctggccaacctgttcgccagcgagggccagcccggcaaggtgatctag

SEQ ID NO: 7766 - DNA, 948 bp, Artificial Sequence; identical to SEQ ID NO: 7760
  Description of Artificial Sequence: Synthetic coding sequence

SEQ ID NO: 7767 - DNA, 798 bp, Artificial Sequence
  Description of Artificial Sequence: Synthetic coding sequence
atggcctgcgccgagttcagcttccacgtgcccagcctggaggagctggccggcgtgatgcagaagggcctgaaggacaacttcgccgacgtgcaggtgagcgtggtggactgccccgacctgaccaaggagcccttcaccttccccgtgaagggcatctgcggcaagaccagaatcgccgaggtgggcggcgtgccctacctgctgcccctggtgaaccagaagaaggtgtacgacctgaacaagatcgccaaggagatcaagctgcccggcgccttcatcctgggcgccggcgccggccccttccagaccctgggcttcaacagcgagttcatgcccgtgatccagaccgagagcgagcacaagccccccgtgaacggcagctacttcgcccacgtgaaccccgccgacggcggctgcctgctggagaagtacagcgagaagtgccacgacttccagtgcgccctgctggccaacctgttcgccagcgagggccagcccggcaagcccgccgagttcagcagctgccccctgaacagcgacgaggaggtgaacaagtggctgcacttctacgagatgaaggcccccctggtgtgcctgcccgtgttcgtgagcagagaccccggcttcgacctgagactggagcacacccacttcttcagcagacacggcgagggcggccactaccactacgacaccacccccgacatcgtggagtacctgggctacttcctgcccgccgagttcctgtacagaatcgaccagcccaaggagacccacagcatcggcagagactag

SEQ ID NO: 7768 - DNA, 291 bp, Artificial Sequence
  Description of Artificial Sequence: Synthetic coding sequence
atggcctgcgccgagttcagcttccacgtgcccagcctggaggagctggccggcgtgatgcagaagggcctgaaggacaacttcgccgacgtgcaggtgagcgtggtggactgccccgacctgaccaaggagcccttcaccttccccgtgaagggcatctgcggcaagaccagaatcgccgaggtgggcggcgtgccctacctgctgcccctggtgaaccagaagaaggtgtacgacctgaacaagatcgccaaggagatcaagctgcccggcgccttcatcctgggctag

SEQ ID NO: 7769 - DNA, 720 bp, Artificial Sequence
  Description of Artificial Sequence: Synthetic coding sequence
atgcagaagggcctgaaggacaacttcgccgacgtgcaggtgagcgtggtggactgccccgacctgaccaaggagcccttcaccttccccgtgaagggcatctgcggcaagaccagaatcgccgaggtgggcggcgtgccctacctgctgcccctggtgaaccagaagaaggtgtacgacctgaacaagatcgccaaggagatcaagctgcccggcgccttcatcctgggcgccggcgccggccccttccagaccctgggcttcaacagcgagttcatgcccgtgatccagaccgagagcgagcacaagccccccgtgaacggcagctacttcgcccacgtgaaccccgccgacggcggctgcctgctggagaagtacagcgagaagtgccacgacttccagtgcgccctgctggccaacctgttcgccagcgagggccagcccggcaaggtgatcgaggtgaaggccaagagaagaaccggccccctgaacttcgtgacctgcatgagagagaccctggagaagcactacggcaacaagcccatcggcatgggcggcaccttcatcatccagaagggcaaggtgaagagccacatcatgcccgccgagttcagcagctgccccctgaacagcgacgaggaggtgaacaagtggctgcacttctacgagatgaaggcccccctggtgtgcctgcccgtgttcgtgagcagagacccctag

SEQ ID NO: 7770 - DNA, 303 bp, Artificial Sequence
  Description of Artificial Sequence: Synthetic coding sequence
atggcctgcgccgagttcagcttccacgtgcccagcctggaggagctggccggcgtgatgcagaagggcctgaaggacaacttcgccgacgtgcaggtgagcgtggtggactgccccgacctgaccaaggagcccttcaccttccccgtgaagggcatctgcggcaagaccagaatcgccgaggtgggcggcgtgccctacctgctgcccctggtgaaccagaagaaggtgtacgacctgaacaagatcgccaaggagatcaagctgcccggcgccttcatcctgggcgccggcgccggctag

SEQ ID NO: 7771 - DNA, 891 bp, Artificial Sequence; identical to SEQ ID NO: 7762
  Description of Artificial Sequence: Synthetic coding sequence

SEQ ID NO: 7772 - DNA, 1221 bp, Artificial Sequence
  Description of Artificial Sequence: Synthetic coding sequence
atgacccagaccctggacaccagagaggaccccctgaacctgggcggcggcggcggcggcggctgcggctgcggctgggcccacagcgccagcctgagcagctggagcagctgccacagaagaagacccggcgcccccgcctacaacagaccccacagatacagccccaagaccgagtacggcccccccagaaagcagcccaagcagcagcacggccccggcttctggttccagccccccgtgtgcagcaactggggctgctggggcggcccctggagaccccccccccccggcttctggaagttcccctgccccgtgcaggtgttcagagtgtacggcctgcaccccctgtgcttctgctgctgcagctgctggagcggcagctggaaccccggctgggtgaagccccccggcagaaagaagagatggggcagaagaggcagaggcctgagacaccaccccagacacagctaccccagaagcccccccgccgacgtgagcaccctgcccagacccgtgaagctgtacgagtggagagagcccggcatgagagccccccccaacaccacccagttcatcatgaaccagatctacgaggacatgagacagcaggagaaggtggagagacagcaggaggccctgagagcccagaaggccaccgtgagcggcgaggccagccccgccagaagcagcggcaacgacgccccccccggcggcagcaaggagacctggggcctgcaggagaccctgtacggcttcgtgcagaaccccagcctggccttcagccccaaccccgaggagaaccagagcctggcccccctgctggtggaggaggaggaggagaagaagaacgacgacgaggaggagtacgaccaggaggtgtgcgacgccaaggaggccagcgaggaggaggaggaggtggaggacgaggaggaggaggtggaggacgaggaggaggaggaggtggaggaggccgagtacgtggaggagggcgaggaggagctggaggaggaggagctggaggaggaggaggaggtgctggaggagaacgagcagagaggcgaggagttccacctgcccctggagatgcccctgagcatcttcgtggaggccgaggagaagagagagaacttcatcagctgcaccttcctgaaccccgagcagatcatccccaaggtgccccaggagagcctgttcatggcccaggacttcaactgctag

SEQ ID NO: 7773 - DNA, 195 bp, Artificial Sequence
  Description of Artificial Sequence: Synthetic coding sequence
atgccccccagaaagaagagaagacagcccagccagaaggcccccctgctgttccaccagcagcccctggagggccccaagcacagctgcgccagcacccagctgcccatcacccacaccagacaggtgcccagcaagcccatcgaccacagcaccatcaccagctgggtgagccccgacttcgacaccgcctag

SEQ ID NO: 7774 - DNA, 717 bp, Artificial Sequence
  Description of Artificial Sequence: Synthetic coding sequence
atgccccccagaaagaagagaagacagcccagccagaaggcccccctgctgttccaccagcagcccctggagggccccaagcacagctgcgccagcacccagctgcccatcacccacaccagacaggtgcccagcaagcccatcgaccacagcaccatcaccagctgggtgagccccgacttcgacaccgccgccggcagcctgttccccgcctaccagaagcaccagaacagagccagacacagcagcagaaagcccaccaccagcaagttcccccacctgaccttcgagagcccccagagcagcagcagcgagaccctgggcatccccctgatcagagagtgccccagcgagagcgagaaggacgtgagcagaagacccctggtgcccgtgctgagcccccagagctgcggcaacatgagcgtgcaggccctgcagagcctgccctacgtgttcatcccccccgacatccagacccccgagagcagcagcgtgaaggaggagctgatcccccaggaccagaaggagaacagcctgctgagctgcaccctgcacaccggcacccccaacagccccgagcccggccccgtgctggtgaaggacacccccgaggacaagtacggcatcaaggtgacctggagaagaagacagcacctgctggcctacctgagagagagaggcaagctgagcagaagccagttcctggtgaagagctag

SEQ ID NO: 7775 - DNA, 399 bp, Artificial Sequence
  Description of Artificial Sequence: Synthetic coding sequence
atgccccccagaaagaagagaagacagcccagccagaaggcccccctgctgttccaccagcagcccctggagggccccaagcacagctgcgccagcacccagctgcccatcacccacaccagacaggtgcccagcaagcccatcgaccacagcaccatcaccagctgggtgagccccgacttcgacaccgccgccggcagcctgttccccgcctaccagaagcaccagaacagagccagacacagcagcagaaagcccaccaccagcaagttcccccacctgaccttcgagagcccccagagcagcagcagcgagaccctgggcatccccctgatcagagagtgccccagcgagagcgagaaggacgtgagcagaagacccctggtgcccgtgctgtag

SEQ ID NO: 7776 - DNA, 318 bp, Artificial Sequence
  Description of Artificial Sequence: Synthetic coding sequence
atgccccccagaaagaagagaagacagcccagccagaaggcccccctgctgttccaccagcagcccctggagggccccaagcacagctgcgccagcacccagctgcccatcacccacaccagacaggtgcccagcaagcccatcgaccacagcaccatcaccagctgggtgagccccgacttcgacaccgccgccggcagcctgttccccgcctaccagaagcaccagaacagagccagacacagcagcagaaagcccaccaccagcaagttcccccacctgaccttcgagagcccccagagcagcagcagcgagtag

SEQ ID NO: 7777 - DNA, 3138 bp, Artificial Sequence
  Description of Artificial Sequence: Synthetic coding sequence
atgaacctgcaggcccagcccaaggcccagaacaagagaaagagatgcctgttcggcggccaggagcccgcccccaaggagcagcccccccccctgcagcccccccagcagagcatcagagtgaaggaggagcagtacctgggccacgagggccccggcggcgccgtgagcaccagccagcccgtggagctgcccccccccagcagcctggccctgctgaacagcgtggtgtacggccccgagagaaccagcgccgccatgctgagccagcaggtggccagcgtgaagtggcccaacagcgtgatggcccccggcagaggccccgagagaggcggcggcggcggcgtgagcgacagcagctggcagcagcagcccggccagccccccccccacagcacctggaactgccacagcctgagcctgtacagcgccaccaagggcagcccccaccccggcgtgggcgtgcccacctactacaaccaccccgaggccctgaagagagagaaggccggcggcccccagctggacagatacgtgagacccatgatgccccagaaggtgcagctggaggtgggcagaccccaggcccccctgaacagcttccacgccgccaagaagccccccaaccagagcctgcccctgcagcccttccagctggccttcggccaccaggtgaacagacaggtgttcagacagggcccccccccccccaaccccgtggccgccttccccccccagaagcagcagcagcagcagcagccccagcagcagcagcagcagcagcaggccgccctgccccagatgcccctgttcgagaacttctacagcatgccccagcagcccagccagcagccccaggacttcggcctgcagcccgccggccccctgggccagagccacctggcccaccacagcatggccccctaccccttcccccccaaccccgacatgaaccccgagctgagaaaggccctgctgcaggacagcgccccccagcccgccctgccccaggtgcagatccccttccccagaagaagcagaagactgagcaaggagggcatcctgccccccagcgccctggacggcgccggcacccagcccggccaggaggccaccggcaacctgttcctgcaccactggcccctgcagcagcccccccccggcagcctgggccagccccaccccgaggccctgggcttccccctggagctgagagagagccagctgctgcccgacggcgagagactggcccccaacggcagagagagagaggcccccgccatgggcagcgaggagggcatgagagccgtgagcaccggcgactgcggccaggtgctgagaggcggcgtgatccagagcaccagaagaagaagaagagccagccaggaggccaacctgctgaccctggcccagaaggccgtggagctggccagcctgcagaacgccaaggacggcagcggcagcgaggagaagagaaagagcgtgctggccagcaccaccaagtgcggcgtggagttcagcgagcccagcctggccaccaagagagccagagaggacagcggcatggtgcccctgatcatccccgtgagcgtgcccgtgagaaccgtggaccccaccgaggccgcccaggccggcggcctggacgaggacggcaagggccccgagcagaaccccgccgagcacaagcccagcgtgatcgtgaccagaagaagaagcaccagaatccccggcaccgacgcccaggcccaggccgaggacatgaacgtgaagctggagggcgagcccagcgtgagaaagcccaagcagagacccagacccgagcccctgatcatccccaccaaggccggcaccttcatcgccccccccgtgtacagcaacatcaccccctaccagagccacctgagaagccccgtgagactggccgaccaccccagcgagagaagcttcgagctgcccccctacacccccccccccatcctgagccccgtgagagagggcagcggcctgtacttcaacgccatcatcagcaccagcaccatccccgcccccccccccatcacccccaagagcgcccacagaaccctgctgagaaccaacagcgccgaggtgaccccccccgtgctgagcgtgatgggcgaggccacccccgtgagcatcgagcccagaatcaacgtgggcagcagattccaggccgagatccccctgatgagagacagagccctggccgccgccgacccccacaaggccgacctggtgtggcagccctgggaggacctggagagcagcagagagaagcagagacaggtggaggacctgctgaccgccgcctgcagcagcatcttccccggcgccggcaccaaccaggagctggccctgcactgcctgcacgagagcagaggcgacatcctggagaccctgaacaagctgctgctgaagaagcccctgagaccccacaaccaccccctggccacctaccactacaccggcagcgaccagtggaagatggccgagagaaagctgttcaacaagggcatcgccatctacaagaaggacttcttcctggtgcagaagctgatccagaccaagaccgtggcccagtgcgtggagttctactacacctacaagaagcaggtgaagatcggcagaaacggcaccctgaccttcggcgacgtggacaccagcgacgagaagagcgcccaggaggaggtggaggtggacatcaagaccagccagaagttccccagagtgcccctgcccagaagagagagccccagcgaggagagactggagcccaagagagaggtgaaggagcccagaaaggagggcgaggaggaggtgcccgagatccaggagaaggaggagcaggaggagggcagagagagaagcagaagagccgccgccgtgaaggccacccagaccctgcaggccaacgagagcgccagcgacatcctgatcctgagaagccacgagagcaacgcccccggcagcgccggcggccaggccagcgagaagcccagagagggcaccggcaagagcagaagagccctgcccttcagcgagaagaagaagaagaccgagaccttcagcaagacccagaaccaggagaacaccttcccctgcaagaagtgcggcagatag

SEQ ID NO: 7778 - DNA, 3138 bp, Artificial Sequence; identical to SEQ ID NO: 7777
  Description of Artificial Sequence: Synthetic coding sequence

SEQ ID NO: 7779 - DNA, 201 bp, Artificial Sequence
  Description of Artificial Sequence: Synthetic coding sequence
atgaacctgcaggcccagcccaaggcccagaacaagagaaagagatgcctgttcggcggccaggagcccgcccccaaggagcagcccccccccctgcagcccccccagcagagcatcagagtgaaggaggagcagtacctgggccacgagggccccggcggcgccgtgagcaccagccagcccgtggagctgcccccctag

SEQ ID NO: 7780 - DNA, 3138 bp, Artificial Sequence; identical to SEQ ID NO: 7777
  Description of Artificial Sequence: Synthetic coding sequence

SEQ ID NO: 7781 - DNA, 3060 bp, Artificial Sequence
  Description of Artificial Sequence: Synthetic coding sequence
atgaacctgcaggcccagcccaaggcccagaacaagagaaagagatgcctgttcggcggccaggagcccgcccccaaggagcagcccccccccctgcagcccccccagcagagcatcagagtgaaggaggagcagtacctgggccacgagggccccggcggcgccgtgagcaccagccagcccgtggagctgcccccccccagcagcctggccctgctgaacagcgtggtgtacggccccgagagaaccagcgccgccatgctgagccagcaggtggccagcgtgaagtggcccaacagcgtgatggcccccggcagaggccccgagagaggcggcggcggcggcgtgagcgacagcagctggcagcagcagcccggccagccccccccccacagcacctggaactgccacagcctgagcctgtacagcgccaccaagggcagcccccaccccggcgtgggcgtgcccacctactacaaccaccccgaggccctgaagagagagaaggccggcggcccccagctggacagatacgtgagacccatgatgccccagaaggtgcagctggaggtgggcagaccccaggcccccctgaacagcttccacgccgccaagaagccccccaaccagagcctgcccctgcagcccttccagctggccttcggccaccaggtgaacagacaggtgttcagacagggcccccccccccccaaccccgtggccgccttccccccccagaagcagcagcagcagcagcagccccagcagcagcagcagcagcagcaggccgccctgccccagatgcccctgttcgagaacttctacagcatgccccagcagcccagccagcagccccaggacttcggcctgcagcccgccggccccctgggccagagccacctggcccaccacagcatggccccctaccccttcccccccaaccccgacatgaaccccgagctgagaaaggccctgctgcaggacagcgccccccagcccgccctgccccaggtgcagatccccttccccagaagaagcagaagactgagcaaggagggcatcctgccccccagcgccctggacggcgccggcacccagcccggccaggaggccaccggcaacctgttcctgcaccactggcccctgcagcagcccccccccggcagcctgggccagccccaccccgaggccctgggcttccccctggagctgagagagagccagctgctgcccgacggcgagagactggcccccaacggcagagagagagaggcccccgccatgggcagcgaggagggcatgagagccgtgagcaccggcgactgcggccaggtgctgagaggcggcgtgatccagagcaccagaagaagaagaagagccagccaggaggccaacctgctgaccctggcccagaaggccgtggagctggccagcctgcagaacgccaaggacggcagcggcagcgaggagaagagaaagagcgtgctggccagcaccaccaagtgcggcgtggagttcagcgagcccagcctggccaccaagagagccagagaggacagcggcatggtgcccctgatcatccccgtgagcgtgcccgtgagaaccgtggaccccaccgaggccgcccaggccggcggcctggacgaggacggcaagggccccgagcagaaccccgccgagcacaagcccagcgtgatcgtgaccagaagaagaagcaccagaatccccggcaccgacgcccaggcccaggccgaggacatgaacgtgaagctggagggcgagcccagcgtgagaaagcccaagcagagacccagacccgagcccctgatcatccccaccaaggccggcaccttcatcgccccccccgtgtacagcaacatcaccccctaccagagccacctgagaagccccgtgagactggccgaccaccccagcgagagaagcttcgagctgcccccctacacccccccccccatcctgagccccgtgagagagggcagcggcctgtacttcaacgccatcatcagcaccagcaccatccccgcccccccccccatcacccccaagagcgcccacagaaccctgctgagaaccaacagcgccgaggtgaccccccccgtgctgagcgtgatgggcgaggccacccccgtgagcatcgagcccagaatcaacgtgggcagcagattccaggccgagatccccctgatgagagacagagccctggccgccgccgacccccacaaggccgacctggtgtggcagccctgggaggacctggagagcagcagagagaagcagagacaggtggaggacctgctgaccgccgcctgcagcagcatcttccccggcgccggcaccaaccaggagctggccctgcactgcctgcacgagagcagaggcgacatcctggagaccctgaacaagctgctgctgaagaagcccctgagaccccacaaccaccccctggccacctaccactacaccggcagcgaccagtggaagatggccgagagaaagctgttcaacaagggcatcgccatctacaagaaggacttcttcctggtgcagaagctgatccagaccaagaccgtggcccagtgcgtggagttctactacacctacaagaagcaggtgaagatcggcagaaacggcaccctgaccttcggcgacgtggacaccagcgacgagaagagcgcccaggaggaggtggaggtggacatcaagaccagccagaagttccccagagtgcccctgcccagaagagagagccccagcgaggagagactggagcccaagagagaggtgaaggagcccagaaaggagggcgaggaggaggtgcccgagatccaggagaaggaggagcaggaggagggcagagagagaagcagaagagccgccgccgtgaaggccacccagaccctgcaggccaacgagagcgccagcgacatcctgatcctgagaagccacgagagcaacgcccccggcagcgccggcggccaggccagcgagaagcccagagagggcaccggcaagagcagaagagccctgcccttcagctag

SEQ ID NO: 7782 - DNA, 951 bp, Artificial Sequence
  Description of Artificial Sequence: Synthetic coding sequence
atggccgcccccgaggccccccccctggacagagtgttcagaaccacctggctgagcaccgagtgcgacagccaccccctgccccccagctacagaaagttcctgttcgagacccaggccgccgacctggccggcggcaccaccgtggccgccggcaacctgctgaacgagagcgagaaggactgcggccaggacagaagagcccccggcgtgcagccctgcagactggtgaccatgaccagcgtggtgaagaccgtgtacagcctgcagccccccagcgccctgagcggcggccagcccgccgacacccagaccagagccaccagcaagagcctgctgcccgtgagaagcaaggaggtggacgtgagcaagcagctgcacagcggcggccccgagaacgacgtgaccaagatcaccaagctgagaagagagaacggccagatgaaggccaccgacaccgccaccagaagaaacgtgagaaagggctacaagcccctgagcaagcagaagagcgaggaggagctgaaggacaagaaccagctgctggaggccgtgaacaagcagctgcaccagaagctgaccgagacccagggcgagctgaaggacctgacccagaaggtggagctgctggagaagttcagagacaactgcctggccatcctggagagcaagggcctggaccccgccctgggcagcgagaccctggccagcagacaggagagcaccaccgaccacatggacagcatgctgctgctggagaccctgcaggaggagctgaagctgttcaacgagaccgccaagaagcagatggaggagctgcaggccctgaaggtgaagctggagatgaaggaggagagagtgagattcctggagcagcagaccctgtgcaacaaccaggtgaacgacctgaccaccgccctgaaggagatggagcagctgctggagatgtag

SEQ ID NO: 7783 - DNA, 861 bp, Artificial Sequence
  Description of Artificial Sequence: Synthetic coding sequence
atggccgcccccgaggccccccccctggacagagtgttcagaaccacctggctgagcaccgagtgcgacagccaccccctgccccccagctacagaaagttcctgttcgagacccaggccgccgacctggccggcggcaccaccgtggccgccggcaacctgctgaacgagagcgagaaggactgcggccaggacagaagagcccccggcgtgcagccctgcagactggtgaccatgaccagcgtggtgaagaccgtgtacagcctgcagccccccagcgccctgagcggcggccagcccgccgacacccagaccagagccaccagcaagagcctgctgcccgtgagaagcaaggaggtggacgtgagcaagcagctgcacagcggcggccccgagaacgacgtgaccaagatcaccaagctgagaagagagaacggccagatgaaggccaccgacaccgccaccagaagaaacgtgagaaagggctacaagcccctgagcaagcagaagagcgaggaggagctgaaggacaagaaccagctgctggaggccgtgaacaagcagctgcaccagaagctgaccgagacccagggcgagctgaaggacctgacccagaaggtggagctgctggagaagttcagagacaactgcctggccatcctggagagcaagggcctggaccccgccctgggcagcgagaccctggccagcagacaggagagcaccaccgaccacatggacagcatgctgctgctggagaccctgcaggaggagctgaagctgttcaacgagaccgccaagaagcagatggaggagctgcagatcgcctggatgaaccacggcatcctgcaccagatgtag

SEQ ID NO: 7784 - DNA, 726 bp, Artificial Sequence
  Description of Artificial Sequence: Synthetic coding sequence
atggccgcccccgaggccccccccctggacagagtgttcagaaccacctggctgagcaccgagtgcgacagccaccccctgccccccagctacagaaagttcctgttcgagacccaggccgccgacctggccggcggcaccaccgtggccgccggcaacctgctgaacgagagcgagaaggactgcggccaggacagaagagcccccggcgtgcagccctgcagactggtgaccatgaccagcgtggtgaagaccgtgtacagcctgcagccccccagcgccctgagcggcggccagcccgccgacacccagaccagagccaccagcaagagcctgctgcccgtgagaagcaaggaggtggacgtgagcaagcagctgcacagcggcggccccgagaacgacgtgaccaagatcaccaagctgagaagagagaacggccagatgaaggccaccgacaccgccaccagaagaaacgtgagaaagggctacaagcccctgagcaagcagaagagcgaggaggagctgaaggacaagaaccagctgctggaggccgtgaacaagcagctgcaccagaagctgaccgagacccagggcgagctgaaggacctgacccagaaggtggagctgctggagaagttcagagacaactgcctggccatcctggagagcaagggcctggaccccgtggccgtgagaaacttcgccagaggcgccgaggccttctag

SEQ ID NO: 7785 - DNA, 915 bp, Artificial Sequence
  Description of Artificial Sequence: Synthetic coding sequence
atggccagcgagacccacaacgtgaagaagagaaacttctgcaacaagatcgaggaccacttcatcgacctgcccagaaagaagatcagcaacttcaccaacaagaacatgaaggaggtgaagaagagccccaagcagctggccgcctacatcaacagaaccgtgggccagaccgtgaagagccccgacaagctgagaaaggtgatctacagaagaaagaaggtgcaccaccccttccccaacccctgctacagaaagaagcagagccccggcagcggcggctgcgacatggccaacaaggagaacgagctggcctgcgccggccacctgcccgagaagctgcaccacgacagcagaacctacctggtgaacagcagcgacagcggcagcagccagaccgagagccccagcagcaagtacagcggcttcttcagcgaggtgagccaggaccacgagaccatggcccaggtgctgttcagcagaaacatgagactgaacgtggccctgaccttctggagaaagagaagcatcagcgagctggtggcctacctgctgagaatcgaggacctgggcgtggtggtggactgcctgcccgtgctgaccaactgcctgcaggaggagaagcagtacatcagcctgggctgctgcgtggacctgctgcccctggtgaagagcctgctgaagagcaagttcgaggagtacgtgatcgtgggcctgaactggctgcaggccgtgatcaagagatggtggagcgagctgagcagcaagaccgagatcatcaacgacggcaacatccagatcctgaagcagcagctgagcggcctgtgggagcaggagaaccacctgaccctggtgcccggctacaccggcaacatcgccaaggacgtggacgcctacctgctgcagctgcactag

SEQ ID NO: 7786 - DNA, 537 bp, Artificial Sequence
  Description of Artificial Sequence: Synthetic coding sequence
atggccagcgagacccacaacgtgaagaagagaaacttctgcaacaagatcgaggaccacttcatcgacctgcccagaaagaagatcagcaacttcaccaacaagaacatgaaggaggtgaagaagagccccaagcagctggccgcctacatcaacagaaccgtgggccagaccgtgaagagccccgacaagctgagaaaggtgatctacagaagaaagaaggtgcaccaccccttccccaacccctgctacagaaagaagcagagccccggcagcggcggctgcgacatggccaacaaggagaacgagctggcctgcgccggccacctgcccgagaagctgcaccacgacagcagaacctacctggtgaacagcagcgacagcggcagcagccagaccgagagccccagcagcaagtacagcggcttcttcagcgaggtgagccaggaccacgagaccatggcccaggtgctgttcagcagaaacatgagactgaacgtggccctgaccttctggagaaagagaagcatcagctag

SEQ ID NO: 7787 - DNA, 120 bp, Artificial Sequence
  Description of Artificial Sequence: Synthetic coding sequence
atggccagcgagacccacaacgtgaagaagagaaacttctgcaacaagatcgaggaccacttcatcgacctgcccagaaagaagatcagcaacttcaccaacaagaacatgaaggagtag

SEQ ID NO: 7788 - DNA, 225 bp, Artificial Sequence
  Description of Artificial Sequence: Synthetic coding sequence
atggccagcgagacccacaacgtgaagaagagaaacttctgcaacaagatcgaggaccacttcatcgacctgcccagaaagaagatcagcaacttcaccaacaagaacatgaaggaggtgaagaagagccccaagcagctggccgcctacatcaacagaaccgtgggccagaccgtgaagagccccgacaagctgagaaaggtgatctacagaagaaagaagtag

SEQ ID NO: 7789 - DNA, 534 bp, Artificial Sequence
  Description of Artificial Sequence: Synthetic coding sequence
atggccagcgagacccacaacgtgaagaagagaaacttctgcaacaagatcgaggaccacttcatcgacctgcccagaaagaagatcagcaacttcaccaacaagaacatgaaggaggtgaagaagagccccaagcagctggccgcctacatcaacagaaccgtgggccagaccgtgaagagccccgacaagctgagaaaggtgatctacagaagaaagaaggtgcaccaccccttccccaacccctgctacagaaagaagcagagccccggcagcggcggctgcgacatggccaacaaggagaacgagctggcctgcgccggccacctgcccgagaagctgcaccacgacagcagaacctacctggtgaacagcagcgacagcggcagcagccagaccgagagccccagcagcaagtacagcggcttcttcagcgaggtgagccaggaccacgagaccatggcccaggtgctgttcagcagaaacatgagactgaacgtggccctgaccttctggagaaagagaagcatctag

SEQ ID NO: 7790 - DNA, 1887 bp, Artificial Sequence
  Description of Artificial Sequence: Synthetic coding sequence
atgctgctggccagaatgaacccccaggtgcagcccgagaacaacggcgccgacaccggccccgagcagcccctgagagccagaaagaccgccgagctgctggtggtgaaggagagaaacggcgtgcagtgcctgctggcccccagagacggcgacgcccagcccagagagacctggggcaagaagatcgacttcctgctgagcgtggtgggcttcgccgtggacctggccaacgtgtggagattcccctacctgtgctacaagaacggcggcggcgccttcctgatcccctacaccctgttcctgatcatcgccggcatgcccctgttctacatggagctggccctgggccagtacaacagagagggcgccgccaccgtgtggaagatctgccccttcttcaagggcgtgggctacgccgtgatcctgatcgccctgtacgtgggcttctactacaacgtgatcatcgcctggagcctgtactacctgttcagcagcttcaccctgaacctgccctggaccgactgcggccacacctggaacagccccaactgcaccgaccccaagctgctgaacggcagcgtgctgggcaaccacaccaagtacagcaagtacaagttcacccccgccgccgagttctacgagagaggcgtgctgcacctgcacgagagcagcggcatccacgacatcggcctgccccagtggcagctgctgctgtgcctgatggtggtggtgatcgtgctgtacttcagcctgtggaagggcgtgaagaccagcggcaaggtggtgtggatcaccgccaccctgccctacttcgtgctgttcgtgctgctggtgcacggcgtgaccctgcccggcgccagcaacggcatcaacgcctacctgcacatcgacttctacagactgaaggaggccaccgtgtggatcgacgccgccacccagatcttcttcagcctgggcgccggcttcggcgtgctgatcgccttcgccagctacaacaagttcgacaacaactgctacagagacgccctgctgaccagcagcatcaactgcatcaccagcttcgtgagcggcttcgccatcttcagcatcctgggctacatggcccacgagcacaaggtgaacatcgaggacgtggccaccgagggcgccggcctggtgttcatcctgtaccccgaggccatcagcaccctgagcggcagcaccttctgggccgtggtgttcttcgtgatgctgctggccctgggcctggacagcagcatgggcggcatggaggccgtgatcaccggcctggccgacgacttccaggtgctgaagagacacagaaagctgttcaccttcggcgtgaccttcagcaccttcctgctggccctgttctgcatcaccaagggcggcatctacgtgctgaccctgctggacaccttcgccgccggcaccagcatcctgttcgccgtgctgatggaggccatcggcgtgagctggttctacggcgtggacagattcagcaacgacatccagcagatgatgggcttcagacccggcctgtactggagactgtgctggaagttcgtgagccccgccttcctgctgttcgtggtggtggtgagcatcatcaacttcaagcccctgacctacgacgactacatcttccccccctgggccaactgggtgggctggggcatcgccctgagcagcatggtgctggtgcccatctacgtgatctacaagttcctgagcacccagggcagcctgtgggagagactggcctacggcatcacccccgagaacgagcaccacctggtggcccagagagacatcagacagttccagatgaagaccagacagggcagaagaagagccaccaacagctgccagatcagctgctag

SEQ ID NO: 7791 - DNA, 519 bp, Artificial Sequence; identical to SEQ ID NO: 7731
  Description of Artificial Sequence: Synthetic coding sequence

SEQ ID NO: 7792 - DNA, 417 bp, Artificial Sequence; identical to SEQ ID NO: 7733
  Description of Artificial Sequence: Synthetic coding sequence

SEQ ID NO: 7793 - DNA, 555 bp, Artificial Sequence
  Description of Artificial Sequence: Synthetic coding sequence
atggacctgcaggccgccggcgcccaggcccagggcgccgccgagcccagcagaggcccccccctgcccagcgccagaggcgccccccccagccccgaggccggcttcgccaccgccgaccacagcagccaggagagagagaccgagaaggccatggacagactggccagaggcacccagagcatccccaacgacagccccgccagaggcgagggcacccacagcgaggaggagggcttcgccatggacgaggaggacagcgacggcgagctgaacacctgggagctgagcgagggcaccaactgcccccccaaggagcagcccggcgacctgttcaacgaggactgggacagcgagctgaaggccgaccagggcaacccctacgacgccgacgacatccaggagagcatcagccaggagctgaagccctgggtgtgctgcgccccccagggcgacatgatctacgaccccagctggcaccaccccccccccctgatcccctactacagcaagatggtgttcgagaccggccagttcgacgacgccgaggactag

SEQ ID NO: 7794 - DNA, 519 bp, Artificial Sequence
  Description of Artificial Sequence: Synthetic coding sequence
atgggcggcgacgccggcgacagagagcccggccccgccgccagaagcctgggcgagggccaggccggcttcgccaccgccgaccacagcagccaggagagagagaccgagaaggccatggacagactggccagaggcacccagagcatccccaacgacagccccgccagaggcgagggcacccacagcgaggaggagggcttcgccatggacgaggaggacagcgacggcgagctgaacacctgggagctgagcgagggcaccaactgcccccccaaggagcagcccggcgacctgttcaacgaggactgggacagcgagctgaaggccgaccagggcaacccctacgacgccgacgacatccaggagagcatcagccaggagctgaagccctgggtgtgctgcgccccccagggcgacatgatctacgaccccagctggcaccaccccccccccctgatcccctactacagcaagatggtgttcgagaccggccagttcgacgacgccgaggactag

SEQ ID NO: 7795 - DNA, 1956 bp, Artificial Sequence
  Description of Artificial Sequence: Synthetic coding sequence
atgggccccgccagccccgccgccagaggcctgagcagaagacccggccagccccccctgcccctgctgctgcccctgctgctgctgctgctgagagcccagcccgccatcggcagcctggccggcggcagccccggcgccgccgaggcccccggcagcgcccaggtggccggcctgtgcggcagactgaccctgcacagagacctgagaaccggcagatgggagcccgacccccagagaagcagaagatgcctgagagacccccagagagtgctggagtactgcagacagatgtaccccgagctgcagatcgccagagtggagcaggccacccaggccatccccatggagagatggtgcggcggcagcagaagcggcagctgcgcccacccccaccaccaggtggtgcccttcagatgcctgcccggcgagttcgtgagcgaggccctgctggtgcccgagggctgcagattcctgcaccaggagagaatggaccagtgcgagagcagcaccagaagacaccaggaggcccaggaggcctgcagcagccagggcctgatcctgcacggcagcggcatgctgctgccctgcggcagcgacagattcagaggcgtggagtacgtgtgctgccccccccccggcacccccgaccccagcggcaccgccgtgggcgaccccagcaccagaagctggccccccggcagcagagtggagggcgccgaggacgaggaggaggaggagagcttcccccagcccgtggacgactacttcgtggagcccccccaggccgaggaggaggaggagaccgtgcccccccccagcagccacaccctggccgtggtgggcaaggtgacccccacccccagacccaccgacggcgtggacatctacttcggcatgcccggcgagatcagcgagcacgagggcttcctgagagccaagatggacctggaggagagaagaatgagacagatcaacgaggtgatgagagagtgggccatggccgacaaccagagcaagaacctgcccaaggccgacagacaggccctgaacgagcacttccagagcatcctgcagaccctggaggagcaggtgagcggcgagagacagagactggtggagacccacgccaccagagtgatcgccctgatcaacgaccagagaagagccgccctggagggcttcctggccgccctgcaggccgaccccccccaggccgagagagtgctgctggccctgagaagatacctgagagccgagcagaaggagcagagacacaccctgagacactaccagcacgtggccgccgtggaccccgagaaggcccagcagatgagattccaggtgcacacccacctgcaggtgatcgaggagagagtgaaccagagcctgggcctgctggaccagaacccccacctggcccaggagctgagaccccagatccaggagctgctgcacagcgagcacctgggccccagcgagctggaggcccccgcccccggcggcagcagcgaggacaagggcggcctgcagccccccgacagcaaggacgccgacacccccatgaccctgcccaagggcagcaccgagcaggacgccgccagccccgagaaggagaagatgaaccccctggagcagtacgagagaaaggtgaacgccagcgtgcccagaggcttccccttccacagcagcgagatccagagagacgagctggcccccgccggcaccggcgtgagcagagaggccgtgagcggcctgctgatcatgggcgccggcggcggcagcctgatcgtgctgagcatgctgctgctgagaagaaagaagccctacggcgccatcagccacggcgtggtggaggtggaccccatgctgaccctggaggagcagcagctgagagagctgcagagacacggctacgagaaccccacctacagattcctggaggagagaccctag

SEQ ID NO: 7796 - DNA, 2277 bp, Artificial Sequence
  Description of Artificial Sequence: Synthetic coding sequence
atgggcagagacaccagaagcagaagcagaagcgccggcagaagaggcagaagaagacagagccagagcggcagcagaagcagaagcagaagccacggcagaagaaacagaagaagaagagaggacgagggcagaagaagaagaagaagaagaagcagagagagaagaagcgacagcgaggaggagagatggcagagaagcggcatgagaagcagaagcccccccagacccaagtggcacagcagagacggcagcagccagagcgacagcggcgaggagcagagcagaggccagtgggccagaagaagaagaagagccagaagctggagccccagcagcagcgccagcagcagcgccagccccggcagaagccagagccccagagccgccgccgccgccctgagccagcagcagagcctgcaggagagactgagactgagagaggagagaaagcagcaggaggagctgatgaaggccttcgagacccccgaggagaagagagccagaagactggccaagaaggaggccaaggagagaaagaagagagagaagatgggctggggcgaggagtacatgggctacaccaacaccgacaaccccttcggcgacaacaacctgctgggcaccttcatctggaacaaggccctggagaagaagggcatcagccacctggaggagaaggagctgaaggagagaaacaagagaatccaggaggacaacagactggagctgcagaaggtgaagcagctgagactggagagagagagagagaaggccatgagagagcaggagctggagatgctgcagagagagaaggaggccgagcacttcaagacctgggaggagcaggaggacaacttccacctgcagcaggccaagctgagaagcaagatcagaatcagagacggcagagccaagcccatcgacctgctggccaagtacatcagcgccgaggacgacgacctggccgtggagatgcacgagccctacaccttcctgaacggcctgaccgtggccgacatggaggacctgctggaggacatccaggtgtacatggagctggagcagggcaagaacgccgacttctggagagacatgaccaccatcaccgaggacgagatcagcaagctgagaaagctggaggccagcggcaagggccccggcgagagaagagagggcgtgaacgccagcgtgagcagcgacgtgcagagcgtgttcaagggcaagacctacaaccagctgcaggtgatcttccagggcatcgagggcaagatcagagccggcggccccaacctggacatgggctactgggagagcctgctgcagcagctgagagcccacatggccagagccagactgagagagagacaccaggacgtgctgagacagaagctgtacaagctgaagcaggagcagggcgtggagagcgagcccctgttccccatcctgaagcaggagccccagagccccagcagaagcctggagcccgaggacgccgcccccaccccccccggccccagcagcgagggcggccccgccgaggccgaggtggacggcgccacccccaccgagggcgacggcgacggcgacggcgagggcgagggcgagggcgaggccgtgctgatggaggaggacctgatccagcagagcctggacgactacgacgccggcagatacagccccagactgctgaccgcccacgagctgcccctggacgcccacgtgctggagcccgacgaggacctgcagagactgcagctgagcagacagcagctgcaggtgaccggcgacgccagcgagagcgccgaggacatcttcttcagaagagccaaggagggcatgggccaggacgaggcccagttcagcgtggagatgcccctgaccggcaaggcctacctgtgggccgacaagtacagacccagaaagcccagattcttcaacagagtgcacaccggcttcgagtggaacaagtacaaccagacccactacgacttcgacaaccccccccccaagatcgtgcagggctacaagttcaacatcttctaccccgacctgatcgacaagagaagcacccccgagtacttcctggaggcctgcgccgacaacaaggacttcgccatcctgagattccacgccggccccccctacgaggacatcgccttcaagatcgtgaacagagagtgggagtacagccacagacacggcttcagatgccagttcgccaacggcatcttccagctgtggttccacttcaagagatacagatacagaagatag

SEQ ID NO: 7797 - DNA, 2277 bp, Artificial Sequence; identical to SEQ ID NO: 7796
  Description of Artificial Sequence: Synthetic coding sequence

SEQ ID NO: 7798 - DNA, 792 bp, Artificial Sequence
  Description of Artificial Sequence: Synthetic coding sequence
atgggcagagacaccagaagcagaagcagaagcgccggcagaagaggcagaagaagacagagccagagcggcagcagaagaggccccagccccttccccagaagcgtgcaccagcccagacacctgagaaccaacccctgcgcccagggcagctgggtgaaggccggcccccccgtgaagcagctgagactggagagagagagagagaaggccatgagagagcaggagctggagatgctgcagagagagaaggaggccgagcacttcaagacctgggaggagcaggaggacaacttccacctgcagcaggccaagctgagaagcaagatcagaatcagagacggcagagccaagcccatcgacctgctggccaagtacatcagcgccgaggacgacgacctggccgtggagatgcacgagccctacaccttcctgaacggcctgaccgtggccgacatggaggacctgctggaggacatccaggtgtacatggagctggagcagggcaagaacgccgacttctggagagacatgaccaccatcaccgaggacgagatcagcaagctgagaaagctggaggccagcggcaagggccccggcgagagaagagagggcgtgaacgccagcgtgagcagcgacgtgcagagcgtgttcaagggcaagacctacaaccagctgcaggtgatcttccagggcatcgagggcaagatcagagccggcggccccaacctggacatgggctactgggagagcctgctgcagcagctgagagcccacatggccagagcctag

SEQ ID NO: 7799 - DNA, 321 bp, Artificial Sequence
  Description of Artificial Sequence: Synthetic coding sequence
atggagttcgacctgggcgccgccctggagcccaccagccagaagcccggcgtgggcgccggccacggcggcgaccccaagctgagcccccacaaggtgcagggcagaagcgaggccggcgccggccccggccccaagcagggccaccacagcagcagcgacagcagcagcagcagcagcgacagcgacaccgacgtgaagagccacgccgccggcagcaagcagcacgagagcatccccggcaaggccaagaagcccaaggtgaagaagaaggagaagggcaagaaggagaagggcaagaagaaggaggccccccactag

SEQ ID NO: 7800 - DNA, 543 bp, Artificial Sequence
  Description of Artificial Sequence: Synthetic coding sequence
atggccggcgtgaagtaccccggccaggaccccgtggacctggacatctaccagagcagccacatggtggactaccagccctacagaaagcacaagtacagcagagtgaccccccaggagcaggccaagctggacgcccagctgagagacaaggagttctacagacccatccccaaccccaaccccaagctgaccgacggctaccccgccttcaagagaccccacatgaccgccaaggacctgggcctgcccggcttcttccccagccaggagcacgaggccaccagagaggacgagagaaagttcaccagcacctgccacttcacctaccccgccagccacgacctgcacctggcccagggcgaccccaaccaggtgctgcagagcgccgacttcccctgcctggtggaccccaagcaccagcccgccgccgagatggccaagggctacctgctgctgcccggctgcccctgcctgcactgccacatcgtgaaggtgcccatcctgaacagatggggccccctgatgcccttctaccagtag

SEQ ID NO: 7801 - DNA, 1041 bp, Artificial Sequence
  Description of Artificial Sequence: Synthetic coding sequence
atggtgggcggcggcggcaagagaagacccggcggcgagggcccccagtgcgagaagaccaccgacgtgaagaagagcaagttctgcgaggccgacgtgagcagcgacctgagaaaggaggtggagaaccactacaagctgagcctgcccgaggacttctaccacttctggaagttctgcgaggagctggaccccgagaagcccagcgacagcctgagcgccagcctgggcctgcagctggtgggcccctacgacatcctggccggcaagcacaagaccaagaagaagagcaccggcctgaacttcaacctgcactggagattctactacgacccccccgagttccagaccatcatcatcggcgacaacaagacccagtaccacatgggctacttcagagacagccccgacgagttccccgtgtacgtgggcatcaacgaggccaagaagaactgcatcatcgtgcccaacggcgacaacgtgttcgccgccgtgaagctgttcctgaccaagaagctgagagagatcaccgacaagaagaagatcaacctgctgaagaacatcgacgagaagctgaccgaggccgccagagagctgggctacagcctggagcagagaaccgtgaagatgaagcagagagacaagaaggtggtgaccaagaccttccacggcgccggcctggtggtgcccgtggacaagaacgacgtgggctacagagagctgcccgagaccgacgccgacctgaagagaatctgcaagaccatcgtggaggccgccagcgacgaggagagactgaaggccttcgcccccatccaggagatgatgaccttcgtgcagttcgccaacgacgagtgcgactacggcatgggcctggagctgggcatggacctgttctgctacggcagccactacttccacaaggtggccggccagctgctgcccctggcctacaacctgctgaagagaaacctgttcgccgagatcatcgaggagcacctggccaacagaagccaggagaacatcgaccagctggccgcctag

SEQ ID NO: 7802 - DNA, 780 bp, Artificial Sequence
  Description of Artificial Sequence: Synthetic coding sequence
atgagagacagaagaggccccctgggcacctgcctggcccaggtgcagcaggccggcggcggcgacagcgacaagctgagctgcagcctgaagaagagaatgcccgagggcccctggcccgccgacgcccccagctggatgaacaagcccgtggtggacggcaacagccagagcgaggccctgagcctggagatgagaaaggaccccagcggcgccggcctgtggctgcacagcggcggccccgtgctgccctacgtgagagagagcgtgagaagaaaccccgccagcgccgccacccccagcaccgccgtgggcctgttccccgcccccaccgagtgcttcgccagagtgagctgcagcggcgtggaggccctgggcagaagagactggctgggcggcggccccagagccaccgacggccacagaggccagtgccccaagggcgagcccagagtgagcagactgcccagacaccagaaggtgcccgagatgggcagcttccaggacgacccccccagcgccttccccaagggcctgggcagcgagctggagcccgcctgcctgcacagcatcctgagcgccaccctgcacgtgtaccccgaggtgctgctgagcgaggagaccaagagaatcttcctggacagactgaagcccatgttcagcaagcagaccatcgagttcaagaagatgctgaagagcaccagcgacggcctgcagatcaccctgggcctgctggccctgcagcccttcgagctggccaacaccctgtgccacagctag

SEQ ID NO: 7803 - DNA, 363 bp, Artificial Sequence
  Description of Artificial Sequence: Synthetic coding sequence
atgagagacagaagaggccccctgggcacctgcctggcccaggtgcagcaggccggcggcggcgacagcgacaagctgagctgcagcctgaagaagagaatgcccgagggcccctggcccgccgacgcccccagctggatgaacaagcccgtggtggacggcaacagccagagcgaggccctgagcctggagatgagaaaggaccccagcggcgccggcctgtggctgcacagcggcggccccgtgctgccctacgtgagagagagcgtgagaagaaaccccgccagcgccgccacccccagcaccgccgtgggcctgttccccgcccccaccgagtgcttcgccagagtgagctgcagctag

SEQ ID NO: 7804 - DNA, 330 bp, Artificial Sequence
  Description of Artificial Sequence: Synthetic coding sequence
atgagagacagaagaggccccctgggcacctgcctggcccaggtgcagcaggccggcggcggcgacagcgacaagctgagctgcagcctgaagaagagaatgcccgagggcccctggcccgccgacgcccccagctggatgaacaagcccgtggtggacggcaacagccagagcgaggccctgagcctggagatgagaaaggaccccagcggcgccggcctgtggctgcacagcggcggccccgtgctgccctacgtgagagagagcgtgagaagaaaccccgccagcgccgccacccccagcaccgccgtgggcctgttccccgcctag

SEQ ID NO: 7805 - DNA, 2391 bp, Artificial Sequence
  Description of Artificial Sequence: Synthetic coding sequence
atggccgagaccaaggacgtgttcggccaggagccccaccccgtggaggacgacctgtacaaggagagaaccagaaagagaagaaagagcgacagagaccagagattcagagccttccccagcatggagcagagcgccctgaaggagtacgagaagctggagagcagaaccagaagagtgctgagcaacacctaccagaagctgatccagagcgtgttcctggacgacagcatccccaacggcgtgaagtacctgatcaacagactgctggccctgatcgagaagcccaccgtggaccccatctacatcgccctgttcggcagcaccggcgccggcaagagcagcctgatcaacgccatcatccagcaggccatgttcctgcccgtgagcggcgagagcatctgcaccagctgcatcgtgcaggtgagcagcggctgctgcgtgcagtacgaggccaagatccacctgctgagcgaccaggagtggagagaggagctgaagaacctgaccaagctgctgcacagaaccgaggagctgagcagagaggaggccgacgcctggaacagagacgaggccgtggaggaggccacctggaagctgcagatgatctacggcaacggcgccgagagcaagaactacgaggagctgctgagagccaagcccaagagaaagatccccaccagcagagtgatcaccctgaaggccgaggaggccgaggagctgagcatcaagctggacccctacatcagaacccagagaagagactgggacggcgaggccgccgagatgagaatctggcccctgatcaagcacgtggaggtgaccctgcccaagagcgacctgatccccgagggcgtggtgctggtggacatccccggcaccggcgacttcaacagcaagagagacgagatgtggaagaagaccatcgacaagtgcagcgtgatctgggtgatcagcgacatcgagagagtgagcggcggccaggcccacgaggacctgctgaacgagagcatcaaggcctgccagagaggcttctgcagagacgtggccctggtggtgaccaagatggacaagctgcacctgcccgagtacctgagagaggagagaaagggctggcaggccatccagagccagagagaggccgtgctggagagaaacgagatgatcaagctgcagagaaccagaatcctgaaggagaagctgaagagaaagctgcccgccgacttcaaggtgctggaggccagcgacctggtgtacaccgtgagcgcccaggagtactggcagcaggccctgctgaccgaggaggagaccgagatccccaagctgagagagtacatcagaaagagcctgctggacaagaagaagagaaccgtgaccaagtacgtgaccgaggccttcggcctgctgctgctgaccgacagcttcaacagcacccagaacctgcccaacgagcacctgcacatgagcgtgctgagaagattcgccgaggagaaggtggagctgctggagaaggccatcgcccagtgcttcgcctgcatggagcagcccctgcaggagggcgtgagaaccgccagaaccagctacagatgcatcctgagagcctgcctggtgagaagcaagggcaaccagggcttccaccagaccctgaaggccgtgtgcctgaagaacggcatctacgccagcagaaccctggccagaatcgacctgaacgaggccctgacccagcccgtgtacgaccagatcgaccccgtgttcggcagcatcttcagaaccggcaagcccaccggcagcgccctgatgccccacatcgacgccttcaagcagagcctgcaggagaagatgaccgagatcggcatcagaagcggctggaagtacgacagctgcaagaagaacttcctgatccaggagatcagcgccatcctgggcggcctggaggaccacatcctgagaagaaagagaagaatctacgagagcctgaccgccagcgtgcagagcgacctgaagctgtgctacgaggaggccgcccagatcaccggcaagaaggcctgcgagagaatgaaggacgccatcagaagaggcgtggacagacaggtggccgagggcatgttcgagagagcccaggagagaatgcagcaccagttccagcagctgaagaccggcatcgtggagaaggtgaagggcagcatcaccaccatgctggccctggccagcagccagggcgacggcctgtacaaggagctggccgacgtgggcagcgagtacaaggagatggagaagctgcacagaagcctgagagaggtggccgagaacgccagactgagaaagggcatgcaggagttcctgctgagagccagccccagcaaggccggcccccccggcaccagcctgtag

SEQ ID NO: 7806 - DNA, 2391 bp, Artificial Sequence
  Description of Artificial Sequence: Synthetic coding sequence
atggccgagaccaaggacgtgttcggccaggagccccaccccgtggaggacgacctgtacaaggagagaaccagaaagagaagaaagagcgacagagaccagagattcagagccttccccagcatggagcagagcgccctgaaggagtacgagaagctggagagcagaaccagaagagtgctgagcaacacctaccagaagctgatccagagcgtgttcctggacgacagcatccccaacggcgtgaagtacctgatcaacagactgctggccctgatcgagaagcccaccgtggaccccatctacatcgccctgttcggcagcaccggcgccggcaagagcagcctgatcaacgccatcatccagcaggccatgttcctgcccgtgagcggcgagagcatctgcaccagctgcatcgtgcaggtgagcagcggctgctgcgtgcagtacgaggccaagatccacctgctgagcgaccaggagtggagagaggagctgaagaacctgaccaagctgctgcacagaaccgaggagctgagcagagaggaggccgacgcctggaacagagacgaggccgtggaggaggccacctggaagctgcagatgatctacggcaacggcgccgagagcaagaactacgaggagctgctgagagccaagcccaagagaaagatccccaccagcagagtgatcaccctgaaggccgaggaggccgaggagctgagcatcaagctggacccctacatcagaacccagagaagagactgggacggcgaggccgccgagatgagaatctggcccctgatcaagcacgtggaggtgaccctgcccaagagcgacctgatccccgagggcgtggtgctggtggacatccccggcaccggcgacttcaacagcaagagagacgagatgtggaagaagaccatcgacaagtgcagcgtgatctgggtgatcagcgacatcgagagagtgagcggcggccaggcccacgaggacctgctgaacgagagcatcaaggcctgccagagaggcttctgcagagacgtggccctggtggtgaccaagatggacaagctgcacctgcccgagtacctgagagagagaaaggccggcaaccaggccatccagagccagagagaggccgtgctggagagaaacgagatgatcaagctgcagagaaccagaatcctgaaggagaagctgaagagaaagctgcccgccgacttcaaggtgctggaggccagcgacctggtgtacaccgtgagcgcccaggagtactggcagcaggccctgctgaccgaggaggagaccgagatccccaagctgagagagtacatcagaaagagcctgctggacaagaagaagagaaccgtgaccaagtacgtgaccgaggccttcggcctgctgctgctgaccgacagcttcaacagcacccagaacctgcccaacgagcacctgcacatgagcgtgctgagaagattcgccgaggagaaggtggagctgctggagaaggccatcgcccagtgcttcgcctgcatggagcagcccctgcaggagggcgtgagaaccgccagaaccagctacagatgcatcctgagagcctgcctggtgagaagcaagggcaaccagggcttccaccagaccctgaaggccgtgtgcctgaagaacggcatctacgccagcagaaccctggccagaatcgacctgaacgaggccctgacccagcccgtgtacgaccagatcgaccccgtgttcggcagcatcttcagaaccggcaagcccaccggcagcgccctgatgccccacatcgacgccttcaagcagagcctgcaggagaagatgaccgagatcggcatcagaagcggctggaagtacgacagctgcaagaagaacttcctgatccaggagatcagcgccatcctgggcggcctggaggaccacatcctgagaagaaagagaagaatctacgagagcctgaccgccagcgtgcagagcgacctgaagctgtgctacgaggaggccgcccagatcaccggcaagaaggcctgcgagagaatgaaggacgccatcagaagaggcgtggacagacaggtggccgagggcatgttcgagagagcccaggagagaatgcagcaccagttccagcagctgaagaccggcatcgtggagaaggtgaagggcagcatcaccaccatgctggccctggccagcagccagggcgacggcctgtacaaggagctggccgacgtgggcagcgagtacaaggagatggagaagctgcacagaagcctgagagaggtggccgagaacgccagactgagaaagggcatgcaggagttcctgctgagagccagccccagcaaggccggcccccccggcaccagcctgtag

SEQ ID NO: 7807 - DNA, 3999 bp, Artificial Sequence
  Description of Artificial Sequence: Synthetic coding sequence
atgaccggcgaggtgggcagcgaggtgcacctggagatcaacgaccccaacgtgatcagccaggaggaggccgacagccccagcgacagcggccagggcagctacgagaccatcggccccctgagcgagggcgacagcgacgaggagatcttcgtgagcaagaagctgaagaacagaaaggtgctgcaggacagcgacagcgagaccgaggacaccaacgccagccccgagaagaccacctacgacagcgccgaggaggagaacaaggagaacctgtacgccggcaagaacaccaagatcaagagaatctacaagaccgtggccgacagcgacgagagctacatggagaagagcctgtaccaggagaacctggaggcccaggtgaagccctgcctggagctgagcctgcagagcggcaacagcaccgacttcaccaccgacagaaagagcagcaagaagcacatccacgacaaggagggcaccgccggcaaggccaaggtgaagagcaagagaagactggagaaggaggagagaaagatggagaagatcagacagctgaagaagaaggagaccaagaaccaggaggacgacgtggagcagcccttcaacgacagcggctgcctgctggtggacaaggacctgttcgagaccggcctggaggacgagaacaacagccccctggaggacgaggagagcctggagagcatcagagccgccgtgaagaacaaggtgaagaagcacaagaagaaggagcccagcctggagagcggcgtgcacagcttcgaggagggcagcgagctgagcaagggcaccaccagaaaggagagaaaggccgccagactgagcaaggaggccctgaagcagctgcacagcgagacccagagactgatcagagagagcgccctgaacctgccctaccacatgcccgagaacaagaccatccacgacttcttcaagagaaagcccagacccacctgccacggcaacgccatggccctgctgaagagcagcaagtaccagagcagccaccacaaggagatcatcgacaccgccaacaccaccgagatgaacagcgaccaccacagcaagggcagcgagcagaccaccggcgccgagaacgaggtggagaccaacgccctgcccgtggtgagcaaggagacccagatcatcaccggcagcgacgagagctgcagaaaggacctggtgaagaacgaggagctggagatccaggagaagcagaagcagagcgacatcagacccagccccggcgacagcagcgtgctgcagcaggagagcaacttcctgggcaacaaccacagcgaggagtgccaggtgggcggcctggtggccttcgagccccacgccctggagggcgagggcccccagaaccccgaggagaccgacgagaaggtggaggagcccgagcagcagaacaagagcagcgccgtgggcccccccgagaaggtgagaagattcaccctggacagactgaagcagctgggcgtggacgtgagcatcaagcccagactgggcgccgacgaggacagcttcgtgatcctggagcccgagaccaacagagagctggaggccctgaagcagagattctggaagcacgccaaccccgccgccaagcccagagccggccagaccgtgaacgtgaacgtgatcgtgaaggacatgggcaccgacggcaaggaggagctgaaggccgacgtggtgcccgtgaccctggcccccaagaagctggacggcgccagccacaccaagcccggcgagaagctgcaggtgctgaaggccaagctgcaggaggccatgaagctgagaagattcgaggagagacagaagagacaggccctgttcaagctggacaacgaggacggcttcgaggaggaggaggaggaggaggaggagatgaccgacgagagcgaggaggacggcgaggagaaggtggagaaggaggagaaggaggaggagctggaggaggaggaggagaaggaggaggaggaggaggaggagggcaaccaggagaccgccgagttcctgctgagcagcgaggagatcgagaccaaggacgagaaggagatggacaaggagaacaacgacggcagcagcgagatcggcaaggccgtgggcttcctgagcgtgcccaagagcctgagcagcgacagcaccctgctgctgttcaaggacagcagcagcaagatgggctacttccccaccgaggagaagagcgagaccgacgagaacagcggcaagcagcccagcaagctggacgaggacgacagctgcagcctgctgaccaaggagagcagccacaacagcagcttcgagctgatcggcagcaccatccccagctaccagccctgcaacagacagaccggcagaggcaccagcttcttccccaccgccggcggcttcagaagccccagccccggcctgttcagagccagcctggtgagcagcgccagcaagagcagcggcaagctgagcgagcccagcctgcccatcgaggacagccaggacctgtacaacgccagccccgagcccaagaccctgttcctgggcgccggcgacttccagttctgcctggaggacgacacccagagccagctgctggacgccgacggcttcctgaacgtgagaaaccacagaaaccagtaccaggccctgaagcccagactgcccctggccagcatggacgagaacgccatggacgccaacatggacgagctgctggacctgtgcaccggcaagttcaccagccaggccgagaagcacctgcccagaaagagcgacaagaaggagaacatggaggagctgctgaacctgtgcagcggcaagttcaccagccaggacgccagcacccccgccagcagcgagctgaacaagcaggagaaggagagcagcatgggcgaccccatggaggaggccctggccctgtgcagcggcagcttccccaccgacaaggaggaggaggacgaggaggaggagttcggcgacttcagactggtgagcaacgacaacgagttcgacagcgacgaggacgagcacagcgacagcggcaacgacctggccctggaggaccacgaggacgacgacgaggaggagctgctgaagagaagcgagaagctgaagagacagatgagactgagaaagtacctggaggacgaggccgaggtgagcggcagcgacgtgggcagcgaggacgagtacgacggcgaggagatcgacgagtacgaggaggacgtgatcgacgaggtgctgcccagcgacgaggagctgcagagccagatcaagaagatccacatgaagaccatgctggacgacgacaagagacagctgagactgtaccaggagagatacctggccgacggcgacctgcacagcgacggccccggcagaatgagaaagttcagatggaagaacatcgacgacgccagccagatggacctgttccacagagacagcgacgacgaccagaccgaggagcagctggacgagagcgaggccagatggagaaaggagagaatcgagagagagcagtggctgagagacatggcccagcagggcaagatcaccgccgaggaggaggaggagatcggcgaggacagccagttcatgatcctggccaagaaggtgaccgccaaggccctgcagaagaacgccagcagacccatggtgatccaggagagcaagagcctgctgagaaaccccttcgaggccatcagacccggcagcgcccagcaggtgaagaccggcagcctgctgaaccagcccaaggccgtgctgcagaagctggccgccctgagcgaccacaaccccagcgcccccagaaacagcagaaacttcgtgttccacaccctgagccccgtgaaggccgaggccgccaaggagagcagcaagagccagaagatccccgagaaggacagcgactggctgacctggagcggcgcccccatccccggcttcttcagactgagcttcgacccccacggctag

SEQ ID NO: 7808 - DNA, 4020 bp, Artificial Sequence
  Description of Artificial Sequence: Synthetic coding sequence
atgaccggcgaggtgggcagcgaggtgcacctggagatcaacgaccccaacgtgatcagccaggaggaggccgacagccccagcgacagcggccagggcagctacgagaccatcggccccctgagcgagggcgacagcgacgaggagatcttcgtgagcaagaagctgaagaacagaaaggtgctgcaggacagcgacagcgagaccgaggacaccaacgccagccccgagaagaccacctacgacagcgccgaggaggagaacaaggagaacctgtacgccggcaagaacaccaagatcaagagaatctacaagaccgtggccgacagcgacgagagctacatggagaagagcctgtaccaggagaacctggaggcccaggtgaagccctgcctggagctgagcctgcagagcggcaacagcaccgacttcaccaccgacagaaagagcagcaagaagcacatccacgacaaggagggcaccgccggcaaggccaaggtgaagagcaagagaagactggagaaggaggagagaaagatggagaagatcagacagctgaagaagaaggagaccaagaaccaggaggacgacgtggagcagcccttcaacgacagcggctgcctgctggtggacaaggacctgttcgagaccggcctggaggacgagaacaacagccccctggaggacgaggagagcctggagagcatcagagccgccgtgaagaacaaggtgaagaagcacaagaagaaggagcccagcctggagagcggcgtgcacagcttcgaggagggcagcgagctgagcaagggcaccaccagaaaggagagaaaggccgccagactgagcaaggaggccctgaagcagctgcacagcgagacccagagactgatcagagagagcgccctgaacctgccctaccacatgcccgagaacaagaccatccacgacttcttcaagagaaagcccagacccacctgccacggcaacgccatggccctgctgaagagcagcaagtaccagagcagccaccacaaggagatcatcgacaccgccaacaccaccgagatgaacagcgaccaccacagcaagggcagcgagcagaccaccggcgccgagaacgaggtggagaccaacgccctgcccgtggtgagcaaggagacccagatcatcaccggcagcgacgagagctgcagaaaggacctggtgaagaacgaggagctggagatccaggagaagcagaagcagagcgacatcagacccagccccggcgacagcagcgtgctgcagcaggagagcaacttcctgggcaacaaccacagcgaggagtgccaggtgggcggcctggtggccttcgagccccacgccctggagggcgagggcccccagaaccccgaggagaccgacgagaaggtggaggagcccgagcagcagaacaagagcagcgccgtgggcccccccgagaaggtgagaagattcaccctggacagactgaagcagctgggcgtggacgtgagcatcaagcccagactgggcgccgacgaggacagcttcgtgatcctggagcccgagaccaacagagagctggaggccctgaagcagagattctggaagcacgccaaccccgccgccaagcccagagccggccagaccgtgaacgtgaacgtgatcgtgaaggacatgggcaccgacggcaaggaggagctgaaggccgacgtggtgcccgtgaccctggcccccaagaagctggacggcgccagccacaccaagcccggcgagaagctgcaggtgctgaaggccaagctgcaggaggccatgaagctgagaagattcgaggagagacagaagagacaggccctgttcaagctggacaacgaggacggcttcgaggaggaggaggaggaggaggaggagatgaccgacgagagcgaggaggacggcgaggagaaggtggagaaggaggagaaggaggaggagctggaggaggaggaggagaaggaggaggaggaggaggaggagggcaaccaggagaccgccgagttcctgctgagcagcgaggagatcgagaccaaggacgagaaggagatggacaaggagaacaacgacggcagcagcgagatcggcaaggccgtgggcttcctgagcgtgcccaagagcctgagcagcgacagcaccctgctgctgttcaaggacagcagcagcaagatgggctacttccccaccgaggagaagagcgagaccgacgagaacagcggcaagcagcccagcaagctggacgaggacgacagctgcagcctgctgaccaaggagagcagccacaacagcagcttcgagctgatcggcagcaccatccccagctaccagccctgcaacagacagaccggcagaggcaccagcttcttccccaccgccggcggcttcagaagccccagccccggcctgttcagagccagcctggtgagcagcgccagcaagagcagcggcaagctgagcgagcccagcctgcccatcgaggacagccaggacctgtacaacgccagccccgagcccaagaccctgttcctgggcgccggcgacttccagttctgcctggaggacgacacccagagccagctgctggacgccgacggcttcctgaacgtgagaaaccacagaaaccagtaccaggccctgaagcccagactgcccctggccagcatggacgagaacgccatggacgccaacatggacgagctgctggacctgtgcaccggcaagttcaccagccaggccgagaagcacctgcccagaaagagcgacaagaaggagaacatggaggagctgctgaacctgtgcagcggcaagttcaccagccaggacgccagcacccccgccagcagcgagctgaacaagcaggagaaggagagcagcatgggcgaccccatggaggaggccctggccctgtgcagcggcagcttccccaccgacaaggaggaggaggacgaggaggaggagttcggcgacttcagactggtgagcaacgacaacgagttcgacagcgacgaggacgagcacagcgacagcggcaacgacctggccctggaggaccacgaggacgacgacgaggaggagctgctgaagagaagcgagaagctgaagagacagatgagactgagaaagtacctggaggacgaggccgaggtgagcggcagcgacgtgggcagcgaggacgagtacgacggcgaggagatcgacgagtacgaggaggacgtgatcgacgaggtgctgcccagcgacgaggagctgcagagccagatcaagaagatccacatgaagaccatgctggacgacgacaagagacagctgagactgtaccaggagagatacctggccgacggcgacctgcacagcgacggccccggcagaatgagaaagttcagatggaagaacatcgacgacgccagccagatggacctgttccacagagacagcgacgacgaccagaccgaggagcagctggacgagagcgaggccagatggagaaaggagagaatcgagagagagcagtggctgagagacatggcccagcagggcaagatcaccgccgaggaggaggaggagatcggcgaggacagccagttcatgatcctggccaagaaggtgaccgccaaggccctgcagaagaacgccagcagacccatggtgatccaggagagcaagagcctgctgagaaaccccttcgaggccatcagacccggcagcgcccagcaggtgaagaccggcagcctgctgaaccagcccaaggccgtgctgcagaagctggccgccctgagcgaccacaaccccagcgcccccagaaacagcagaaacttcgtgttccacaccctgagccccgtgaaggccgaggccgccaaggagagcagcaagagccaggtgaagaagagaggccccagcttcatgaccagccccagccccaagcacctgaagaccgacgacagcaccagcggcctgaccagaagcatcttcaagtacctggagagctag

SEQ ID NO: 7809 - DNA, 3828 bp, Artificial Sequence
  Description of Artificial Sequence: Synthetic coding sequence
atgaccggcgaggtgggcagcgaggtgcacctggagatcaacgaccccaacgtgatcagccaggaggaggccgacagccccagcgacagcggccagggcagctacgagaccatcggccccctgagcgagggcgacagcgacgaggagatcttcgtgagcaagaagctgaagaacagaaaggtgctgcaggacagcgacagcgagaccgaggacaccaacgccagccccgagaagaccacctacgacagcgccgaggaggagaacaaggagaacctgtacgccggcaagaacaccaagatcaagagaatctacaagaccgtggccgacagcgacgagagctacatggagaagagcctgtaccaggagaacctggaggcccaggtgaagccctgcctggagctgagcctgcagagcggcaacagcaccgacttcaccaccgacagaaagagcagcaagaagcacatccacgacaaggagggcaccgccggcaaggccaaggtgaagagcaagagaagactggagaaggaggagagaaagatggagaagatcagacagctgaagaagaaggagaccaagaaccaggaggacgacgtggagcagcccttcaacgacagcggctgcctgctggtggacaaggacctgttcgagaccggcctggaggacgagaacaacagccccctggaggacgaggagagcctggagagcatcagagccgccgtgaagaacaaggtgaagaagcacaagaagaaggagcccagcctggagagcggcgtgcacagcttcgaggagggcagcgagctgagcaagggcaccaccagaaaggagagaaaggccgccagactgagcaaggaggccctgaagcagctgcacagcgagacccagagactgatcagagagagcgccctgaacctgccctaccacatgcccgagaacaagaccatccacgacttcttcaagagaaagcccagacccacctgccacggcaacgccatggccctgctgaagagcagcaagtaccagagcagccaccacaaggagatcatcgacaccgccaacaccaccgagatgaacagcgaccaccacagcaagggcagcgagcagaccaccggcgccgagaacgaggtggagaccaacgccctgcccgtggtgagcaaggagacccagatcatcaccggcagcgacgagagctgcagaaaggacctggtgaagaacgaggagctggagatccaggagaagcagaagcagagcgacatcagacccagccccggcgacagcagcgtgctgcagcaggagagcaacttcctgggcaacaaccacagcgaggagtgccaggtgggcggcctggtggccttcgagccccacgccctggagggcgagggcccccagaaccccgaggagaccgacgagaaggtggaggagcccgagcagcagaacaagagcagcgccgtgggcccccccgagaaggtgagaagattcaccctggacagactgaagcagctgggcgtggacgtgagcatcaagcccagactgggcgccgacgaggacagcttcgtgatcctggagcccgagaccaacagaggcgagaagctgcaggtgctgaaggccaagctgcaggaggccatgaagctgagaagattcgaggagagacagaagagacaggccctgttcaagctggacaacgaggacggcttcgaggaggaggaggaggaggaggaggagatgaccgacgagagcgaggaggacggcgaggagaaggtggagaaggaggagaaggaggaggagctggaggaggaggaggagaaggaggaggaggaggaggaggagggcaaccaggagaccgccgagttcctgctgagcagcgaggagatcgagaccaaggacgagaaggagatggacaaggagaacaacgacggcagcagcgagatcggcaaggccgtgggcttcctgagcgtgcccaagagcctgagcagcgacagcaccctgctgctgttcaaggacagcagcagcaagatgggctacttccccaccgaggagaagagcgagaccgacgagaacagcggcaagcagcccagcaagctggacgaggacgacagctgcagcctgctgaccaaggagagcagccacaacagcagcttcgagctgatcggcagcaccatccccagctaccagccctgcaacagacagaccggcagaggcaccagcttcttccccaccgccggcggcttcagaagccccagccccggcctgttcagagccagcctggtgagcagcgccagcaagagcagcggcaagctgagcgagcccagcctgcccatcgaggacagccaggacctgtacaacgccagccccgagcccaagaccctgttcctgggcgccggcgacttccagttctgcctggaggacgacacccagagccagctgctggacgccgacggcttcctgaacgtgagaaaccacagaaaccagtaccaggccctgaagcccagactgcccctggccagcatggacgagaacgccatggacgccaacatggacgagctgctggacctgtgcaccggcaagttcaccagccaggccgagaagcacctgcccagaaagagcgacaagaaggagaacatggaggagctgctgaacctgtgcagcggcaagttcaccagccaggacgccagcacccccgccagcagcgagctgaacaagcaggagaaggagagcagcatgggcgaccccatggaggaggccctggccctgtgcagcggcagcttccccaccgacaaggaggaggaggacgaggaggaggagttcggcgacttcagactggtgagcaacgacaacgagttcgacagcgacgaggacgagcacagcgacagcggcaacgacctggccctggaggaccacgaggacgacgacgaggaggagctgctgaagagaagcgagaagctgaagagacagatgagactgagaaagtacctggaggacgaggccgaggtgagcggcagcgacgtgggcagcgaggacgagtacgacggcgaggagatcgacgagtacgaggaggacgtgatcgacgaggtgctgcccagcgacgaggagctgcagagccagatcaagaagatccacatgaagaccatgctggacgacgacaagagacagctgagactgtaccaggagagatacctggccgacggcgacctgcacagcgacggccccggcagaatgagaaagttcagatggaagaacatcgacgacgccagccagatggacctgttccacagagacagcgacgacgaccagaccgaggagcagctggacgagagcgaggccagatggagaaaggagagaatcgagagagagcagtggctgagagacatggcccagcagggcaagatcaccgccgaggaggaggaggagatcggcgaggacagccagttcatgatcctggccaagaaggtgaccgccaaggccctgcagaagaacgccagcagacccatggtgatccaggagagcaagagcctgctgagaaaccccttcgaggccatcagacccggcagcgcccagcaggtgaagaccggcagcctgctgaaccagcccaaggccgtgctgcagaagctggccgccctgagcgaccacaaccccagcgcccccagaaacagcagaaacttcgtgttccacaccctgagccccgtgaaggccgaggccgccaaggagagcagcaagagccaggtgaagaagagaggccccagcttcatgaccagccccagccccaagcacctgaagaccgacgacagcaccagcggcctgaccagaagcatcttcaagtacctggagagctag

SEQ ID NO: 7810 - DNA, 1977 bp, Artificial Sequence
  Description of Artificial Sequence: Synthetic coding sequence
atgaccggcgaggtgggcagcgaggtgcacctggagatcaacgaccccaacgtgatcagccaggaggaggccgacagccccagcgacagcggccagggcagctacgagaccatcggccccctgagcgagggcgacagcgacgaggagatcttcgtgagcaagaagctgaagaacagaaaggtgctgcaggacagcgacagcgagaccgaggacaccaacgccagccccgagaagaccacctacgacagcgccgaggaggagaacaaggagaacctgtacgccggcaagaacaccaagatcaagagaatctacaagaccgtggccgacagcgacgagagctacatggagaagagcctgtaccaggagaacctggaggcccaggtgaagccctgcctggagctgagcctgcagagcggcaacagcaccgacttcaccaccgacagaaagagcagcaagaagcacatccacgacaaggagggcaccgccggcaaggccaaggtgaagagcaagagaagactggagaaggaggagagaaagatggagaagatcagacagctgaagaagaaggagaccaagaaccaggaggacgacgtggagcagcccttcaacgacagcggctgcctgctggtggacaaggacctgttcgagaccggcctggaggacgagaacaacagccccctggaggacgaggagagcctggagagcatcagagccgccgtgaagaacaaggtgaagaagcacaagaagaaggagcccagcctggagagcggcgtgcacagcttcgaggagggcagcgagctgagcaagggcaccaccagaaaggagagaaaggccgccagactgagcaaggaggccctgaagcagctgcacagcgagacccagagactgatcagagagagcgccctgaacctgccctaccacatgcccgagaacaagaccatccacgacttcttcaagagaaagcccagacccacctgccacggcaacgccatggccctgctgaagagcagcaagtaccagagcagccaccacaaggagatcatcgacaccgccaacaccaccgagatgaacagcgaccaccacagcaagggcagcgagcagaccaccggcgccgagaacgaggtggagaccaacgccctgcccgtggtgagcaaggagacccagatcatcaccggcagcgacgagagctgcagaaaggacctggtgaagaacgaggagctggagatccaggagaagcagaagcagagcgacatcagacccagccccggcgacagcagcgtgctgcagcaggagagcaacttcctgggcaacaaccacagcgaggagtgccaggtgggcggcctggtggccttcgagccccacgccctggagggcgagggcccccagaaccccgaggagaccgacgagaaggtggaggagcccgagcagcagaacaagagcagcgccgtgggcccccccgagaaggtgagaagattcaccctggacagactgaagcagctgggcgtggacgtgagcatcaagcccagactgggcgccgacgaggacagcttcgtgatcctggagcccgagaccaacagagagctggaggccctgaagcagagattctggaagcacgccaaccccgccgccaagcccagagccggccagaccgtgaacgtgaacgtgatcgtgaaggacatgggcaccgacggcaaggaggagctgaaggccgacgtggtgcccgtgaccctggcccccaagaagctggacggcgccagccacaccaagcccggcgagaagctgcaggtgctgaaggccaagctgcaggaggccatgaagctgagaagattcgaggagagacagaagagacaggccctgttcaagctggacaacgaggacggcttcgaggaggaggaggaggaggaggaggagatgaccgacgagagcgaggaggacggcgaggagaagaagaagaagaagaagaagaagaagaactag

SEQ ID NO: 7811 - DNA, 3393 bp, Artificial Sequence
  Description of Artificial Sequence: Synthetic coding sequence
atgagatgcctggcccccagacccgccggcagctacctgagcgagccccagggcagcagccagtgcgccaccatggagctgggccccctggagggcggctacctggagctgctgaacagcgacgccgaccccctgtgcctgtaccacttctacgaccagatggacctggccggcgaggaggagatcgagctgtacagcgagcccgacaccgacaccatcaactgcgaccagttcagcagactgctgtgcgacatggagggcgacgaggagaccagagaggcctacgccaacatcgccgagctggaccagtacgtgttccaggacagccagctggagggcctgagcaaggacatcttcaagcacatcggccccgacgaggtgatcggcgagagcatggagatgcccgccgaggtgggccagaagagccagaagagacccttccccgaggagctgcccgccgacctgaagcactggaagcccgccgagccccccaccgtggtgaccggcagcctgctggtgagacccgtgagcgactgcagcaccctgccctgcctgcccctgcccgccctgttcaaccaggagcccgccagcggccagatgagactggagaagaccgaccagatccccatgcccttcagcagcagcagcctgagctgcctgaacctgcccgagggccccatccagttcgtgcccaccatcagcaccctgccccacggcctgtggcagatcagcgaggccggcaccggcgtgagcagcatcttcatctaccacggcgaggtgccccaggccagccaggtgcccccccccagcggcttcaccgtgcacggcctgcccaccagccccgacagacccggcagcaccagccccttcgcccccagcgccaccgacctgcccagcatgcccgagcccgccctgaccagcagagccaacatgaccgagcacaagaccagccccacccagtgccccgccgccggcgaggtgagcaacaagctgcccaagtggcccgagcccgtggagcagttctacagaagcctgcaggacacctacggcgccgagcccgccggccccgacggcatcctggtggaggtggacctggtgcaggccagactggagagaagcagcagcaagagcctggagagagagctggccacccccgactgggccgagagacagctggcccagggcggcctggccgaggtgctgctggccgccaaggagcacagaagacccagagagaccagagtgatcgccgtgctgggcaaggccggccagggcaagagctactgggccggcgccgtgagcagagcctgggcctgcggcagactgccccagtacgacttcgtgttcagcgtgccctgccactgcctgaacagacccggcgacgcctacggcctgcaggacctgctgttcagcctgggcccccagcccctggtggccgccgacgaggtgttcagccacatcctgaagagacccgacagagtgctgctgatcctggacggcttcgaggagctggaggcccaggacggcttcctgcacagcacctgcggccccgcccccgccgagccctgcagcctgagaggcctgctggccggcctgttccagaagaagctgctgagaggctgcaccctgctgctgaccgccagacccagaggcagactggtgcagagcctgagcaaggccgacgccctgttcgagctgagcggcttcagcatggagcaggcccaggcctacgtgatgagatacttcgagagcagcggcatgaccgagcaccaggacagagccctgaccctgctgagagacagacccctgctgctgagccacagccacagccccaccctgtgcagagccgtgtgccagctgagcgaggccctgctggagctgggcgaggacgccaagctgcccagcaccctgaccggcctgtacgtgggcctgctgggcagagccgccctggacagcccccccggcgccctggccgagctggccaagctggcctgggagctgggcagaagacaccagagcaccctgcaggaggaccagttccccagcgccgacgtgagaacctgggccatggccaagggcctggtgcagcacccccccagagccgccgagagcgagctggccttccccagcttcctgctgcagtgcttcctgggcgccctgtggctggccctgagcggcgagatcaaggacaaggagctgccccagtacctggccctgacccccagaaagaagagaccctacgacaactggctggagggcgtgcccagattcctggccggcctgatcttccagccccccgccagatgcctgggcgccctgctgggccccagcgccgccgccagcgtggacagaaagcagaaggtgctggccagatacctgaagagactgcagcccggcaccctgagagccagacagctgctggagctgctgcactgcgcccacgaggccgaggaggccggcatctggcagcacgtggtgcaggagctgcccggcagactgagcttcctgggcaccagactgaccccccccgacgcccacgtgctgggcaaggccctggaggccgccggccaggacttcagcctggacctgagaagcaccggcatctgccccagcggcctgggcagcctggtgggcctgagctgcgtgaccagattcagagccgccctgagcgacaccgtggccctgtgggagagcctgcagcagcacggcgagaccaagctgctgcaggccgccgaggagaagttcaccatcgagcccttcaaggccaagagcctgaaggacgtggaggacctgggcaagctggtgcagacccagagaaccagaagcagcagcgaggacaccgccggcgagctgcccgccgtgagagacctgaagaagctggagttcgccctgggccccgtgagcggcccccaggccttccccaagctggtgagaatcctgaccgccttcagcagcctgcagcacctggacctggacgccctgagcgagaacaagatcggcgacgagggcgtgagccagctgagcgccaccttcccccagctgaagagcctggagaccctgaacctgagccagaacaacatcaccgacctgggcgcctacaagctggccgaggccctgcccagcctggccgccagcctgctgagactgagcctgtacaacaactgcatctgcgacgtgggcgccgagagcctggccagagtgctgcccgacatggtgagcctgagagtgatggacgtgcagtacaacaagttcaccgccgccggcgcccagcagctggccgccagcctgagaagatgcccccacgtggagaccctggccatgtggacccccaccatccccttcagcgtgcaggagcacctgcagcagcaggacagcagaatcagcctgagatag

SEQ ID NO: 7812 - DNA, 1641 bp, Artificial Sequence
  Description of Artificial Sequence: Synthetic coding sequence
atgagatgcctggcccccagacccgccggcagctacctgagcgagccccagggcagcagccagtgcgccaccatggagctgggccccctggagggcggctacctggagctgctgaacagcgacgccgaccccctgtgcctgtaccacttctacgaccagatggacctggccggcgaggaggagatcgagctgtacagcgagcccgacaccgacaccatcaactgcgaccagttcagcagactgctgtgcgacatggagggcgacgaggagaccagagaggcctacgccaacatcgccgagctggaccagtacgtgttccaggacagccagctggagggcctgagcaaggacatcttcaagcacatcggccccgacgaggtgatcggcgagagcatggagatgcccgccgaggtgggccagaagagccagaagagacccttccccgaggagctgcccgccgacctgaagcactggaagcccgtgcccttcagcagcagcagcctgagctgcctgaacctgcccgagggccccatccagttcgtgcccaccatcagcaccctgccccacggcctgtggcagatcagcgaggccggcaccggcgtgagcagcatcttcatctaccacggcgaggtgccccaggccagccaggtgcccccccccagcggcttcaccgtgcacggcctgcccaccagccccgacagacccggcagcaccagccccttcgcccccagcgccaccgacctgcccagcatgcccgagcccgccctgaccagcagagccaacatgaccgagcacaagaccagccccacccagtgccccgccgccggcgaggtgagcaacaagctgcccaagtggcccggcctggcctggagcccctgcctgggcctgagacccagcctgcacagagccgccctgagcgacaccgtggccctgtgggagagcctgcagcagcacggcgagaccaagctgctgcaggccgccgaggagaagttcaccatcgagcccttcaaggccaagagcctgaaggacgtggaggacctgggcaagctggtgcagacccagagaaccagaagcagcagcgaggacaccgccggcgagctgcccgccgtgagagacctgaagaagctggagttcgccctgggccccgtgagcggcccccaggccttccccaagctggtgagaatcctgaccgccttcagcagcctgcagcacctggacctggacgccctgagcgagaacaagatcggcgacgagggcgtgagccagctgagcgccaccttcccccagctgaagagcctggagaccctgaacctgagccagaacaacatcaccgacctgggcgcctacaagctggccgaggccctgcccagcctggccgccagcctgctgagactgagcctgtacaacaactgcatctgcgacgtgggcgccgagagcctggccagagtgctgcccgacatggtgagcctgagagtgatggacgtgcagtacaacaagttcaccgccgccggcgcccagcagctggccgccagcctgagaagatgcccccacgtggagaccctggccatgtggacccccaccatccccttcagcgtgcaggagcacctgcagcagcaggacagcagaatcagcctgagatag

SEQ ID NO: 7813 - DNA, 2655 bp, Artificial Sequence
  Description of Artificial Sequence: Synthetic coding sequence
atgagatgcctggcccccagacccgccggcagctacctgagcgagccccagggcagcagccagtgcgccaccatggagctgggccccctggagggcggctacctggagctgctgaacagcgacgccgaccccctgtgcctgtaccacttctacgaccagatggacctggccggcgaggaggagatcgagctgtacagcgagcccgacaccgacaccatcaactgcgaccagttcagcagactgctgtgcgacatggagggcgacgaggagaccagagaggcctacgccaacatcgccgagctggaccagtacgtgttccaggacagccagctggagggcctgagcaaggacatcttcatcgagcacatcggccccgacgaggtgatcggcgagagcatggagatgcccgccgaggtgggccagaagagccagaagagacccttccccgaggagctgcccgccgacctgaagcactggaagcccgtgcccttcagcagcagcagcctgagctgcctgaacctgcccgagggccccatccagttcgtgcccaccatcagcaccctgccccacggcctgtggcagatcagcgaggccggcaccggcgtgagcagcatcttcatctaccacggcgaggtgccccaggccagccaggtgcccccccccagcggcttcaccgtgcacggcctgcccaccagccccgacagacccggcagcaccagccccttcgcccccagcgccaccgacctgcccagcatgcccgagcccgccctgaccagcagagccaacatgaccgagcacaagaccagccccacccagtgccccgccgccggcgaggtgagcaacaagctgcccaagtggcccgagcccgtggagcagttctacagaagcctgcaggacacctacggcgccgagcccgccggccccgacggcatcctggtggaggtggacctggtgcaggccagactggagagaagcagcagcaagagcctggagagagagctggccacccccgactgggccgagagacagctggcccagggcggcctggccgaggtgctgctggccgccaaggagcacagaagacccagagagaccagagtgatcgccgtgctgggcaaggccggccagggcaagagctactgggccggcgccgtgagcagagcctgggcctgcggcagactgccccagtacgacttcgtgttcagcgtgccctgccactgcctgaacagacccggcgacgcctacggcctgcaggacctgctgttcagcctgggcccccagcccctggtggccgccgacgaggtgttcagccacatcctgaagagacccgacagagtgctgctgatcctggacggcttcgaggagctggaggcccaggacggcttcctgcacagcacctgcggccccgcccccgccgagccctgcagcctgagaggcctgctggccggcctgttccagaagaagctgctgagaggctgcaccctgctgctgaccgccagacccagaggcagactggtgcagagcctgagcaaggccgacgccctgttcgagctgagcggcttcagcatggagcaggcccaggcctacgtgatgagatacttcgagagcagcggcatgaccgagcaccaggacagagccctgaccctgctgagagacagacccctgctgctgagccacagccacagccccaccctgtgcagagccgtgtgccagctgagcgaggccctgctggagctgggcgaggacgccaagctgcccagcaccctgaccggcctgtacgtgggcctgctgggcagagccgccctggacagcccccccggcgccctggccgagctggccaagctggcctgggagctgggcagaagacaccagagcaccctgcaggaggaccagttccccagcgccgacgtgagaacctgggccatggccaagggcctggtgcagcacccccccagagccgccgagagcgagctggccttccccagcttcctgctgcagtgcttcctgggcgccctgtggctggccctgagcggcgagatcaaggacaaggagctgccccagtacctggccctgacccccagaaagaagagaccctacgacaactggctggagggcgtgcccagattcctggccggcctgatcttccagccccccgccagatgcctgggcgccctgctgggccccagcgccgccgccagcgtggacagaaagcagaaggtgctggccagatacctgaagagactgcagcccggcaccctgagagccagacagctgctggagctgctgcactgcgcccacgaggccgaggaggccggcatctggcagcacgtggtgcaggagctgcccggcagactgagcttcctgggcaccagactgaccccccccgacgcccacgtgctgggcaaggccctggaggccgccggccaggacttcagcctggacctgagaagcaccggcatctgccccagcggcctgggcagcctggtgggcctgagctgcgtgaccagattcagatggggcgagggcctgggcagagacatcctggtgctgggcatcaactgcggcctgggcgccaagcccagcgccctgtggggcagcttcagcatgcagagcagcagagtgggccagaacggcttcagccccttcctgagatag

SEQ ID NO: 7814 - DNA, 1062 bp, Artificial Sequence
  Description of Artificial Sequence: Synthetic coding sequence
atgagatgcctggcccccagacccgccggcagctacctgagcgagccccagggcagcagccagtgcgccaccatggagctgggccccctggagggcggctacctggagctgctgaacagcgacgccgaccccctgtgcctgtaccacttctacgaccagatggacctggccggcgaggaggagatcgagctgtacagcgagcccgacaccgacaccatcaactgcgaccagttcagcagactgctgtgcgacatggagggcgacgaggagaccagagaggcctacgccaacatcgccgagctggaccagtacgtgttccaggacagccagctggagggcctgagcaaggacatcttcaagcacatcggccccgacgaggtgatcggcgagagcatggagatgcccgccgaggtgggccagaagagccagaagagacccttccccgaggagctgcccgccgacctgaagcactggaagcccgccgagccccccaccgtggtgaccggcagcctgctggtgagacccgtgagcgactgcagcaccctgccctgcctgcccctgcccgccctgttcaaccaggagcccgccagcggccagatgagactggagaagaccgaccagatccccatgcccttcagcagcagcagcctgagctgcctgaacctgcccgagggccccatccagttcgtgcccaccatcagcaccctgccccacggcctgtggcagatcagcgaggccggcaccggcgtgagcagcatcttcatctaccacggcgaggtgccccaggccagccaggtgcccccccccagcggcttcaccgtgcacggcctgcccaccagccccgacagacccggcagcaccagccccttcgcccccagcgccaccgacctgcccagcatgcccgagcccgccctgaccagcagagccaacatgaccgagcacaagaccagccccacccagtgccccgccgccggcgaggtgagcaacaagctgcccaagtggcccggcagagaggtgcccagaaagacccagctgggcagcagcctgctgttcggcacctag

SEQ ID NO: 7815 - DNA, 4332 bp, Artificial Sequence
  Description of Artificial Sequence: Synthetic coding sequence
atgtacgccgtgtacaagcaggcccacccccccaccggcctggagttcagcatgtactgcaacttcttcaacaacagcgagagaaacctggtggtggccggcaccagccagctgtacgtgtacagactgaacagagacgccgaggccctgaccaagaacgacagaagcaccgagggcaaggcccacagagagaagctggagctggccgccagcttcagcttcttcggcaacgtgatgagcatggccagcgtgcagctggccggcgccaagagagacgccctgctgctgagcttcaaggacgccaagctgagcgtggtggagtacgaccccggcacccacgacctgaagaccctgagcctgcactacttcgaggagcccgagctgagagacggcttcgtgcagaacgtgcacacccccagagtgagagtggaccccgacggcagatgcgccgccatgctggtgtacggcaccagactggtggtgctgcccttcagaagagagagcctggccgaggagcacgagggcctggtgggcgagggccagagaagcagcttcctgcccagctacatcatcgacgtgagagccctggacgagaagctgctgaacatcatcgacctgcagttcctgcacggctactacgagcccaccctgctgatcctgttcgagcccaaccagacctggcccggcagagtggccgtgagacaggacacctgcagcatcgtggccatcagcctgaacatcacccagaaggtgcaccccgtgatctggagcctgaccagcctgcccttcgactgcacccaggccctggccgtgcccaagcccatcggcggcgtggtggtgttcgccgtgaacagcctgctgtacctgaaccagagcgtgcccccctacggcgtggccctgaacagcctgaccaccggcaccaccgccttccccctgagaacccaggagggcgtgagaatcaccctggactgcgcccaggccaccttcatcagctacgacaagatggtgatcagcctgaagggcggcgagatctacgtgctgaccctgatcaccgacggcatgagaagcgtgagagccttccacttcgacaaggccgccgccagcgtgctgaccaccagcatggtgaccatggagcccggctacctgttcctgggcagcagactgggcaacagcctgctgctgaagtacaccgagaagctgcaggagccccccgccagcgccgtgagagaggccgccgacaaggaggagccccccagcaagaagaagagagtggacgccaccgccggctggagcgccgccggcaagagcgtgccccaggacgaggtggacgagatcgaggtgtacggcagcgaggcccagagcggcacccagctggccacctacagcttcgaggtgtgcgacagcatcctgaacatcggcccctgcgccaacgccgccgtgggcgagcccgccttcctgagcgaggagttccagaacagccccgagcccgacctggagatcgtggtgtgcagcggccacggcaagaacggcgccctgagcgtgctgcagaagagcatcagaccccaggtggtgaccaccttcgagctgcccggctgctacgacatgtggaccgtgatcgcccccgtgagaaaggaggaggaggacaaccccaagggcgagggcaccgagcaggagcccagcaccacccccgaggccgacgacgacggcagaagacacggcttcctgatcctgagcagagaggacagcaccatgatcctgcagaccggccaggagatcatggagctggacaccagcggcttcgccacccagggccccaccgtgttcgccggcaacatcggcgacaacagatacatcgtgcaggtgagccccctgggcatcagactgctggagggcgtgaaccagctgcacttcatccccgtggacctgggcgcccccatcgtgcagtgcgccgtggccgacccctacgtggtgatcatgagcgccgagggccacgtgaccatgttcctgctgaagagcgacagctacggcggcagacaccacagactggccctgcacaagccccccctgcaccaccagagcaaggtgatcaccctgtgcctgtacagagacctgagcggcatgttcaccaccgagagcagactgggcggcgccagagacgagctgggcggcagaagcggccccgaggccgagggcctgggcagcgagaccagccccaccgtggacgacgaggaggagatgctgtacggcgacagcggcagcctgttcagccccagcaaggaggaggccagaagaagcagccagccccccgccgacagagaccccgcccccttcagagccgagcccacccactggtgcctgctggtgagagagaacggcaccatggagatctaccagctgcccgactggagactggtgttcctggtgaagaacttccccgtgggccagagagtgctggtggacagcagcttcggccagcccaccacccagggcgaggccagaagagaggaggccaccagacagggcgagctgcccctggtgaaggaggtgctgctggtggccctgggcagcagacagagcagaccctacctgctggtgcacgtggaccaggagctgctgatctacgaggccttcccccacgacagccagctgggccagggcaacctgaaggtgagattcaagaaggtgccccacaacatcaacttcagagagaagaagcccaagcccagcaagaagaaggccgagggcggcggcgccgaggagggcgccggcgccagaggcagagtggccagattcagatacttcgaggacatctacggctacagcggcgtgttcatctgcggccccagcccccactggctgctggtgaccggcagaggcgccctgagactgcaccccatggccatcgacggccccgtggacagcttcgcccccttccacaacgtgaactgccccagaggcttcctgtacttcaacagacagggcgagctgagaatcagcgtgctgcccgcctacctgagctacgacgccccctggcccgtgagaaagatccccctgagatgcaccgcccactacgtggcctaccacgtggagagcaaggtgtacgccgtggccaccagcaccaacaccccctgcgccagaatccccagaatgaccggcgaggagaaggagttcgagaccatcgagagagacgagagatacatccacccccagcaggaggccttcagcatccagctgatcagccccgtgagctgggaggccatccccaacgccagaatcgagctgcaggagtgggagcacgtgacctgcatgaagaccgtgagcctgagaagcgaggagaccgtgagcggcctgaagggctacgtggccgccggcacctgcctgatgcagggcgaggaggtgacctgcagaggcagaatcctgatcatggacgtgatcgaggtggtgcccgagcccggccagcccctgaccaagaacaagttcaaggtgctgtacgagaaggagcagaagggccccgtgaccgccctgtgccactgcaacggccacctggtgagcgccatcggccagaagatcttcctgtggagcctgagagccagcgagctgaccggcatggccttcatcgacacccagctgtacatccaccagatgatcagcgtgaagaacttcatcctggccgccgacgtgatgaagagcatcagcctgctgagataccaggaggagagcaagaccctgagcctggtgagcagagacgccaagcccctggaggtgtacagcgtggacttcatggtggacaacgcccagctgggcttcctggtgagcgacagagacagaaacctgatggtgtacatgtacctgcccgaggccaaggagagcttcggcggcatgagactgctgagaagagccgacttccacgtgggcgcccacgtgaacaccttctggagaaccccctgcagaggcgccaccgagggcctgagcaagaagagcgtggtgtgggagaacaagcacatcacctggttcgccaccctggacggcggcatcggcctgctgctgcccatgcaggagaagacctacagaagactgctgatgctgcagaacgccctgaccaccatgctgccccaccacgccggcctgaaccccagagccttcagaatgctgcacgtggacagaagaaccctgcagaacgccgtgagaaacgtgctggacggcgagctgctgaacagatacctgtacctgagcaccatggagagaagcgagctggccaagaagatcggcaccacccccgacatcatcctggacgacctgctggagaccgacagagtgaccgcccacttctag

SEQ ID NO: 7816 - DNA, 2349 bp, Artificial Sequence
  Description of Artificial Sequence: Synthetic coding sequence
atgaccagcatcatcaagctgaccaccctgagcggcgtgcaggaggagagcgccctgtgctacctgctgcaggtggacgagttcagattcctgctggactgcggctgggacgagcacttcagcatggacatcatcgacagcctgagaaagcacgtgcaccagatcgacgccgtgctgctgagccaccccgaccccctgcacctgggcgccctgccctacgccgtgggcaagctgggcctgaactgcgccatctacgccaccatccccgtgtacaagatgggccagatgttcatgtacgacctgtaccagagcagacacaacaccgaggacttcaccctgttcaccctggacgacgtggacgccgccttcgacaagatccagcagctgaagttcagccagatcgtgaacctgaagggcaagggccacggcctgagcatcacccccctgcccgccggccacatgatcggcggcaccatctggaagatcgtgaaggacggcgaggaggagatcgtgtacgccgtggacttcaaccacaagagagagatccacctgaacggctgcagcctggagatgctgagcagacccagcctgctgatcaccgacagcttcaacgccacctacgtgcagcccagaagaaagcagagagacgagcagctgctgaccaacgtgctggagaccctgagaggcgacggcaacgtgctgatcgccgtggacaccgccggcagagtgctggagctggcccagctgctggaccagatctggagaaccaaggacgccggcctgggcgtgtacagcctggccctgctgaacaacgtgagctacaacgtggtggagttcagcaagagccaggtggagtggatgagcgacaagctgatgagatgcttcgaggacaagagaaacaaccccttccagttcagacacctgagcctgtgccacggcctgagcgacctggccagagtgcccagccccaaggtggtgctggccagccagcccgacctggagtgcggcttcagcagagacctgttcatccagtggtgccaggaccccaagaacagcatcatcctgacctacagaaccacccccggcaccctggccagattcctgatcgacaaccccagcgagaagatcaccgagatcgagctgagaaagagagtgaagctggagggcaaggagctggaggagtacctggagaaggagaagctgaagaaggaggccgccaagaagctggagcagagcaaggaggccgacatcgacagcagcgacgagagcgacatcgaggaggacatcgaccagcccagcgcccacaagaccaagcacgacctgatgatgaagggcgagggcagcagaaagggcagcttcttcaagcaggccaagaagagctaccccatgttccccgcccccgaggagagaatcaagtgggacgagtacggcgagatcatcaagcccgaggacttcctggtgcccgagctgcaggccaccgaggaggagaagagcaagctggagagcggcctgaccaacggcgacgagcccatggaccaggacctgagcgacgtgcccaccaagtgcatcagcaccaccgagagcatcgagatcaaggccagagtgacctacatcgactacgagggcagaagcgacggcgacagcatcaagaagatcatcaaccagatgaagcccagacagctgatcatcgtgcacggcccccccgaggccagccaggacctggccgagtgctgcagagccttcggcggcaaggacatcaaggtgtacatgcccaagctgcacgagaccgtggacgccaccagcgagacccacatctaccaggtgagactgaaggacagcctggtgagcagcctgcagttctgcaaggccaaggacgccgagctggcctggatcgacggcgtgctggacatgagagtgagcaaggtggacaccggcgtgatcctggaggagggcgagctgaaggacgacggcgaggacagcgagatgcaggtggaggcccccagcgacagcagcgtgatcgcccagcagaaggccatgaagagcctgttcggcgacgacgagaaggagaccggcgaggagagcgagatcatccccaccctggagcccctgcccccccacgaggtgcccggccaccagagcgtgttcatgaacgagcccagactgagcgacttcaagcaggtgctgctgagagagggcatccaggccgagttcgtgggcggcgtgctggtgtgcaacaaccaggtggccgtgagaagaaccgagaccggcagaatcggcctggagggctgcctgtgccaggacttctacagaatcagagacctgctgtacgagcagtacgccatcgtgtag

SEQ ID NO: 7817 - DNA, 243 bp, Artificial Sequence
  Description of Artificial Sequence: Synthetic coding sequence
atgaccagcatcatcaagctgaccaccctgagcggcgtgcaggaggagagcgccctgtgctacctgctgcaggtggacgagttcagattcctgctggactgcggctgggacgagcacttcagcatggacatcatcgacagcctgagaaagcacgtgcaccagatcgacgccgtgctgctgagccaccccgaccccctgcacctgggcgccctgccctacgccgtgggcaagctgggcctgtag

SEQ ID NO: 7818 - DNA, 2055 bp, Artificial Sequence
  Description of Artificial Sequence: Synthetic coding sequence
atgagcgccatccccgccgaggagagcgaccagctgctgatcagacccctgggcgccggccaggaggtgggcagaagctgcatcatcctggagttcaagggcagaaagatcatgctggactgcggcatccaccccggcctggagggcatggacgccctgccctacatcgacctgatcgaccccgccgagatcgacctgctgctgatcagccacttccacctggaccactgcggcgccctgccctggttcctgcagaagaccagcttcaagggcagaaccttcatgacccacgccaccaaggccatctacagatggctgctgagcgactacgtgaaggtgagcaacatcagcgccgacgacatgctgtacaccgagaccgacctggaggagagcatggacaagatcgagaccatcaacttccacgaggtgaaggaggtggccggcatcaagttctggtgctaccacgccggccacgtgctgggcgccgccatgttcatgatcgagatcgccggcgtgaagctgctgtacaccggcgacttcagcagacaggaggacagacacctgatggccgccgagatccccaacatcaagcccgacatcctgatcatcgagagcacctacggcacccacatccacgagaagagagaggagagagaggccagattctgcaacaccgtgcacgacatcgtgaacagaggcggcagaggcctgatccccgtgttcgccctgggcagagcccaggagctgctgctgatcctggacgagtactggcagaaccaccccgagctgcacgacatccccatctactacgccagcagcctggccaagaagtgcatggccgtgtaccagacctacgtgaacgccatgaacgacaagatcagaaagcagatcaacatcaacaaccccttcgtgttcaagcacatcagcaacctgaagagcatggaccacttcgacgacatcggccccagcgtggtgatggccagccccggcatgatgcagagcggcctgagcagagagctgttcgagagctggtgcaccgacaagagaaacggcgtgatcatcgccggctactgcgtggagggcaccctggccaagcacatcatgagcgagcccgaggagatcaccaccatgagcggccagaagctgcccctgaagatgagcgtggactacatcagcttcagcgcccacaccgactaccagcagaccagcgagttcatcagagccctgaagcccccccacgtgatcctggtgcacggcgagcagaacgagatggccagactgaaggccgccctgatcagagagtacgaggacaacgacgaggtgcacatcgaggtgcacaaccccagaaacaccgaggccgtgaccctgaacttcagaggcgagaagctggccaaggtgatgggcttcctggccgacaagaagcccgagcagggccagagagtgagcggcatcctggtgaagagaaacttcaactaccacatcctgagcccctgcgacctgagcaactacaccgacctggccatgagcaccgtgaagcagacccaggccatcccctacaccggccccttcaacctgctgtgctaccagctgcagaagctgaccggcgacgtggaggagctggagatccaggagaagcccgccctgaaggtgttcaagaacatcaccgtgatccaggagcccggcatggtggtgctggagtggctggccaaccccagcaacgacatgtacgccgacaccgtgaccaccgtgatcctggaggtgcagagcaaccccaagatcagaaagggcgccgtgcagaaggtgagcaagaagctggagatgcacgtgtacagcaagagactggagatcatgctgcaggacatcttcggcgaggactgcgtgagcgtgaaggacgacagcatcctgagcgtgaccgtggacggcaagaccgccaacctgaacctggagaccagaaccgtggagtgcgaggagggcagcgaggacgacgagagcctgagagagatggtggagctggccgcccagagactgtacgaggccctgacccccgtgcactag

SEQ ID NO: 7819 - DNA, 1641 bp, Artificial Sequence
  Description of Artificial Sequence: Synthetic coding sequence
atgagcgccatccccgccgaggagagcgaccagctgctgatcagacccctgggcgccggccaggaggtgggcagaagctgcatcatcctggagttcaagggcagaaagatcatgctggactgcggcatccaccccggcctggagggcatggacgccctgccctacatcgacctgatcgaccccgccgagatcgacctgctgctgatcagccacttccacctggaccactgcggcgccctgccctggttcctgcagaagaccagcttcaagggcagaaccttcatgacccacgccaccaaggccatctacagatggctgctgagcgactacgtgaaggtgagcaacatcagcgccgacgacatgctgtacaccgagaccgacctggaggagagcatggacaagatcgagaccatcaacttccacgaggtgaaggaggtggccggcatcaagttctggtgctaccacgccggccacgtgctgggcgccgccatgttcatgatcgagatcgccggcgtgaagctgctgtacaccggcgacttcagcagacaggaggacagacacctgatggccgccgagatccccaacatcaagcccgacatcctgatcatcgagagcacctacggcacccacatccacgagaagagagaggagagagaggccagattctgcaacaccgtgcacgacatcgtgaacagaggcggcagaggcctgatccccgtgttcgccctgggcagagcccaggagctgctgctgatcctggacgagtactggcagaaccaccccgagctgcacgacatccccatctactacgccagcagcctggccaagaagtgcatggccgtgtaccagacctacgtgaacgccatgaacgacaagatcagaaagcagatcaacatcaacaaccccttcgtgttcaagcacatcagcaacctgaagagcatggaccacttcgacgacatcggccccagcgtggtgatggccagccccggcatgatgcagagcggcctgagcagagagctgttcgagagctggtgcaccgacaagagaaacggcgtgatcatcgccggctactgcgtggagggcaccctggccaagatcctggtgcacggcgagcagaacgagatggccagactgaaggccgccctgatcagagagtacgaggacaacgacgaggtgcacatcgaggtgcacaaccccagaaacaccgaggccgtgaccctgaacttcagaggcgagaagctggccaaggtgatgggcttcctggccgacaagaagcccgagcagggccagagagtgagcggcatcctggtgaagagaaacttcaactaccacatcctgagcccctgcgacctgagcaactacaccgacctggccatgagcaccgtgaagcagacccaggccatcccctacaccggccccttcaacctgctgtgctaccagctgcagaagctgaccggcgacgtggaggagctggagatccaggagaagcccgccctgaaggtgttcaagaacatcaccgtgatccaggagcccggcatggtggtgctggagtggctggccaaccccagcaacgacatgtacgccgacaccgtgaccaccgtgatcctggaggtgcagagcaaccccaagatcagaaagtag

SEQ ID NO: 7820 - DNA, 1221 bp, Artificial Sequence
  Description of Artificial Sequence: Synthetic coding sequence
atggccgtgtaccagacctacgtgaacgccatgaacgacaagatcagaaagcagatcaacatcaacaaccccttcgtgttcaagcacatcagcaacctgaagagcatggaccacttcgacgacatcggccccagcgtggtgatggccagccccggcatgatgcagagcggcctgagcagagagctgttcgagagctggtgcaccgacaagagaaacggcgtgatcatcgccggctactgcgtggagggcaccctggccaagcacatcatgagcgagcccgaggagatcaccaccatgagcggccagaagctgcccctgaagatgagcgtggactacatcagcttcagcgcccacaccgactaccagcagaccagcgagttcatcagagccctgaagcccccccacgtgatcctggtgcacggcgagcagaacgagatggccagactgaaggccgccctgatcagagagtacgaggacaacgacgaggtgcacatcgaggtgcacaaccccagaaacaccgaggccgtgaccctgaacttcagaggcgagaagctggccaaggtgatgggcttcctggccgacaagaagcccgagcagggccagagagtgagcggcatcctggtgaagagaaacttcaactaccacatcctgagcccctgcgacctgagcaactacaccgacctggccatgagcaccgtgaagcagacccaggccatcccctacaccggccccttcaacctgctgtgctaccagctgcagaagctgaccggcgacgtggaggagctggagatccaggagaagcccgccctgaaggtgttcaagaacatcaccgtgatccaggagcccggcatggtggtgctggagtggctggccaaccccagcaacgacatgtacgccgacaccgtgaccaccgtgatcctggaggtgcagagcaaccccaagatcagaaagggcgccgtgcagaaggtgagcaagaagctggagatgcacgtgtacagcaagagactggagatcatgctgcaggacatcttcggcgaggactgcgtgagcgtgaaggacgacagcatcctgagcgtgaccgtggacggcaagaccgccaacctgaacctggagaccagaaccgtggagtgcgaggagggcagcgaggacgacgagagcctgagagagatggtggagctggccgcccagagactgtacgaggccctgacccccgtgcactag

SEQ ID NO: 7821 - DNA, 1545 bp, Artificial Sequence
  Description of Artificial Sequence: Synthetic coding sequence
atgggcagacccgagagcgccggcggcggcagcagaggccccttcgagggcggcggcagagccagaagagccggcggcatcttcctgaccctgagcatcctgagaaccagagacctgcccagcggcgccatgagcgagggcgtggacctgatcgacatctacgccgacgaggagttcaaccaggaccccgagttcaacaacaccgaccagatcgacctgtacgacgacgtgctgaccgccaccagccagcccagcgacgacagaagcagcagcaccgagccccccccccccgtgagacaggagcccagccccaagcccaacaacaagacccccgccatcctgtacacctacagcggcctgagaaacagaagagccgccgtgtacgtgggcagcttcagctggtggaccaccgaccagcagctgatccaggtgatcagaagcatcggcgtgtacgacgtggtggagctgaagttcgccgagaacagagccaacggccagagcaagggctacgccgaggtggtggtggccagcgagaacagcgtgcacaagctgctggagctgctgcccggcaaggtgctgaacggcgagaaggtggacgtgagacccgccaccagacagaacctgagccagttcgaggcccaggccagaaagagagagtgcgtgagagtgcccagaggcggcatcccccccagagcccacagcagagacagcagcgacagcgccgacggcagagccacccccagcgagaacctggtgcccagcagcgccagagtggacaagccccccagcgtgctgccctacttcaacagaccccccagcgccctgcccctgatgggcctgccccccccccccatccccccccccccccccctgagcagcagcttcggcgtgcccccccccccccccggcatccactaccagcacctgatgccccccccccccagactgcccccccacctggccgtgcccccccccggcgccatcccccccgccctgcacctgaaccccgccttcttccccccccccaacgccaccgtgggccccccccccgacacctacatgaaggccagcgccccctacaaccaccacggcagcagagacagcggccccccccccagcaccgtgagcgaggccgagttcgaggacatcatgaagagaaacagagccatcagcagcagcgccatcagcaaggccgtgagcggcgccagcgccggcgactacagcgacgccatcgagaccctgctgaccgccatcgccgtgatcaagcagagcagagtggccaacgacgagagatgcagagtgctgatcagcagcctgaaggactgcctgcacggcatcgaggccaagagctacagcgtgggcgccagcggcagcagcagcagaaagagacacagaagcagagagagaagccccagcagaagcagagagagcagcagaagacacagagacctgctgcacaacgaggacagacacgacgactacttccaggagagaaacagagagcacgagagacacagagacagagagagagacagacaccactag

SEQ ID NO: 7822 - DNA, 1416 bp, Artificial Sequence
  Description of Artificial Sequence: Synthetic coding sequence
atgagcgagggcgtggacctgatcgacatctacgccgacgaggagttcaaccaggaccccgagttcaacaacaccgaccagatcgacctgtacgacgacgtgctgaccgccaccagccagcccagcgacgacagaagcagcagcaccgagccccccccccccgtgagacaggagcccagccccaagcccaacaacaagacccccgccatcctgtacacctacagcggcctgagaaacagaagagccgccgtgtacgtgggcagcttcagctggtggaccaccgaccagcagctgatccaggtgatcagaagcatcggcgtgtacgacgtggtggagctgaagttcgccgagaacagagccaacggccagagcaagggctacgccgaggtggtggtggccagcgagaacagcgtgcacaagctgctggagctgctgcccggcaaggtgctgaacggcgagaaggtggacgtgagacccgccaccagacagaacctgagccagttcgaggcccaggccagaaagagagagtgcgtgagagtgcccagaggcggcatcccccccagagcccacagcagagacagcagcgacagcgccgacggcagagccacccccagcgagaacctggtgcccagcagcgccagagtggacaagccccccagcgtgctgccctacttcaacagaccccccagcgccctgcccctgatgggcctgccccccccccccatccccccccccccccccctgagcagcagcttcggcgtgcccccccccccccccggcatccactaccagcacctgatgccccccccccccagactgcccccccacctggccgtgcccccccccggcgccatcccccccgccctgcacctgaaccccgccttcttccccccccccaacgccaccgtgggccccccccccgacacctacatgaaggccagcgccccctacaaccaccacggcagcagagacagcggccccccccccagcaccgtgagcgaggccgagttcgaggacatcatgaagagaaacagagccatcagcagcagcgccatcagcaaggccgtgagcggcgccagcgccggcgactacagcgacgccatcgagaccctgctgaccgccatcgccgtgatcaagcagagcagagtggccaacgacgagagatgcagagtgctgatcagcagcctgaaggactgcctgcacggcatcgaggccaagagctacagcgtgggcgccagcggcagcagcagcagaaagagacacagaagcagagagagaagccccagcagaagcagagagagcagcagaagacacagagacctgctgcacaacgaggacagacacgacgactacttccaggagagaaacagagagcacgagagacacagagacagagagagagacagacaccactag

SEQ ID NO: 7823 - DNA, 618 bp, Artificial Sequence
  Description of Artificial Sequence: Synthetic coding sequence
atgagcgagggcgtggacctgatcgacatctacgccgacgaggagttcaaccaggaccccgagttcaacaacaccgaccagatcgacctgtacgacgacgtgctgaccgccaccagccagcccagcgacgacagaagcagcagcaccgagccccccccccccgtgagacaggagcccagccccaagcccaacaacaagacccccgccatcctgtacacctacagcggcctgagaaacagaagagccgccgtgtacgtgggcagcttcagctggtggaccaccgaccagcagctgatccaggtgatcagaagcatcggcgtgtacgacgtggtggagctgaagttcgccgagaacagagccaacggccagagcaagggctacgccgaggtggtggtggccagcgagaacagcgtgcacaagctgctggagctgctgcccggcaaggtgctgaacggcgagaaggtggacgtgagacccgccaccagacagaacctgagccagttcgaggcccaggccagaaagagaatcccccccagagcccacagcagagacagcagcgacagcgccgacggcagagccacccccagcgagaacctggtgcccagcagcgccagatag

SEQ ID NO: 7824 - DNA, 1389 bp, Artificial Sequence
  Description of Artificial Sequence: Synthetic coding sequence
atgagcgagggcgtggacctgatcgacatctacgccgacgaggagttcaaccaggaccccgagttcaacaacaccgaccagatcgacctgtacgacgacgtgctgaccgccaccagccagcccagcgacgacagaagcagcagcaccgagccccccccccccgtgagacaggagcccagccccaagcccaacaacaagacccccgccatcctgtacacctacagcggcctgagaaacagaagagccgccgtgtacgtgggcagcttcagctggtggaccaccgaccagcagctgatccaggtgatcagaagcatcggcgtgtacgacgtggtggagctgaagttcgccgagaacagagccaacggccagagcaagggctacgccgaggtggtggtggccagcgagaacagcgtgcacaagctgctggagctgctgcccggcaaggtgctgaacggcgagaaggtggacgtgagacccgccaccagacagaacctgagccagttcgaggcccaggccagaaagagaatcccccccagagcccacagcagagacagcagcgacagcgccgacggcagagccacccccagcgagaacctggtgcccagcagcgccagagtggacaagccccccagcgtgctgccctacttcaacagaccccccagcgccctgcccctgatgggcctgccccccccccccatccccccccccccccccctgagcagcagcttcggcgtgcccccccccccccccggcatccactaccagcacctgatgccccccccccccagactgcccccccacctggccgtgcccccccccggcgccatcccccccgccctgcacctgaaccccgccttcttccccccccccaacgccaccgtgggccccccccccgacacctacatgaaggccagcgccccctacaaccaccacggcagcagagacagcggccccccccccagcaccgtgagcgaggccgagttcgaggacatcatgaagagaaacagagccatcagcagcagcgccatcagcaaggccgtgagcggcgccagcgccggcgactacagcgacgccatcgagaccctgctgaccgccatcgccgtgatcaagcagagcagagtggccaacgacgagagatgcagagtgctgatcagcagcctgaaggactgcctgcacggcatcgaggccaagagctacagcgtgggcgccagcggcagcagcagcagaaagagacacagaagcagagagagaagccccagcagaagcagagagagcagcagaagacacagagacctgctgcacaacgaggacagacacgacgactacttccaggagagaaacagagagcacgagagacacagagacagagagagagacagacaccactag

SEQ ID NO: 7825 - DNA, 1389 bp, Artificial Sequence; identical to SEQ ID NO: 7824
  Description of Artificial Sequence: Synthetic coding sequence

SEQ ID NO: 7826 - DNA, 435 bp, Artificial Sequence
  Description of Artificial Sequence: Synthetic coding sequence
atgagcgagggcgtggacctgatcgacatctacgccgacgaggagttcaaccaggaccccgagttcaacaacaccgaccagatcgacctgtacgacgacgtgctgaccgccaccagccagcccagcgacgacagaagcagcagcaccgagccccccccccccgtgagacaggagcccagccccaagcccaacaacaagacccccgccatcctgtacacctacagcggcctgagaaacagaagagccgccgtgtacgtgggcagcttcagctggtggaccaccgaccagcagctgatccaggtgatcagaagcatcggcgtgtacgacgtggtggagctgaagttcgccgagaacagagccaacggccagagcaagggctacgccgaggtggtggtggccagcgagaacagcgtgcacaagctgctggagctgtag

SEQ ID NO: 7827 - DNA, 441 bp, Artificial Sequence
  Description of Artificial Sequence: Synthetic coding sequence
atgagcgagggcgtggacctgatcgacatctacgccgacgaggagttcaaccaggaccccgagttcaacaacaccgaccagatcgacctgtacgacgacgtgctgaccgccaccagccagcccagcgacgacagaagcagcagcaccgagccccccccccccgtgagacaggagcccagccccaagcccaacaacaagacccccgccatcctgtacacctacagcggcctgagaaacagaagagccgccgtgtacgtgggcagcttcagctggtggaccaccgaccagcagctgatccaggtgatcagaagcatcggcgtgtacgacgtggtggagctgaagttcgccgagaacagagccaacggccagagcaagggctacgccgaggtggtggtggccagcgagaacagcgtgcacaagctgctggagctgctgccctag

SEQ ID NO: 7828 - DNA, 867 bp, Artificial Sequence
  Description of Artificial Sequence: Synthetic coding sequence
atgagcgagggcgtggacctgatcgacatctacgccgacgaggagttcaaccaggaccccgagttcaacaacaccgaccagatcgacctgtacgacgacgtgctgaccgccaccagccagcccagcgacgacagaagcagcagcaccgagccccccccccccgtgagacaggagcccagccccaagcccaacaacaagacccccgccatcctgtacacctacagcggcctgagaaacagaagagccgccgtgtacgtgggcagcttcagctggtggaccaccgaccagcagctgatccaggtgatcagaagcatcggcgtgtacgacgtggtggagctgaagttcgccgagaacagagccaacggccagagcaagggctacgccgaggtggtggtggccagcgagaacagcgtgcacaagctgctggagctgctgcccggcaaggtgctgaacggcgagaaggtggacgtgagacccgccaccagacagaacctgagccagttcgaggcccaggccagaaagagaatcccccccagagcccacagcagagacagcagcgacagcgccgacggcagagccacccccagcgagaacctggtgcccagcagcgccagagtggacaagccccccagcgtgctgccctacttcaacagaccccccagcgccctgcccctgatgggcctgccccccccccccatccccccccccccccccctgagcagcagcttcggcgtgcccccccccccccccggcatccactaccagcacctgatgccccccccccccagactgcccccccacctggccgtgcccccccccggcgccatcccccccgccctgcacctgaaccccgccttcttcccctag

SEQ ID NO: 7829 - DNA, 3162 bp, Artificial Sequence
  Description of Artificial Sequence: Synthetic coding sequence
atgagcagaagaaagcaggccaagccccagcacatcaacagcgaggaggaccagggcgagcagcagccccagcagcagacccccgagttcgccgacgccgcccccgccgcccccgccgccggcgagctgggcgcccccgtgaaccaccccggcaacgacgaggtggccagcgaggacgaggccaccgtgaagagactgagaagagaggagacccacgtgtgcgagaagtgctgcgccgagttcttcagcatcagcgagttcctggagcacaagaagaactgcaccaagaacccccccgtgctgatcatgaacgacagcgagggccccgtgcccagcgaggacttcagcggcgccgtgctgagccaccagcccaccagccccggcagcaaggactgccacagagagaacggcggcagcagcgaggacatgaaggagaagcccgacgccgagagcgtggtgtacctgaagaccgagaccgccctgccccccaccccccaggacatcagctacctggccaagggcaaggtggccaacaccaacgtgaccctgcaggccctgagaggcaccaaggtggccgtgaaccagagaagcgccgacgccctgcccgcccccgtgcccggcgccaacagcatcccctgggtgctggagcagatcctgtgcctgcagcagcagcagctgcagcagatccagctgaccgagcagatcagaatccaggtgaacatgtgggccagccacgccctgcacagcagcggcgccggcgccgacaccctgaagaccctgggcagccacatgagccagcaggtgagcgccgccgtggccctgctgagccagaaggccggcagccagggcctgagcctggacgccctgaagcaggccaagctgccccacgccaacatccccagcgccaccagcagcctgagccccggcctggcccccttcaccctgaagcccgacggcaccagagtgctgcccaacgtgatgagcagactgcccagcgccctgctgccccaggcccccggcagcgtgctgttccagagccccttcagcaccgtggccctggacaccagcaagaagggcaagggcaagccccccaacatcagcgccgtggacgtgaagcccaaggacgaggccgccctgtacaagcacaagtgcaagtactgcagcaaggtgttcggcaccgacagcagcctgcagatccacctgagaagccacaccggcgagagacccttcgtgtgcagcgtgtgcggccacagattcaccaccaagggcaacctgaaggtgcacttccacagacacccccaggtgaaggccaacccccagctgttcgccgagttccaggacaaggtggccgccggcaacggcatcccctacgccctgagcgtgcccgaccccatcgacgagcccagcctgagcctggacagcaagcccgtgctggtgaccaccagcgtgggcctgccccagaacctgagcagcggcaccaaccccaaggacctgaccggcggcagcctgcccggcgacctgcagcccggccccagccccgagagcgagggcggccccaccctgcccggcgtgggccccaactacaacagccccagagccggcggcttccagggcagcggcacccccgagcccggcagcgagaccctgaagctgcagcagctggtggagaacatcgacaaggccaccaccgaccccaacgagtgcctgatctgccacagagtgctgagctgccagagcagcctgaagatgcactacagaacccacaccggcgagagacccttccagtgcaagatctgcggcagagccttcagcaccaagggcaacctgaagacccacctgggcgtgcacagaaccaacaccagcatcaagacccagcacagctgccccatctgccagaagaagttcaccaacgccgtgatgctgcagcagcacatcagaatgcacatgggcggccagatccccaacacccccctgcccgagaacccctgcgacttcaccggcagcgagcccatgaccgtgggcgagaacggcagcaccggcgccatctgccacgacgacgtgatcgagagcatcgacgtggaggaggtgagcagccaggaggcccccagcagcagcagcaaggtgcccacccccctgcccagcatccacagcgccagccccaccctgggcttcgccatgatggccagcctggacgcccccggcaaggtgggccccgcccccttcaacctgcagagacagggcagcagagagaacggcagcgtggagagcgacggcctgaccaacgacagcagcagcctgatgggcgaccaggagtaccagagcagaagccccgacatcctggagaccaccagcttccaggccctgagccccgccaacagccaggccgagagcatcaagagcaagagccccgacgccggcagcaaggccgagagcagcgagaacagcagaaccgagatggagggcagaagcagcctgcccagcaccttcatcagagccccccccacctacgtgaaggtggaggtgcccggcaccttcgtgggccccagcaccctgagccccggcatgacccccctgctggccgcccagcccagaagacaggccaagcagcacggctgcaccagatgcggcaagaacttcagcagcgccagcgccctgcagatccacgagagaacccacaccggcgagaagcccttcgtgtgcaacatctgcggcagagccttcaccaccaagggcaacctgaaggtgcactacatgacccacggcgccaacaacaacagcgccagaagaggcagaaagctggccatcgagaacaccatggccctgctgggcaccgacggcaagagagtgagcgagatcttccccaaggagatcctggcccccagcgtgaacgtggaccccgtggtgtggaaccagtacaccagcatgctgaacggcggcctggccgtgaagaccaacgagatcagcgtgatccagagcggcggcgtgcccaccctgcccgtgagcctgggcgccaccagcgtggtgaacaacgccaccgtgagcaagatggacggcagccagagcggcatcagcgccgacgtggagaagcccagcgccaccgacggcgtgcccaagcaccagttcccccacttcctggaggagaacaagatcgccgtgagctag

SEQ ID NO: 7830 - DNA, 1038 bp, Artificial Sequence
  Description of Artificial Sequence: Synthetic coding sequence
atgtacagaaccaaggtgggcctgaaggacagacagcagctgtacaagctgatcatcagccagctgctgtacgacggctacatcagcatcgccaacggcctgatcaacgagatcaagccccagagcgtgtgcgcccccagcgagcagctgctgcacctgatcaagctgggcatggagaacgacgacaccgccgtgcagtacgccatcggcagaagcgacaccgtggcccccggcaccggcatcgacctggagttcgacgccgacgtgcagaccatgagccccgaggccagcgagtacgagacctgctacgtgaccagccacaagggcccctgcagagtggccacctacagcagagacggccagctgatcgccaccggcagcgccgacgccagcatcaagatcctggacaccgagagaatgctggccaagagcgccatgcccatcgaggtgatgatgaacgagaccgcccagcagaacatggagaaccaccccgtgatcagaaccctgtacgaccacgtggacgaggtgacctgcctggccttccaccccaccgagcagatcctggccagcggcagcagagactacaccctgaagctgttcgactacagcaagcccagcgccaagagagccttcaagtacatccaggaggccgagatgctgagaagcatcagcttccaccccagcggcgacttcatcctggtgggcacccagcaccccaccctgagactgtacgacatcaacaccttccagtgcttcgtgagctgcaacccccaggaccagcacaccgacgccatctgcagcgtgaactacaacagcagcgccaacatgtacgtgaccggcagcaaggacggctgcatcaagctgtgggacggcgtgagcaacagatgcatcaccaccttcgagaaggcccacgacggcgccgaggtgtgcagcgccatcttcagcaagaacagcaagtacatcctgagcagcggcaaggacagcgtggccaagctgtgggagatcagcaccggcagaaccctggtgagatacacctag

SEQ ID NO: 7831 - DNA, 1257 bp, Artificial Sequence
  Description of Artificial Sequence: Synthetic coding sequence
atgtacagactgatcatcagccagctgctgtacgacggctacatcagcatcgccaacggcctgatcaacgagatcaagccccagagcgtgtgcgcccccagcgagcagctgctgcacctgatcaagctgggcatggagaacgacgacaccgccgtgcagtacgccatcggcagaagcgacaccgtggcccccggcaccggcatcgacctggagttcgacgccgacgtgcagaccatgagccccgaggccagcgagtacgagacctgctacgtgaccagccacaagggcccctgcagagtggccacctacagcagagacggccagctgatcgccaccggcagcgccgacgccagcatcaagatcctggacaccgagagaatgctggccaagagcgccatgcccatcgaggtgatgatgaacgagaccgcccagcagaacatggagaaccaccccgtgatcagaaccctgtacgaccacgtggacgaggtgacctgcctggccttccaccccaccgagcagatcctggccagcggcagcagagactacaccctgaagctgttcgactacagcaagcccagcgccaagagagccttcaagtacatccaggaggccgagatgctgagaagcatcagcttccaccccagcggcgacttcatcctggtgggcacccagcaccccaccctgagactgtacgacatcaacaccttccagtgcttcgtgagctgcaacccccaggaccagcacaccgacgccatctgcagcgtgaactacaacagcagcgccaacatgtacgtgaccggcagcaaggacggctgcatcaagctgtgggacggcgtgagcaacagatgcatcaccaccttcgagaaggcccacgacggcgccgaggtgtgcagcgccatcttcagcaagaacagcaagtacatcctgagcagcggcaaggacagcgtggccaagctgtgggagatcagcaccggcagaaccctggtgagatacaccggcgccggcctgagcggcagacaggtgcacagaacccaggccgtgttcaaccacaccgaggactacgtgctgctgcccgacgagagaaccatcagcctgtgctgctgggacagcagaaccgccgagagaagaaacctgctgagcctgggccacaacaacatcgtgagatgcatcgtgcacagccccaccaaccccggcttcatgacctgcagcgacgacttcagagccagattctggtacagaagaagcaccaccgactag

SEQ ID NO: 7832 - DNA, 429 bp, Artificial Sequence
  Description of Artificial Sequence: Synthetic coding sequence
atgtacagaaccaaggtgggcctgaaggacagacagcagctgtacaagctgatcatcagccagctgctgtacgacggctacatcagcatcgccaacggcctgatcaacgagatcaagccccagagcgtgtgcgcccccagcgagcagctgctgcacctgatcaagctgggcatggagaacgacgacaccgccgtgcagtacgccatcggcagaagcgacaccgtggcccccggcaccggcatcgacctggagttcgacgccgacgtgcagaccatgagccccgaggccagcgagtacgagacctgctacgtgaccagccacaagggcccctgcagagtggccacctacagcagagacggccagctgatcgccaccggcagcgccgacgccagcatcaagatcctggacaccgagagaatgctggcctag

SEQ ID NO: 7833 - DNA, 1038 bp, Artificial Sequence; identical to SEQ ID NO: 7830
  Description of Artificial Sequence: Synthetic coding sequence

SEQ ID NO: 7834 - DNA, 1734 bp, Artificial Sequence
  Description of Artificial Sequence: Synthetic coding sequence
atggccggcctgaccgtgagagaccccgccgtggacagaagcctgagaagcgtgttcgtgggcaacatcccctacgaggccaccgaggagcagctgaaggacatcttcagcgaggtgggccccgtggtgagcttcagactggtgtacgacagagagaccggcaagcccaagggctacggcttctgcgagtaccaggaccaggagaccgccctgagcgccatgagaaacctgaacggcagagagttcagcggcagagccctgagagtggacaacgccgccagcgagaagaacaaggaggagctgaagagcctgggcaccggcgcccccgtgatcgagagcccctacggcgagaccatcagccccgaggacgcccccgagagcatcagcaaggccgtggccagcctgccccccgagcagatgttcgagctgatgaagcagatgaagctgtgcgtgcagaacagcccccaggaggccagaaacatgctgctgcagaacccccagctggcctacgccctgctgcaggcccaggtggtgatgagaatcgtggaccccgagatcgccctgaagatcctgcacagacagaccaacatccccaccctgatcgccggcaacccccagcccgtgcacggcgccggccccggcagcggcagcaacgtgagcatgaaccagcagaacccccaggccccccaggcccagagcctgggcggcatgcacgtgaacggcgccccccccctgatgcaggccagcatgcagggcggcgtgcccgcccccggccagatgcccgccgccgtgaccggccccggccccggcagcctggcccccggcggcggcatgcaggcccaggtgggcatgcccggcagcggccccgtgagcatggagagaggccaggtgcccatgcaggaccccagagccgccatgcagagaggcagcctgcccgccaacgtgcccacccccagaggcctgctgggcgacgcccccaacgaccccagaggcggcaccctgctgagcgtgaccggcgaggtggagcccagaggctacctgggccccccccaccagggcccccccatgcaccacgtgcccggccacgagagcagaggcccccccccccacgagctgagaggcggccccctgcccgagcccagacccctgatggccgagcccagaggccccatgctggaccagagaggcccccccctggacggcagaggcggcagagaccccagaggcatcgacgccagaggcatggaggccagagccatggaggccagaggcctggacgccagaggcctggaggccagagccatggaggccagagccatggaggccagagccatggaggccagagccatggaggccagagccatggaggtgagaggcatggaggccagaggcatggacaccagaggccccgtgcccggccccagaggccccatccccagcggcatgcagggccccagccccatcaacatgggcgccgtggtgccccagggcagcagacaggtgcccgtgatgcagggcaccggcatgcagggcgccagcatccagggcggcagccagcccggcggcttcagccccggccagaaccaggtgaccccccaggaccacgagaaggccgccctgatcatgcaggtgctgcagctgaccgccgaccagatcgccatgctgccccccgagcagagacagagcatcctgatcctgaaggagcagatccagaagagcaccggcgccccctag

SEQ ID NO: 7835 - DNA, 1662 bp, Artificial Sequence
  Description of Artificial Sequence: Synthetic coding sequence
atggccggcctgaccgtgagagaccccgccgtggacagaagcctgagaagcgtgttcgtgggcaacatcccctacgaggccaccgaggagcagctgaaggacatcttcagcgaggtgggccccgtggtgagcttcagactggtgtacgacagagagaccggcaagcccaagggctacggcttctgcgagtaccaggaccaggagaccgccctgagcgccatgagaaacctgaacggcagagagttcagcggcagagccctgagagtggacaacgccgccagcgagaagaacaaggaggagctgaagagcctgggcaccggcgcccccgtgatcgagagcccctacggcgagaccatcagccccgaggacgcccccgagagcatcagcaaggccgtggccagcctgccccccgagcagatgttcgagctgatgaagcagatgaagctgtgcgtgcagaacagcccccaggaggccagaaacatgctgctgcagaacccccagctggcctacgccctgctgcaggcccaggtggtgatgagaatcgtggaccccgagatcgccctgaagatcctgcacagacagaccaacatccccaccctgatcgccggcaacccccaggcccagagcctgggcggcatgcacgtgaacggcgccccccccctgatgcaggccagcatgcagggcggcgtgcccgcccccggccagatgcccgccgccgtgaccggccccggccccggcagcctggcccccggcggcggcatgcaggcccaggtgggcatgcccggcagcggccccgtgagcatggagagaggccaggtgcccatgcaggaccccagagccgccatgcagagaggcagcctgcccgccaacgtgcccacccccagaggcctgctgggcgacgcccccaacgaccccagaggcggcaccctgctgagcgtgaccggcgaggtggagcccagaggctacctgggccccccccaccagggcccccccatgcaccacgtgcccggccacgagagcagaggcccccccccccacgagctgagaggcggccccctgcccgagcccagacccctgatggccgagcccagaggccccatgctggaccagagaggcccccccctggacggcagaggcggcagagaccccagaggcatcgacgccagaggcatggaggccagagccatggaggccagaggcctggacgccagaggcctggaggccagagccatggaggccagagccatggaggccagagccatggaggccagagccatggaggccagagccatggaggtgagaggcatggaggccagaggcatggacaccagaggccccgtgcccggccccagaggccccatccccagcggcatgcagggccccagccccatcaacatgggcgccgtggtgccccagggcagcagacaggtgcccgtgatgcagggcaccggcatgcagggcgccagcatccagggcggcagccagcccggcggcttcagccccggccagaaccaggtgaccccccaggaccacgagaaggccgccctgatcatgcaggtgctgcagctgaccgccgaccagatcgccatgctgccccccgagcagagacagagcatcctgatcctgaaggagcagatccagaagagcaccggcgccccctag

SEQ ID NO: 7836 - DNA, 2154 bp, Artificial Sequence
  Description of Artificial Sequence: Synthetic coding sequence
atgagcggcgacggcgccaccgagcaggccgccgagtacgtgcccgagaaggtgaagaaggccgagaagaagctggaggagaacccctacgacctggacgcctggagcatcctgatcagagaggcccagaaccagcccatcgacaaggccagaaagacctacgagagactggtggcccagttccccagcagcggcagattctggaagctgtacatcgaggccgagatcaaggccaagaactacgacaaggtggagaagctgttccagagatgcctgatgaaggtgctgcacatcgacctgtggaagtgctacctgagctacgtgagagagaccaagggcaagctgcccagctacaaggagaagatggcccaggcctacgacttcgccctggacaagatcggcatggagatcatgagctaccagatctgggtggactacatcaacttcctgaagggcgtggaggccgtgggcagctacgccgagaaccagagaatcaccgccgtgagaagagtgtaccagagaggctgcgtgaaccccatgatcaacatcgagcagctgtggagagactacaacaagtacgaggagggcatcaacatccacctggccaagaagatgatcgaggacagaagcagagactacatgaacgccagaagagtggccaaggagtacgagaccgtgatgaagggcctggacagaaacgcccccagcgtgcccccccagaacaccccccaggaggcccagcaggtggacatgtggaagaagtacatccagtgggagaagagcaaccccctgagaaccgaggaccagaccctgatcaccaagagagtgatgttcgcctacgagcagtgcctgctggtgctgggccaccaccccgacatctggtacgaggccgcccagtacctggagcagagcagcaagctgctggccgagaagggcgacatgaacaacgccaagctgttcagcgacgaggccgccaacatctacgagagagccatcagcaccctgctgaagaagaacatgctgctgtacttcgcctacgccgactacgaggagagcagaatgaagtacgagaaggtgcacagcatctacaacagactgctggccatcgaggacatcgaccccaccctggtgtacatccagtacatgaagttcgccagaagagccgagggcatcaagagcggcagaatgatcttcaagaaggccagagaggacaccagaaccagacaccacgtgtacgtgaccgccgccctgatggagtactactgcagcaaggacaagagcgtggccttcaagatcttcgagctgggcctgaagaagtacggcgacatccccgagtacgtgctggcctacatcgactacctgagccacctgaacgaggacaacaacaccagagtgctgttcgagagagtgctgaccagcggcagcctgccccccgagaagagcggcgagatctgggccagattcctggccttcgagagcaacatcggcgacctggccagcatcctgaaggtggagaagagaagattcaccgccttcaaggaggagtacgagggcaaggagaccgccctgctggtggacagatacaagttcatggacctgtacccctgcagcgccagcgagctgaaggccctgggctacaaggacgtgagcagagccaagctggccgccatcatccccgaccccgtggtggcccccagcatcgtgcccgtgctgaaggacgaggtggacagaaagcccgagtaccccaagcccgacacccagcagatgatccccttccagcccagacacctggccccccccggcctgcaccccgtgcccggcggcgtgttccccgtgccccccgccgccgtggtgctgatgaagctgctgcccccccccatctgcttccagggccccttcgtgcaggtggacgagctgatggagatcttcagaagatgcaagatccccaacaccgtggaggaggccgtgagaatcatcaccggcggcgcccccgagctggccgtggagggcaacggccccgtggagagcaacgccgtgctgaccaaggccgtgaagagacccaacgaggacagcgacgaggacgaggagaagggcgccgtggtgccccccgtgcacgacatctacagagccagacagcagaagagaatcagatag

SEQ ID NO: 7837 - DNA, 135 bp, Artificial Sequence
  Description of Artificial Sequence: Synthetic coding sequence
atgagcggcgacggcgccaccgagcaggccgccgagtacgtgcccgagaaggtgaagaaggccgagaagaagctggaggagaacccctacgacctggacgcctggagcatcctgatcagagaggcccaggtgtag

SEQ ID NO: 7838 - DNA, 312 bp, Artificial Sequence
  Description of Artificial Sequence: Synthetic coding sequence
atgagcggcgacggcgccaccgagcaggccgccgagtacgtgcccgagaaggtgaagaaggccgagaagaagctggaggagaacccctacgacctggacgcctggagcatcctgatcagagaggcccagaaccagcccatcgacaaggccagaaagacctacgagagactggtggcccagttccccagcagcggcagattctggaagctgtacatcgaggccgaggtgaccatcctgttctacttcttcctgtaccagtactgcagcatccactgcagcgacagaaagcaggtgagaaacatcgccaactag

SEQ ID NO: 7839 - DNA, 186 bp, Artificial Sequence
  Description of Artificial Sequence: Synthetic coding sequence
atgagcggcgacggcgccaccgagcaggccgccgagtacgtgcccgagaaggtgaagaaggccgagaagaagctggaggagaacccctacgacctggacgcctggagcatcctgatcagagaggcccagaaccagcccatcgacaaggccagaaagacctacgagagactggtggcccagttctag

SEQ ID NO: 7840 - DNA, 1953 bp, Artificial Sequence
  Description of Artificial Sequence: Synthetic coding sequence
atgaccctgatgctgggcgcccagatcaaggccaagaactacgacaaggtggagaagctgttccagagatgcctgatgaaggtgctgcacatcgacctgtggaagtgctacctgagctacgtgagagagaccaagggcaagctgcccagctacaaggagaagatggcccaggcctacgacttcgccctggacaagatcggcatggagatcatgagctaccagatctgggtggactacatcaacttcctgaagggcgtggaggccgtgggcagctacgccgagaaccagagaatcaccgccgtgagaagagtgtaccagagaggctgcgtgaaccccatgatcaacatcgagcagctgtggagagactacaacaagtacgaggagggcatcaacatccacctggccaagaagatgatcgaggacagaagcagagactacatgaacgccagaagagtggccaaggagtacgagaccgtgatgaagggcctggacagaaacgcccccagcgtgcccccccagaacaccccccaggaggcccagcaggtggacatgtggaagaagtacatccagtgggagaagagcaaccccctgagaaccgaggaccagaccctgatcaccaagagagtgatgttcgcctacgagcagtgcctgctggtgctgggccaccaccccgacatctggtacgaggccgcccagtacctggagcagagcagcaagctgctggccgagaagggcgacatgaacaacgccaagctgttcagcgacgaggccgccaacatctacgagagagccatcagcaccctgctgaagaagaacatgctgctgtacttcgcctacgccgactacgaggagagcagaatgaagtacgagaaggtgcacagcatctacaacagactgctggccatcgaggacatcgaccccaccctggtgtacatccagtacatgaagttcgccagaagagccgagggcatcaagagcggcagaatgatcttcaagaaggccagagaggacaccagaaccagacaccacgtgtacgtgaccgccgccctgatggagtactactgcagcaaggacaagagcgtggccttcaagatcttcgagctgggcctgaagaagtacggcgacatccccgagtacgtgctggcctacatcgactacctgagccacctgaacgaggacaacaacaccagagtgctgttcgagagagtgctgaccagcggcagcctgccccccgagaagagcggcgagatctgggccagattcctggccttcgagagcaacatcggcgacctggccagcatcctgaaggtggagaagagaagattcaccgccttcaaggaggagtacgagggcaaggagaccgccctgctggtggacagatacaagttcatggacctgtacccctgcagcgccagcgagctgaaggccctgggctacaaggacgtgagcagagccaagctggccgccatcatccccgaccccgtggtggcccccagcatcgtgcccgtgctgaaggacgaggtggacagaaagcccgagtaccccaagcccgacacccagcagatgatccccttccagcccagacacctggccccccccggcctgcaccccgtgcccggcggcgtgttccccgtgccccccgccgccgtggtgctgatgaagctgctgcccccccccatctgcttccagggccccttcgtgcaggtggacgagctgatggagatcttcagaagatgcaagatccccaacaccgtggaggaggccgtgagaatcatcaccggcggcgcccccgagctggccgtggagggcaacggccccgtggagagcaacgccgtgctgaccaaggccgtgaagagacccaacgaggacagcgacgaggacgaggagaagggcgccgtggtgccccccgtgcacgacatctacagagccagacagcagaagagaatcagatag

SEQ ID NO: 7841 - DNA, 1740 bp, Artificial Sequence
  Description of Artificial Sequence: Synthetic coding sequence
atgctgagaagcggccccgccagcggccccagcgtgcccaccggcagagccatgcccagcagaagagtggccagaccccccgccgcccccgagctgggcgccctgggcagccccgacctgagcagcctgagcctggccgtgagcagaagcaccgacgagctggagatcatcgacgagtacatcaaggagaacggcttcggcctggacggcggccagcccggccccggcgagggcctgcccagactggtgagcagaggcgccgccagcctgagcaccgtgaccctgggccccgtggccccccccgccaccccccccccctggggctgccccctgggcagactggtgagccccgcccccggccccggcccccagccccacctggtgatcaccgagcagcccaagcagagaggcatgagattcagatacgagtgcgagggcagaagcgccggcagcatcctgggcgagagcagcaccgaggccagcaagaccctgcccgccatcgagctgagagactgcggcggcctgagagaggtggaggtgaccgcctgcctggtgtggaaggactggccccacagagtgcacccccacagcctggtgggcaaggactgcaccgacggcatctgcagagtgagactgagaccccacgtgagccccagacacagcttcaacaacctgggcatccagtgcgtgagaaagaaggagatcgaggccgccatcgagagaaagatccagctgggcatcgacccctacaacgccggcagcctgaagaaccaccaggaggtggacatgaacgtggtgagaatctgcttccaggccagctacagagaccagcagggccagatgagaagaatggaccccgtgctgagcgagcccgtgtacgacaagaagagcaccaacaccagcgagctgagaatctgcagaatcaacaaggagagcggcccctgcaccggcggcgaggagctgtacctgctgtgcgacaaggtgcagaaggaggacatcagcgtggtgttcagcagagccagctgggagggcagagccgacttcagccaggccgacgtgcacagacagatcgccatcgtgttcaagacccccccctacgaggacctggagatcgtggagcccgtgaccgtgaacgtgttcctgcagagactgaccgacggcgtgtgcagcgagcccctgcccttcacctacctgcccagagaccacgacagctacggcgtggacaagaagagaaagagaggcatgcccgacgtgctgggcgagctgaacagcagcgacccccacggcatcgagagcaagagaagaaagaagaagcccgccatcctggaccacttcctgcccaaccacggcagcggccccttcctgccccccagcgccctgctgcccgaccccgacttcttcagcggcaccgtgagcctgcccggcctggagccccccggcggccccgacctgctggacgacggcttcgcctacgaccccaccgcccccaccctgttcaccatgctggacctgctgccccccgcccccccccacgccagcgccgtggtgtgcagcggcggcgccggcgccgtggtgggcgagacccccggccccgagcccctgaccctggacagctaccaggcccccggccccggcgacggcggcaccgccagcctggtgggcagcaacatgttccccaaccactacagagaggccgccttcggcggcggcctgctgagccccggccccgaggccacctag

SEQ ID NO: 7842 - DNA, 1785 bp, Artificial Sequence
  Description of Artificial Sequence: Synthetic coding sequence
atgtggcacgaggccagaaagcacgagagaaagctgagaggcatgatggtggactacaagaagagagccgagagaagaagagagtactacgagaagatcaagaaggaccccgcccagttcctgcaggtgcacggcagagcctgcaaggtgcacctggacagcgccgtggccctggccgccgagagccccgtgaacatgatgccctggcagggcgacaccaacaacatgatcgacagattcgacgtgagagcccacctggaccacatccccgactacaccccccccctgctgaccaccatcagccccgagcaggagagcgacgagagaaagtgcaactacgagagatacagaggcctggtgcagaacgacttcgccggcatcagcgaggagcagtgcctgtaccagatctacatcgacgagctgtacggcggcctgcagagacccagcgaggacgagaagaagaagctggccgagaagaaggccagcatcggctacacctacgaggacagcaccgtggccaaggtggagaaggccgccgagaagcccgaggaggaggagagcgccgccgaggaggagagcaacagcgacgaggacgaggtgatccccgacatcgacgtggaggtggacgtggacgagctgaaccaggagcaggtggccgacctgaacaagcaggccaccacctacggcatggccgacggcgacttcgtgagaatgctgagaaaggacaaggaggaggccgaggccatcaagcacgccaaggccctggaggaggagaaggccatgtacagcggcagaagaagcagaagacagagaagagagttcagagagaagagactgagaggcagaaagatcagcccccccagctacgccagaagagacagccccacctacgacccctacaagagaagccccagcgagagcagcagcgagagcagaagcagaagcagaagccccacccccggcagagaggagaagatcaccttcatcaccagcttcggcggcagcgacgaggaggccgccgccgccgccgccgccgccgccgccagcggcgtgaccaccggcaagccccccgcccccccccagcccggcggccccgcccccggcagaaacgccagcgccagaagaagaagcagcagcagcagcagcagcagcagcgccagcagaaccagcagcagcagaagcagcagcagaagcagcagcagaagcagaagaggcggcggctactacagaagcggcagacacgccagaagcagaagcagaagctggagcagaagcagaagcagaagcagaagatacagcagaagcagaagcagaggcagaagacacagcggcggcggcagcagagacggccacagatacagcagaagccccgccagaagaggcggctacggccccagaagaagaagcagaagcagaagccacagcggcgacagatacagaagaggcggcagaggcctgagacaccacagcagcagcagaagcagaagcagctggagcctgagccccagcagaagcagaagcctgaccagaagcagaagccacagccccagccccagccagagcagaagcagaagcagaagcagaagccagagccccagccccagccccgccagagagaagctgaccagacccgccgccagccccgccgtgggcgagaagctgaagaagaccgagcccgccgccggcaaggagaccggcgccgccaaggtgacccaggccgacgccagcggcgaggccgagaccgaggacgccgagggcgccgagcaggccgtgcagggcggctag

SEQ ID NO: 7843 - DNA, 1839 bp, Artificial Sequence
  Description of Artificial Sequence: Synthetic coding sequence
atgtggcacgaggccagaaagcacgagagaaagctgagaggcatgatggtggactacaagaagagagccgagagaagaagagagtactacgagaagatcaagaaggaccccgcccagttcctgcaggagagcgacgagagaaagtgcaactacgagagatacagaggcctggtgcagaacgacttcgccggcatcagcgaggagcagtgcctgtaccagatctacatcgacgagctgtacggcggcctgcagagacccagcgaggacgagaagaagaagctggccgagaagaaggccagcatcggctacacctacgaggacagcaccgtggccaaggtggagaaggccgccgagaagcccgaggaggaggagagcgccgccgaggaggagagcaacagcgacgaggacgaggtgatccccgacatcgacgtggaggtggacgtggacgagctgaaccaggagcaggtggccgacctgaacaagcaggccaccacctacggcatggccgacggcgacttcgtgagaatgctgagaaaggacaaggaggaggccgaggccatcaagcacgccaaggccctggaggaggagaaggccatgtacagcggcagaagaagcagaagacagagaagagagttcagagagaagagactgagaggcagaaagatcagcccccccagctacgccagaagagacagccccacctacgacccctacaagagaagccccagcgagagcagcagcgagagcagaagcagaagcagaagccccacccccggcagagaggagaagatcaccttcatcaccagcttcggcggcagcgacgaggaggccgccgccgccgccgccgccgccgccgccagcggcgtgaccaccggcaagccccccgcccccccccagcccggcggccccgcccccggcagaaacgccagcgccagaagaagaagcagcagcagcagcagcagcagcagcgccagcagaaccagcagcagcagaagcagcagcagaagcagcagcagaagcagaagaggcggcggctactacagaagcggcagacacgccagaagcagaagcagaagctggagcagaagcagaagcagaagcagaagatacagcagaagcagaagcagaggcagaagacacagcggcggcggcagcagagacggccacagatacagcagaagccccgccagaagaggcggctacggccccagaagaagaagcagaagcagaagccacagcggcgacagatacagaagaggcggcagaggcctgagacaccacagcagcagcagaagcagaagcagctggagcctgagccccagcagaagcagaagcctgaccagaagcagaagccacagccccagccccagccagagcagaagcagaagcagaagcagaagccagagccccagccccagccccgccagagagaagctgaccagacccgccgccagccccgccgtgggcgagaagctgaagaagaccgagcccgccgccggcaaggagaccggcgccgccaagcccaagctgaccccccaggagaagctgaagctgagaatgcagaaggccctgaacagacagttcaaggccgacaagaaggccgcccaggagaagatgatccagcaggagcacgagagacaggagagagaggacgagctgagagccatggccagaaagatcagaatgaaggagagagagagaagagagaaggagagagaggagtgggagagacagtacagcagacagagcagaagccccagccccagatacagcagagagtacagcagcagcagaagaagaagcagaagcagaagcagaagcccccactacagacactag

SEQ ID NO: 7844 - DNA, 1968 bp, Artificial Sequence
  Description of Artificial Sequence: Synthetic coding sequence
atgtggcacgaggccagaaagcacgagagaaagctgagaggcatgatggtggactacaagaagagagccgagagaagaagagagtactacgagaagatcaagaaggaccccgcccagttcctgcaggtgcacggcagagcctgcaaggtgcacctggacagcgccgtggccctggccgccgagagccccgtgaacatgatgccctggcagggcgacaccaacaacatgatcgacagattcgacgtgagagcccacctggaccacatccccgactacaccccccccctgctgaccaccatcagccccgagcaggagagcgacgagagaaagtgcaactacgagagatacagaggcctggtgcagaacgacttcgccggcatcagcgaggagcagtgcctgtaccagatctacatcgacgagctgtacggcggcctgcagagacccagcgaggacgagaagaagaagctggccgagaagaaggccagcatcggctacacctacgaggacagcaccgtggccaaggtggagaaggccgccgagaagcccgaggaggaggagagcgccgccgaggaggagagcaacagcgacgaggacgaggtgatccccgacatcgacgtggaggtggacgtggacgagctgaaccaggagcaggtggccgacctgaacaagcaggccaccacctacggcatggccgacggcgacttcgtgagaatgctgagaaaggacaaggaggaggccgaggccatcaagcacgccaaggccctggaggaggagaaggccatgtacagcggcagaagaagcagaagacagagaagagagttcagagagaagagactgagaggcagaaagatcagcccccccagctacgccagaagagacagccccacctacgacccctacaagagaagccccagcgagagcagcagcgagagcagaagcagaagcagaagccccacccccggcagagaggagaagatcaccttcatcaccagcttcggcggcagcgacgaggaggccgccgccgccgccgccgccgccgccgccagcggcgtgaccaccggcaagccccccgcccccccccagcccggcggccccgcccccggcagaaacgccagcgccagaagaagaagcagcagcagcagcagcagcagcagcgccagcagaaccagcagcagcagaagcagcagcagaagcagcagcagaagcagaagaggcggcggctactacagaagcggcagacacgccagaagcagaagcagaagctggagcagaagcagaagcagaagcagaagatacagcagaagcagaagcagaggcagaagacacagcggcggcggcagcagagacggccacagatacagcagaagccccgccagaagaggcggctacggccccagaagaagaagcagaagcagaagccacagcggcgacagatacagaagaggcggcagaggcctgagacaccacagcagcagcagaagcagaagcagctggagcctgagccccagcagaagcagaagcctgaccagaagcagaagccacagccccagccccagccagagcagaagcagaagcagaagcagaagccagagccccagccccagccccgccagagagaagctgaccagacccgccgccagccccgccgtgggcgagaagctgaagaagaccgagcccgccgccggcaaggagaccggcgccgccaaggtgatcaaggccgacaagaaggccgcccaggagaagatgatccagcaggagcacgagagacaggagagagaggacgagctgagagccatggccagaaagatcagaatgaaggagagagagagaagagagaaggagagagaggagtgggagagacagtacagcagacagagcagaagccccagccccagatacagcagagagtacagcagcagcagaagaagaagcagaagcagaagcagaagcccccactacagacactag

SEQ ID NO: 7845 - DNA, 1242 bp, Artificial Sequence
  Description of Artificial Sequence: Synthetic coding sequence
atgagcttcagagacctgagaaacttcaccgagatgatgagagccctgggctaccccagacacatcagcatggagaacttcagaacccccaacttcggcctggtgagcgaggtgctgctgtggctggtgaagagatacgagccccagaccgacatcccccccgacgtggacaccgagcaggacagagtgttcttcatcaaggccatcgcccagttcatggccaccaaggcccacatcaagctgaacaccaagaagctgtaccaggccgacggctacgccgtgaaggagctgctgaagatcaccagcgtgctgtacaacgccatgaagaccaagggcatggagggcagcgagatcgtggaggaggacgtgaacaagttcaagttcgacctgggcagcaagatcgccgacctgaaggccgccagacagctggccagcgagatcaccagcaagggcgccagcctgtacgacctgctgggcatggaggtggagctgagagagatgagaaccgaggccatcgccagacccctggagatcaacgagaccgagaaggtgatgagaatcgccatcaaggagatcctgacccaggtgcagaagaccaaggacctgctgaacaacgtggccagcgacgaggccaacctggaggccaagatcgagaagagaaagctggagctggagagaaacagaaagagactggagaccctgcagagcgtgagaccctgcttcatggacgagtacgagaagaccgaggaggagctgcagaagcagtacgacacctacctggagaagttccagaacctgacctacctggagcagcagctggaggaccaccacagaatggagcaggagagattcgaggaggccaagaacaccctgtgcctgatccagaacaagctgaaggaggaggagaagagactgctgaagagcggcagcaacgacgacagcgacatcgacatccaggaggacgacgagagcgacagcgagctggaggagagaagactgcccaagccccagaccgccatggagatgctgatgcagggcagacccggcaagagaatcgtgggcaccatgcagggcggcgacagcgacgacaacgaggacagcgaggagagcgagatcgacatggaggacgacgacgacgaggacgacgacctggaggacgagagcatcagcctgagccccaccaagcccaacagaagagtgagaaagagcgagcccctggacgagagcgacaacgacttctag

SEQ ID NO: 7846 - DNA, 744 bp, Artificial Sequence
  Description of Artificial Sequence: Synthetic coding sequence
atgagaaccgaggccatcgccagacccctggagatcaacgagaccgagaaggtgatgagaatcgccatcaaggagatcctgacccaggtgcagaagaccaaggacctgctgaacaacgtggccagcgacgaggccaacctggaggccaagatcgagaagagaaagctggagctggagagaaacagaaagagactggagaccctgcagagcgtgagaccctgcttcatggacgagtacgagaagaccgaggaggagctgcagaagcagtacgacacctacctggagaagttccagaacctgacctacctggagcagcagctggaggaccaccacagaatggagcaggagagattcgaggaggccaagaacaccctgtgcctgatccagaacaagctgaaggaggaggagaagagactgctgaagagcggcagcaacgacgacagcgacatcgacatccaggaggacgacgagagcgacagcgagctggaggagagaagactgcccaagccccagaccgccatggagatgctgatgcagggcagacccggcaagagaatcgtgggcaccatgcagggcggcgacagcgacgacaacgaggacagcgaggagagcgagatcgacatggaggacgacgacgacgaggacgacgacctggaggacgagagcatcagcctgagccccaccaagcccaacagaagagtgagaaagagcgagcccctggacgagagcgacaacgacttctag

SEQ ID NO: 7847 - DNA, 576 bp, Artificial Sequence
  Description of Artificial Sequence: Synthetic coding sequence
atggacgagtacgagaagaccgaggaggagctgcagaagcagtacgacacctacctggagaagttccagaacctgacctacctggagcagcagctggaggaccaccacagaatggagcaggagagattcgaggaggccaagaacaccctgtgcctgatccagaacaagctgaaggaggaggagaagagactgctgaagagcggcagcaacgacgacagcgacatcgacatccaggaggacgacgagagcgacagcgagctggaggagagaagactgcccaagccccagaccgccatggagatgctgatgcagggcagacccggcaagagaatcgtgggcaccatgcagggcggcgacagcgacgacaacatggaggccgcccccgccctgctgggcaagtgcaagaccagcagcagcaagaagcaggaggacagcgaggagagcgagatcgacatggaggacgacgacgacgaggacgacgacctggaggacgagagcatcagcctgagccccaccaagcccaacagaagagtgagaaagagcgagcccctggacgagagcgacaacgacttctag

SEQ ID NO: 7848 - DNA, 1242 bp, Artificial Sequence; identical to SEQ ID NO: 7845
  Description of Artificial Sequence: Synthetic coding sequence

SEQ ID NO: 7849 - DNA, 1116 bp, Artificial Sequence
  Description of Artificial Sequence: Synthetic coding sequence
atggccgccgccgccgccggcctgggcggcggcggcgccggccccggccccgaggccggcgacttcctggccagatacagactggtgagcaacaagctgaagaagagattcctgagaaagcccaacgtggccgaggccggcgagcagttcggccagctgggcagagagctgagagcccaggagtgcctgccctacgccgcctggtgccagctggccgtggccagatgccagcaggccctgttccacggccccggcgaggccctggccctgaccgaggccgccagactgttcctgagacaggagagagacgccagacagagactggtgtgccccgccgcctacggcgagcccctgcaggccgccgccagcgccctgggcgccgccgtgagactgcacctggagctgggccagcccgccgccgccgccgccctgtgcctggagctggccgccgccctgagagacctgggccagcccgccgccgccgccggccacttccagagagccgcccagctgcagctgccccagctgcccctggccgccctgcaggccctgggcgaggccgccagctgccagctgctggccagagactacaccggcgccctggccgtgttcaccagaatgcagagactggccagagagcacggcagccaccccgtgcagagcctgccccccccccccccccccgccccccagcccggccccggcgccacccccgccctgcccgccgccctgctgccccccaacagcggcagcgccgcccccagccccgccgccctgggcgccttcagcgacgtgctggtgagatgcgaggtgagcagagtgctgctgctgctgctgctgcagcccccccccgccaagctgctgcccgagcacgcccagaccctggagaagtacagctgggaggccttcgacagccacggccaggagagcagcggccagctgcccgaggagctgttcctgctgctgcagagcctggtgatggccacccacgagaaggacaccgaggccatcaagagcctgcaggtggagatgtggcccctgctgaccgccgagcagaaccacctgctgcacctggtgctgcaggagaccatcagccccagcggccagggcgtgtag

SEQ ID NO: 7850 - DNA, 1116 bp, Artificial Sequence; identical to SEQ ID NO: 7849
  Description of Artificial Sequence: Synthetic coding sequence

SEQ ID NO: 7851 - DNA, 1116 bp, Artificial Sequence; identical to SEQ ID NO: 7849
  Description of Artificial Sequence: Synthetic coding sequence

SEQ ID NO: 7852 - DNA, 2502 bp, Artificial Sequence
  Description of Artificial Sequence: Synthetic coding sequence
atgagccccgagaagcagcacagagaggaggacgaggtggacagcgtgctgctgagcgccagcaagatcctgaacagcagcgagggcgtgaaggagagcggctgcagcgacaccgagtacggctgcatcgccgagagcgagaaccagatccagccccagagcgccctgaaggtgctgcagcagcagctggagagcttccaggccctgagaatgcagaccctgcagaacgtgagcatggtgcagagcgagatcagcgagatcctgaacaagagcatcatcgaggtggagaacccccagttcagcagcgagaagaacctggtgttcggcaccagaatcgagaaggacctgcccaccgagaaccaggaggagaacctgagcatggagaagagccaccacttcgaggacagcaagaccctgcacagcgtggaggagaagctgagcggcgacagcgtgaacagcctgccccagagcgtgaacgtgcccagccagatccacagcgaggacaccctgaccctgagaaccagcaccgacaacctgagcagcaacatcatcatccaccccagcgagaacagcgacatcctgaagaactacaacaacttctacagattcctgcccaccgccccccccaacgtgatgagccaggccgacaccgtgatcctggacaagagcaagatcaccgtgcccttcctgaagcacggcttctgcgagaacctggacgacatctgccacagcatcaagcagatgaaggaggagctgcagaagagccacgacggcgaggtggccctgaccaacgagctgcagaccctgcagaccgaccccgacgtgcacagaaacggcaagtacgacatgagccccatccaccaggacaagatgaacttcatcaaggaggagaacctggacggcaacctgaacgaggacatcaagagcaagagaatcagcgagctggaggccctggtgaagaagctgctgcccttcagagagaccgtgagcaagttccacgtgcacttctgcagaaagtgcaagaagctgagcaagagcgagatgcacagaggcaagaagaacgagaagaacaacaaggagatccccatcaccggcaagaacatcaccgacctgaagttccacagcagagtgcccagatacaccctgagcttcctggaccagaccaagcacgagatgaaggacaaggagagacagcccttcctggtgaagcagggcagcatcatcagcgagaacgagaagaccagcaaggtgaacagcgtgaccgagcagtgcgtggccaagatccagtacctgcagaactacctgaaggagagcgtgcagatccagaagaaggtgatggagctggagagcgagaacctgaacctgaagagcaagatgaagcccctgatcttcaccacccagagcctgatccagaaggtggagacctacgagaagcagctgaagaacctggtggaggagaagagcaccatccagagcaagctgagcaagaccgaggagtacagcaaggagtgcctgaaggagttcaagaagatcatcagcaagtacaacgtgctgcagggccagaacaagaccctggaggagaagaacatccagctgagcctggagaagcagcagatgatggaggccctggaccagctgaagagcaaggagcacaagacccagagcgacatggccatcgtgaacaacgagaacaacagaatgagcatcgagatggaggccatgaagaccaacatcctgctgatccaggacgagaaggagatgctggagaagaagacccaccagctgctgaaggagaagagcagcctgggcaacgagctgaaggagagccagctggagatcatccagctgaaggagaaggagagactggccaagaccgagcaggagaccctgctgcagatcatcgagaccgtgaaggacgagaagctgaacctggagaccaccctgcaggagagcaccgccgccagacagatcatggagagagagatcgagaacatccagacctaccagagcaccgccgaggagaacttcctgcaggagatcaagaacgccaagagcgaggccagcatctacaagaacagcctgagcgagatcggcaaggagtgcgagatgctgagcaagatggtgatggagaccaagaccgacaaccagatcctgaaggaggagctgaagaagcacagccaggagaacatcaagttcgagaacagcatcagcagactgaccgaggacaagatcctgctggagaactacgtgagaagcatcgagaacgagagagacaccctggagttcgagatgagacacctgcagagagagtacctgagcctgagcgacaagatctgcaaccagcacaacgaccccagcaagaccacctacatcagcagaagagagaagttccacttcgacaactacacccacgaggacaccagcagcccccagagcagacccctggccagcgacctgaagggctacttcaaggtgaaggacagaaccctgaagcaccactag

SEQ ID NO: 7853 - DNA, 2391 bp, Artificial Sequence
  Description of Artificial Sequence: Synthetic coding sequence
atgagccccgagaagcagcacagagaggaggacgaggtggacagcgtgctgctgagcgccagcaagatcctgaacagcagcgagggcgtgaaggagagcggctgcagcgacaccgagtacggctgcatcgccgagagcgagaaccagatccagccccagagcgccctgaaggtgctgcagcagcagctggagagcttccaggccctgagaatgcagaccctgcagaacgtgagcatgcccaccgagaaccaggaggagaacctgagcatggagaagagccaccacttcgaggacagcaagaccctgcacagcgtggaggagaagctgagcggcgacagcgtgaacagcctgccccagagcgtgaacgtgcccagccagatccacagcgaggacaccctgaccctgagaaccagcaccgacaacctgagcagcaacatcatcatccaccccagcgagaacagcgacatcctgaagaactacaacaacttctacagattcctgcccaccgccccccccaacgtgatgagccaggccgacaccgtgatcctggacaagagcaagatcaccgtgcccttcctgaagcacggcttctgcgagaacctggacgacatctgccacagcatcaagcagatgaaggaggagctgcagaagagccacgacggcgaggtggccctgaccaacgagctgcagaccctgcagaccgaccccgacgtgcacagaaacggcaagtacgacatgagccccatccaccaggacaagatgaacttcatcaaggaggagaacctggacggcaacctgaacgaggacatcaagagcaagagaatcagcgagctggaggccctggtgaagaagctgctgcccttcagagagaccgtgagcaagttccacgtgcacttctgcagaaagtgcaagaagctgagcaagagcgagatgcacagaggcaagaagaacgagaagaacaacaaggagatccccatcaccggcaagaacatcaccgacctgaagttccacagcagagtgcccagatacaccctgagcttcctggaccagaccaagcacgagatgaaggacaaggagagacagcccttcctggtgaagcagggcagcatcatcagcgagaacgagaagaccagcaaggtgaacagcgtgaccgagcagtgcgtggccaagatccagtacctgcagaactacctgaaggagagcgtgcagatccagaagaaggtgatggagctggagagcgagaacctgaacctgaagagcaagatgaagcccctgatcttcaccacccagagcctgatccagaaggtggagacctacgagaagcagctgaagaacctggtggaggagaagagcaccatccagagcaagctgagcaagaccgaggagtacagcaaggagtgcctgaaggagttcaagaagatcatcagcaagtacaacgtgctgcagggccagaacaagaccctggaggagaagaacatccagctgagcctggagaagcagcagatgatggaggccctggaccagctgaagagcaaggagcacaagacccagagcgacatggccatcgtgaacaacgagaacaacagaatgagcatcgagatggaggccatgaagaccaacatcctgctgatccaggacgagaaggagatgctggagaagaagacccaccagctgctgaaggagaagagcagcctgggcaacgagctgaaggagagccagctggagatcatccagctgaaggagaaggagagactggccaagaccgagcaggagaccctgctgcagatcatcgagaccgtgaaggacgagaagctgaacctggagaccaccctgcaggagagcaccgccgccagacagatcatggagagagagatcgagaacatccagacctaccagagcaccgccgaggagaacttcctgcaggagatcaagaacgccaagagcgaggccagcatctacaagaacagcctgagcgagatcggcaaggagtgcgagatgctgagcaagatggtgatggagaccaagaccgacaaccagatcctgaaggaggagctgaagaagcacagccaggagaacatcaagttcgagaacagcatcagcagactgaccgaggacaagatcctgctggagaactacgtgagaagcatcgagaacgagagagacaccctggagttcgagatgagacacctgcagagagagtacctgagcctgagcgacaagatctgcaaccagcacaacgaccccagcaagaccacctacatcagcagaagagagaagttccacttcgacaactacacccacgaggacaccagcagcccccagagcagacccctggccagcgacctgaagggctacttcaaggtgaaggacagaaccctgaagcaccactag

SEQ ID NO: 7854 - DNA, 726 bp, Artificial Sequence
  Description of Artificial Sequence: Synthetic coding sequence
atggcccccgtgagaagaagcgccaagtggagacccggcggcatcgaggccagaggcgagggcgtgagcaccgtgggctacagaaacaagaacgtgagacagaagacctggagacccaaccacccccaggccttcgtgggcagcgtgagagagggccagggcttcgccttcagaagaaagctgaagatccagcagagctacaagaagctgctgagaaaggagaagaaggcccagaccagcctggagagccagttcaccgacagataccccgacaacctgaagcacctgtacctggccgaggaggagagacacagaaagcaggccagaaaggtggaccaccccctgagcgagcaggtgcaccagcccctgctggaggagcagtgcagcatcgacgagcccctgttcgaggaccagtgcagcttcgaccagccccagcccgaggagcagtgcatcaagaccgtgaacagcttcaccatccccaagaagaacaagaagaagaccagcaaccagaaggcccaggaggagtacgagcagatccaggccaagagagccgccaagaagcaggagttcgagagaagaaagcaggagagagaggaggcccagagacagtacaagaagaagaagatggaggtgttcaagatcctgaacaagaagaccaagaagggccagcccaacctgaacgtgcagatggagtacctgctgcagaagatccaggagaagtgctag

SEQ ID NO: 7855 - DNA, 888 bp, Artificial Sequence
  Description of Artificial Sequence: Synthetic coding sequence
atggagcaccagctgctgtgctgcgaggtggagaccatcagaagagcctaccccgacgccaacctgctgaacgacagagtgctgagagccatgctgaaggccgaggagacctgcgcccccagcgtgagctacttcaagtgcgtgcagaaggaggtgctgcccagcatgagaaagatcgtggccacctggatgctggaggtgtgcgaggagcagaagtgcgaggaggaggtgttccccctggccatgaactacctggacagattcctgagcctggagcccgtgaagaagagcagactgcagctgctgggcgccacctgcatgttcgtggccagcaagatgaaggagaccatccccctgaccgccgagaagctgtgcatctacaccgacaacagcatcagacccgaggagctgctgcagatggagctgctgctggtgaacaagctgaagtggaacctggccgccatgaccccccacgacttcatcgagcacttcctgagcaagatgcccgaggccgaggagaacaagcagatcatcagaaagcacgcccagaccttcgtggccctgtgcgccaccgacgtgaagttcatcagcaacccccccagcatggtggccgccggcagcgtggtggccgccgtgcagggcctgaacctgagaagccccaacaacttcctgagctactacagactgaccagattcctgagcagagtgatcaagtgcgaccccgactgcctgagagcctgccaggagcagatcgaggccctgctggagagcagcctgagacaggcccagcagaacatggaccccaaggccgccgaggaggaggaggaggaggaggaggaggtggacctggcctgcacccccaccgacgtgagagacgtggacatctag

SEQ ID NO: 7856 - DNA, 492 bp, Artificial Sequence
  Description of Artificial Sequence: Synthetic coding sequence
atggacacccccctgagaagaagcagaagactgggcggcctgagacccgagagccccgagagcctgaccagcgtgagcagaaccagaagagccctggtggagttcgagagcaaccccgaggagaccagagagcccggcagcccccccagcgtgcagagagccggcctgggcagccccgagagaccccccaagaccagccccggcagccccagactgcagcagggcgccggcctggagagcccccagggccagcccgagcccggcgccgccagcccccagagacagcaggacctgcacctggagagcccccagaacaaggaggagctgacccccggcgccccccagcaccagctgccccccgtgcccggcagccccgagccctaccccggccagcaggccaccagcagctggggcgacggcgacagaagactgagaggcaaggaggccaagagattcttcatccccggccccagcgtgcaggaggtggagtag

SEQ ID NO: 7857 - DNA, 315 bp, Artificial Sequence
  Description of Artificial Sequence: Synthetic coding sequence
atgctgcaggacaagcccctgagaaccagctggcagagaaagatgaaggagagacaggagagaaagctggccaaggacttcgccagacacctggaggaggagaaggagagaagaagacaggagaagaagcagagaagagccgagaacctgaagagaagactggagaacgagagaaaggccgaggtggtgcaggtgatcagaaaccccgccaagctgaagagagccaagaagaagcagctgagaagcatcgagaagagagacaccctggccctgctgcagaagcagcccccccagcagcccgccgccaagatctag

SEQ ID NO: 7858 - DNA, 819 bp, Artificial Sequence
  Description of Artificial Sequence: Synthetic coding sequence
atggaggaggaggccatcgccagcctgcccggcgaggagaccgaggacatggacttcctgagcggcctggagctggccgacctgctggaccccagacagcccgactggcacctggaccccggcctgagcagccccggccccctgagcagcagcggcggcggcagcgacagcggcggcctgtggagaggcgacgacgacgacgaggccgccgccgccgagatgcagagattcagcgacctgctgcagagactgctgaacggcatcggcggctgcagcagcagcagcgacagcggcagcgccgagaagagaagaagaaagagccccggcggcggcggcggcggcggcagcggcaacgacaacaaccaggccgccaccaagagccccagaaaggccgccgccgccgccgccagactgaacagactgaagaagaaggagtacgtgatgggcctggagagcagagtgagaggcctggccgccgagaaccaggagctgagagccgagaacagagagctgggcaagagagtgcaggccctgcaggaggagagcagatacctgagagccgtgctggccaacgagaccggcctggccagactgctgagcagactgagcggcgtgggcctgagactgaccaccagcctgttcagagacagccccgccggcgaccacgactacgccctgcccgtgggcaagcagaagcaggacctgctggaggaggacgacagcgccggcggcgtgtgcctgcacgtggacaaggacaaggtgagcgtggagttctgcagcgcctgcgccagaaaggccagcagcagcctgaagatgtag

SEQ ID NO: 7859 - DNA, 1065 bp, Artificial Sequence
  Description of Artificial Sequence: Synthetic coding sequence
atgagacacagcctgaccaagctgctggccgccagcggcagcaacagccccaccagaagcgagagccccgagcccgccgccacctgcagcctgcccagcgacctgaccagagccgccgccggcgaggaggagaccgccgccgccggcagccccggcagaaagcagcagttcggcgacgagggcgagctggaggccggcagaggcagcagaggcggcgtggccgtgagagcccccagccccgaggagatggaggaggaggccatcgccagcctgcccggcgaggagaccgaggacatggacttcctgagcggcctggagctggccgacctgctggaccccagacagcccgactggcacctggaccccggcctgagcagccccggccccctgagcagcagcggcggcggcagcgacagcggcggcctgtggagaggcgacgacgacgacgaggccgccgccgccgagatgcagagattcagcgacctgctgcagagactgctgaacggcatcggcggctgcagcagcagcagcgacagcggcagcgccgagaagagaagaagaaagagccccggcggcggcggcggcggcggcagcggcaacgacaacaaccaggccgccaccaagagccccagaaaggccgccgccgccgccgccagactgaacagactgaagaagaaggagtacgtgatgggcctggagagcagagtgagaggcctggccgccgagaaccaggagctgagagccgagaacagagagctgggcaagagagtgcaggccctgcaggaggagagcagatacctgagagccgtgctggccaacgagaccggcctggccagactgctgagcagactgagcggcgtgggcctgagactgaccaccagcctgttcagagacagccccgccggcgaccacgactacgccctgcccgtgggcaagcagaagcaggacctgctggaggaggacgacagcgccggcggcgtgtgcctgcacgtggacaaggacaaggtgagcgtggagttctgcagcgcctgcgccagaaaggccagcagcagcctgaagatgtag

SEQ ID NO: 7860 - DNA, 1065 bp, Artificial Sequence; identical to SEQ ID NO: 7859
  Description of Artificial Sequence: Synthetic coding sequence

SEQ ID NO: 7861 - DNA, 816 bp, Artificial Sequence
  Description of Artificial Sequence: Synthetic coding sequence
atggagcacggcagcatcatcacccaggccagaagagaggacgccctggtgctgaccaagcagggcctggtgagcaagagcagccccaagaagcccagaggcagaaacatcttcaaggccctgttctgctgcttcagagcccagcacgtgggccagagcagcagcagcaccgagctggccgcctacaaggaggaggccaacaccatcgccaagagcgacctgctgcagtgcctgcagtaccagttctaccagatccccggcacctgcctgctgcccgaggtgaccgaggaggaccagggcagaatctgcgtggtgatcgacctggacgagaccctggtgcacagcagcttcaagcccatcaacaacgccgacttcatcgtgcccatcgagatcgagggcaccacccaccaggtgtacgtgctgaagagaccctacgtggacgagttcctgagaagaatgggcgagctgttcgagtgcgtgctgttcaccgccagcctggccaagtacgccgaccccgtgaccgacctgctggacagatgcggcgtgttcagagccagactgttcagagagagctgcgtgttccaccagggctgctacgtgaaggacctgagcagactgggcagagacctgagaaagaccctgatcctggacaacagccccgccagctacatcttccaccccgagaacgccgtgcccgtgcagagctggttcgacgacatggccgacaccgagctgctgaacctgatccccatcttcgaggagctgagcggcgccgaggacgtgtacaccagcctgggccagctgagagccccctag

SEQ ID NO: 7862 - DNA, 831 bp, Artificial Sequence
  Description of Artificial Sequence: Synthetic coding sequence
atggacggccccgccatcatcacccaggtgaccaaccccaaggaggacgagggcagactgcccggcgccggcgagaaggccagccagtgcaacgtgagcctgaagaagcagagaagcagaagcatcctgagcagcttcttctgctgcttcagagactacaacgtggaggcccccccccccagcagccccagcgtgctgccccccctggtggaggagaacggcggcctgcagaagggcgaccagagacaggtgatccccatccccagcccccccgccaagtacctgctgcccgaggtgaccgtgctggactacggcaagaagtgcgtggtgatcgacctggacgagaccctggtgcacagcagcttcaagcccatcagcaacgccgacttcatcgtgcccgtggagatcgacggcaccatccaccaggtgtacgtgctgaagagaccccacgtggacgagttcctgcagagaatgggccagctgttcgagtgcgtgctgttcaccgccagcctggccaagtacgccgaccccgtggccgacctgctggacagatggggcgtgttcagagccagactgttcagagagagctgcgtgttccacagaggcaactacgtgaaggacctgagcagactgggcagagagctgagcaaggtgatcatcgtggacaacagccccgccagctacatcttccaccccgagaacgccgtgcccgtgcagagctggttcgacgacatgaccgacaccgagctgctggacctgatccccttcttcgagggcctgagcagagaggacgacgtgtacagcatgctgcacagactgtgcaacagatag

SEQ ID NO: 7863 - DNA, 798 bp, Artificial Sequence
  Description of Artificial Sequence: Synthetic coding sequence
atggacggccccgccatcatcacccaggtgaccaaccccaaggaggacgagggcagactgcccggcgccggcgagaaggccagccagtgcaacgtgagcctgaagaagcagagaagcagaagcatcctgagcagcttcttctgctgcttcagagactacaacgtggaggcccccccccccagcagccccagcgtgctgccccccctggtggaggagaacggcggcctgcagaagccccccgccaagtacctgctgcccgaggtgaccgtgctggactacggcaagaagtgcgtggtgatcgacctggacgagaccctggtgcacagcagcttcaagcccatcagcaacgccgacttcatcgtgcccgtggagatcgacggcaccatccaccaggtgtacgtgctgaagagaccccacgtggacgagttcctgcagagaatgggccagctgttcgagtgcgtgctgttcaccgccagcctggccaagtacgccgaccccgtggccgacctgctggacagatggggcgtgttcagagccagactgttcagagagagctgcgtgttccacagaggcaactacgtgaaggacctgagcagactgggcagagagctgagcaaggtgatcatcgtggacaacagccccgccagctacatcttccaccccgagaacgccgtgcccgtgcagagctggttcgacgacatgaccgacaccgagctgctggacctgatccccttcttcgagggcctgagcagagaggacgacgtgtacagcatgctgcacagactgtgcaacagatag

SEQ ID NO: 7864 - DNA, 3522 bp, Artificial Sequence
  Description of Artificial Sequence: Synthetic coding sequence
atgagcagaggcagcatcgagatccccctgagagacaccgacgaggtgatcgagctggacttcgaccagctgcccgagggcgacgaggtgatcagcatcctgaagcaggagcacacccagctgcacatctggatcgccctggccctggagtactacaagcagggcaagaccgaggagttcgtgaagctgctggaggccgccagaatcgacggcaacctggactacagagaccacgagaaggaccagatgacctgcctggacaccctggccgcctactacgtgcagcaggccagaaaggagaagaacaaggacaacaagaaggacctgatcacccaggccaccctgctgtacaccatggccgacaagatcatcatgtacgaccagaaccacctgctgggcagagcctgcttctgcctgctggagggcgacaagatggaccaggccgacgcccagttccacttcgtgctgaaccagagccccaacaacatccccgccctgctgggcaaggcctgcatcagcttcaacaagaaggactacagaggcgccctggcctactacaagaaggccctgagaaccaaccccggctgccccgccgaggtgagactgggcatgggccactgcttcgtgaagctgaacaagctggagaaggccagactggccttcagcagagccctggagctgaacagcaagtgcgtgggcgccctggtgggcctggccgtgctggagctgaacaacaaggaggccgacagcatcaagaacggcgtgcagctgctgagcagagcctacaccatcgaccccagcaaccccatggtgctgaaccacctggccaaccacttcttcttcaagaaggactacagcaaggtgcagcacctggccctgcacgccttccacaacaccgaggtggaggccatgcaggccgagagctgctaccagctggccagaagcttccacgtgcaggaggactacgaccaggccttccagtactactaccaggccacccagttcgccagcagcagcttcgtgctgcccttcttcggcctgggccagatgtacatctacagaggcgacaaggagaacgccagccagtgcttcgagaaggtgctgaaggcctaccccaacaactacgagaccatgaagatcctgggcagcctgtacgccgccagcgaggaccaggagaagagagacatcgccaagggccacctgaagaaggtgaccgagcagtaccccgacgacgtggaggcctggatcgagctggcccagatcctggagcagaccgacatccagggcgccctgagcgcctacggcaccgccaccagaatcctgcaggagaaggtgcaggccgacgtgccccccgagatcctgaacaacgtgggcgccctgcacttcagactgggcaacctgggcgaggccaagaagtacttcctggccagcctggacagagccaaggccgaggccgagcacgacgagcactactacaacgccatcagcgtgaccaccagctacaacctggccagactgtacgaggccatgtgcgagttccacgaggccgagaagctgtacaagaacatcctgagagagcaccccaactacgtggactgctacctgagactgggcgccatggccagagacaagggcaacttctacgaggccagcgactggttcaaggaggccctgcagatcaaccaggaccaccccgacgcctggagcctgatcggcaacctgcacctggccaagcaggagtggggccccggccagaagaagttcgagagaatcctgaagcagcccagcacccagagcgacacctacagcatgctggccctgggcaacgtgtggctgcagaccctgcaccagcccaccagagacagagagaaggagaagagacaccaggacagagccctggccatctacaagcaggtgctgagaaacgacgccaagaacctgtacgccgccaacggcatcggcgccgtgctggcccacaagggctacttcagagaggccagagacgtgttcgcccaggtgagagaggccaccgccgacatcagcgacgtgtggctgaacctggcccacatctacgtggagcagaagcagtacatcagcgccgtgcagatgtacgagaactgcctgagaaagttctacaagcaccagaacaccgaggtggtgctgtacctggccagagccctgttcaagtgcggcaagctgcaggagtgcaagcagaccctgctgaaggccagacacgtggcccccagcgacaccgtgctgatgttcaacgtggccctggtgctgcagagactggccaccagcgtgctgaaggacgagaagagcaacctgaaggaggtgctgaacgccgtgaaggagctggagctggcccacagatacttcagctacctgagcaaggtgggcgacaagatgagattcgacctggccctggccgccaccgaggccagacagtgcagcgacctgctgagccaggcccagtaccacgtggccagagccagaaagcaggacgaggaggagagagagctgagagccaagcaggagcaggagaaggagctgctgagacagaagctgctgaaggagcaggaggagaagagactgagagagaaggaggagcagaagaagctgctggagcagagagcccagtacgtggagaagaccaagaacatcctgatgttcaccggcgagaccgaggccaccaaggagaagaagagaggcggcggcggcggcagaagaagcaagaagggcggcgagttcgacgagttcgtgaacgacgacaccgacgacgacctgcccatcagcaagaagaagaagagaagaaagggcagcggcagcgagcaggagggcgaggacgaggagggcggcgagagaaagaagaagaagagaagaagacaccccaagggcgaggagggcagcgacgacgacgagaccgagaacggccccaagcccaagaagagaagaccccccaaggccgagaagaagaaggcccccaagcccgagagactgccccccagcatgaagggcaagatcaagagcaaggccatcatcagcagcagcgacgacagcagcgacgaggacaagctgaagatcgccgacgagggccaccccagaaacagcaacagcaacagcgacagcgacgaggacgagcagagaaagaagtgcgccagcagcgagagcgacagcgacgagaaccagaacaagagcggcagcgaggccggcagccccagaagacccagaagacagagaagcgaccaggacagcgacagcgaccagcccagcagaaagagaagacccagcggcagcgagcagagcgacaacgagagcgtgcagagcggcagaagccacagcggcgtgagcgagaacgacagcagacccgccagccccagcgccgagagcgaccacgagagcgagagaggcagcgacaacgagggcagcggccagggcagcggcaacgagagcgagcccgagggcagcaacaacgaggccagcgacagaggcagcgagcacggcagcgacgacagcgactag

SEQ ID NO: 7865 - DNA, 3693 bp, Artificial Sequence
  Description of Artificial Sequence: Synthetic coding sequence
atggccagcgccagctaccacatcagcaacctgctggagaagatgaccagcagcgacaaggacttcagattcatggccaccaacgacctgatgaccgagctgcagaaggacagcatcaagctggacgacgacagcgagagaaaggtggtgaagatgatcctgaagctgctggaggacaagaacggcgaggtgcagaacctggccgtgaagtgcctgggccccctggtgagcaaggtgaaggagtaccaggtggagaccatcgtggacaccctgtgcaccaacatgctgagcgacaaggagcagctgagagacatcagcagcatcggcctgaagaccgtgatcggcgagctgccccccgccagcagcggcagcgccctggccgccaacgtgtgcaagaagatcaccggcagactgaccagcgccatcgccaagcaggaggacgtgagcgtgcagctggaggccctggacatcatggccgacatgctgagcagacagggcggcctgctggtgaacttccaccccagcatcctgacctgcctgctgccccagctgaccagccccagactggccgtgagaaagagaaccatcatcgccctgggccacctggtgatgagctgcggcaacatcgtgttcgtggacctgatcgagcacctgctgagcgagctgagcaagaacgacagcatgagcaccaccagaacctacatccagtgcatcgccgccatcagcagacaggccggccacagaatcggcgagtacctggagaagatcatccccctggtggtgaagttctgcaacgtggacgacgacgagctgagagagtactgcatccaggccttcgagagcttcgtgagaagatgccccaaggaggtgtacccccacgtgagcaccatcatcaacatctgcctgaagtacctgacctacgaccccaactacaactacgacgacgaggacgaggacgagaacgccatggacgccgacggcggcgacgacgacgaccagggcagcgacgacgagtacagcgacgacgacgacatgagctggaaggtgagaagagccgccgccaagtgcctggacgccgtggtgagcaccagacacgagatgctgcccgagttctacaagaccgtgagccccgccctgatcagcagattcaaggagagagaggagaacgtgaaggccgacgtgttccacgcctacctgagcctgctgaagcagaccagacccgtgcagagctggctgtgcgaccccgacgccatggagcagggcgagacccccctgaccatgctgcagagccaggtgcccaacatcgtgaaggccctgcacaagcagatgaaggagaagagcgtgaagaccagacagtgctgcttcaacatgctgaccgagctggtgaacgtgctgcccggcgccctgacccagcacatccccgtgctggtgcccggcatcatcttcagcctgaacgacaagagcagcagcagcaacctgaagatcgacgccctgagctgcctgtacgtgatcctgtgcaaccacagcccccaggtgttccacccccacgtgcaggccctggtgccccccgtggtggcctgcgtgggcgaccccttctacaagatcaccagcgaggccctgctggtgacccagcagctggtgaaggtgatcagacccctggaccagcccagcagcttcgacgccaccccctacatcaaggacctgttcacctgcaccatcaagagactgaaggccgccgacatcgaccaggaggtgaaggagagagccatcagctgcatgggccagatcatctgcaacctgggcgacaacctgggcagcgacctgcccaacaccctgcagatcttcctggagagactgaagaacgagatcaccagactgaccaccgtgaaggccctgaccctgatcgccggcagccccctgaagatcgacctgagacccgtgctgggcgagggcgtgcccatcctggccagcttcctgagaaagaaccagagagccctgaagctgggcaccctgagcgccctggacatcctgatcaagaactacagcgacagcctgaccgccgccatgatcgacgccgtgctggacgagctgccccccctgatcagcgagagcgacatgcacgtgagccagatggccatcagcttcctgaccaccctggccaaggtgtaccccagcagcctgagcaagatcagcggcagcatcctgaacgagctgatcggcctggtgagaagccccctgctgcagggcggcgccctgagcgccatgctggacttcttccaggccctggtggtgaccggcaccaacaacctgggctacatggacctgctgagaatgctgaccggccccgtgtacagccagagcaccgccctgacccacaagcagagctactacagcatcgccaagtgcgtggccgccctgaccagagcctgccccaaggagggccccgccgtggtgggccagttcatccaggacgtgaagaacagcagaagcaccgacagcatcagactgctggccctgctgagcctgggcgaggtgggccaccacatcgacctgagcggccagctggagctgaagagcgtgatcctggaggccttcagcagccccagcgaggaggtgaagagcgccgccagctacgccctgggcagcatcagcgtgggcaacctgcccgagtacctgcccttcgtgctgcaggagatcaccagccagcccaagagacagtacctgctgctgcacagcctgaaggagatcatcagcagcgccagcgtggtgggcctgaagccctacgtggagaacatctgggccctgctgctgaagcactgcgagtgcgccgaggagggcaccagaaacgtggtggccgagtgcctgggcaagctgaccctgatcgaccccgagaccctgctgcccagactgaagggctacctgatcagcggcagcagctacgccagaagcagcgtggtgaccgccgtgaagttcaccatcagcgaccacccccagcccatcgaccccctgctgaagaactgcatcggcgacttcctgaagaccctggaggaccccgacctgaacgtgagaagagtggccctggtgaccttcaacagcgccgcccacaacaagcccagcctgatcagagacctgctggacaccgtgctgccccacctgtacaacgagaccaaggtgagaaaggagctgatcagagaggtggagatgggccccttcaagcacaccgtggacgacggcctggacatcagaaaggccgccttcgagtgcatgtacaccctgctggacagctgcctggacagactggacatcttcgagttcctgaaccacgtggaggacggcctgaaggaccactacgacatcaagatgctgaccttcctgatgctggtgagactgagcaccctgtgccccagcgccgtgctgcagagactggacagactggtggagcccctgagagccacctgcaccaccaaggtgaaggccaacagcgtgaagcaggagttcgagaagcaggacgagctgaagagaagcgccatgagagccgtggccgccctgctgaccatccccgaggccgagaagagccccctgatgagcgagttccagagccagatcagcagcaaccccgagctggccgccatcttcgagagcatccagaaggacagcagcagcaccaacctggagagcatggacaccagctag

SEQ ID NO: 7866 - DNA, 1209 bp, Artificial Sequence
  Description of Artificial Sequence: Synthetic coding sequence
tacgagctggtgagcagacagggcggcctgctggtgaacttccaccccagcatcctgacctgcctgctgccccagctgaccagccccagactggccgtgagaaagagaaccatcatcgccctgggccacctggtgatgagctgcggcaacatcgtgttcgtggacctgatcgagcacctgctgagcgagctgagcaagaacgacagcatgagcaccaccagaacctacatccagtgcatcgccgccatcagcagacaggccggccacagaatcggcgagtacctggagaagatcatccccctggtggtgaagttctgcaacgtggacgacgacgagctgagagagtactgcatccaggccttcgagagcttcgtgagaagatgccccaaggaggtgtacccccacgtgagcaccatcatcaacatctgcctgaagtacctgacctacgaccccaactacaactacgacgacgaggacgaggacgagaacgccatggacgccgacggcggcgacgacgacgaccagggcagcgacgacgagtacagcgacgacgacgacatgagctggaaggtgagaagagccgccgccaagtgcctggacgccgtggtgagcaccagacacgagatgctgcccgagttctacaagaccgtgagccccgccctgatcagcagattcaaggagagagaggagaacgtgaaggccgacgtgttccacgcctacctgagcctgctgaagcagaccagacccgtgcagagctggctgtgcgaccccgacgccatggagcagggcgagacccccctgaccatgctgcagagccaggtgcccaacatcgtgaaggccctgcacaagcagatgaaggagaagagcgtgaagaccagacagtgctgcttcaacatgctgaccgagctggtgaacgtgctgcccggcgccctgacccagcacatccccgtgctggtgcccggcatcatcttcagcctgaacgacaagagcagcagcagcaacctgaagatcgacgccctgagctgcctgtacgtgatcctgtgcaaccacagcccccaggtgttccacccccacgtgcaggccctggtgccccccgtggtggcctgcgtgggcgaccccttctacaagatcaccagcgaggccctgctggtgacccagcagctggtgaaggcccaccacatgcccgaggcccagtggctgagactgtag

SEQ ID NO: 7867 - DNA, 3693 bp, Artificial Sequence; identical to SEQ ID NO: 7865
  Description of Artificial Sequence: Synthetic coding sequence

SEQ ID NO: 7868 - DNA, 3360 bp, Artificial Sequence
  Description of Artificial Sequence: Synthetic coding sequence
atgagcaccgccgccttccacatcagcagcctgctggagaagatgaccagcagcgacaaggacttcagattcatggccaccagcgacctgatgagcgagctgcagaaggacagcatccagctggacgaggacagcgagagaaaggtggtgaagatgctgctgagactgctggaggacaagaacggcgaggtgcagaacctggccgtgaagtggctgggcgtgcccctgggcgccttccacgccagcctgctgcactgcctgctgccccagctgagcagccccagactggccgtgagaaagagagccgtgggcgccctgggccacctggccgccgcctgcagcaccgacctgttcgtggagctggccgaccacctgctggacagactgcccggccccagagtgcccaccagccccaccgccatcagaaccctgatccagtgcctgggcagcgtgggcagacaggccggccacagactgggcgcccacctggacagactggtgcccctggtggaggacttctgcaacctggacgacgacgagctgagagagagctgcctgcaggccttcgaggccttcctgagaaagtgccccaaggagatgggcccccacgtgcccaacgtgaccagcctgtgcctgcagtacatcaagcacgaccccaactacaactacgacagcgacgaggacgaggagcagatggagaccgaggacagcgagttcagcgagcaggagagcgaggacgagtacagcgacgacgacgacatgagctggaaggtgagaagagccgccgccaagtgcatcgccgccctgatcagcagcagacccgacctgctgcccgacttccactgcaccctggcccccgtgctgatcagaagattcaaggagagagaggagaacgtgaaggccgacgtgttcaccgcctacatcgtgctgctgagacagacccagccccccaagggctggctggaggccatggaggagcccacccagaccggcagcaacctgcacatgctgagaggccaggtgcccctggtggtgaaggccctgcagagacagctgaaggacagaagcgtgagagccagacagggctgcttcagcctgctgaccgagctggccggcgtgctgcccggcagcctggccgagcacatgcccgtgctggtgagcggcatcatcttcagcctggccgacagaagcagcagcagcaccatcagaatggacgccctggccttcctgcagggcctgctgggcaccgagcccgccgaggccttccacccccacctgcccatcctgctgccccccgtgatggcctgcgtggccgacagcttctacaagatcgccgccgaggccctggtggtgctgcaggagctggtgagagccctgtggcccctgcacagacccagaatgctggaccccgagccctacgtgggcgagatgagcgccgtgaccctggccagactgagagccaccgacctggaccaggaggtgaaggagagagccatcagctgcatgggccacctggtgggccacctgggcgacagactgggcgacgacctggagcccaccctgctgctgctgctggacagactgagaaacgagatcaccagactgcccgccatcaaggccctgaccctggtggccgtgagccccctgcagctggacctgcagcccatcctggccgaggccctgcacatcctggccagcttcctgagaaagaaccagagagccctgagactggccaccctggccgccctggacgccctggcccagagccagggcctgagcctgccccccagcgccgtgcaggccgtgctggccgagctgcccgccctggtgaacgagagcgacatgcacgtggcccagctggccgtggacttcctggccaccgtgacccaggcccagcccgccagcctggtggaggtgagcggccccgtgctgagcgagctgctgagactgctgagaagccccctgctgcccgccggcgtgctggccgccgccgagggcttcctgcaggccctggtgggcaccagacccccctgcgtggactacgccaagctgatcagcctgctgaccgcccccgtgtacgagcaggccgtggacggcggccccggcctgcacaagcaggtgttccacagcctggccagatgcgtggccgccctgagcgccgcctgcccccaggaggccgccagcaccgccagcagactggtgtgcgacgccagaagcccccacagcagcaccggcgtgaaggtgctggccttcctgagcctggccgaggtgggccaggtggccggccccggccaccagagagagctgaaggccgtgctgctggaggccctgggcagccccagcgaggacgtgagagccgccgccagctacgccctgggcagagtgggcgccggcagcctgcccgacttcctgcccttcctgctggagcagatcgaggccgagcccagaagacagtacctgctgctgcacagcctgagagaggccctgggcgccgcccagcccgacagcctgaagccctacgccgaggacatctgggccctgctgttccagagatgcgagggcgccgaggagggcaccagaggcgtggtggccgagtgcatcggcaagctggtgctggtgaaccccagcttcctgctgcccagactgagaaagcagctggccgccggcagaccccacaccagaagcaccgtgatcaccgccgtgaagttcctgatcagcgaccagccccaccccatcgaccccctgctgaagagcttcatcgccgtgcacaacaagcccagcctggtgagagacctgctggacgacatcctgcccctgctgtaccaggagaccaagatcagaagagacctgatcagagaggtggagatgggccccttcaagcacaccgtggacgacggcctggacgtgagaaaggccgccttcgagtgcatgtacagcctgctggagagctgcctgggccagctggacatctgcgagttcctgaaccacgtggaggacggcctgaaggaccactacgacatcagaatgctgaccttcatcatggtggccagactggccaccctgtgccccgcccccgtgctgcagagagtggacagactgatcgagcccctgagagccacctgcaccgccaaggtgaaggccggcagcgtgaagcaggagttcgagaagcaggacgagctgaagagaagcgccatgagagccgtggccgccctgctgaccatccccgaggtgggcaagagccccatcatggccgacttcagcagccagatcagaagcaaccccgagctggccgccctgttcgagagcatccagaaggacagcgccagcgcccccagcaccgacagcatggagctgagctag

SEQ ID NO: 7869 - DNA, 3711 bp, Artificial Sequence
  Description of Artificial Sequence: Synthetic coding sequence
atgagcaccgccgccttccacatcagcagcctgctggagaagatgaccagcagcgacaaggacttcagattcatggccaccagcgacctgatgagcgagctgcagaaggacagcatccagctggacgaggacagcgagagaaaggtggtgaagatgctgctgagactgctggaggacaagaacggcgaggtgcagaacctggccgtgaagtgcctgggccccctggtggtgaaggtgaaggagtaccaggtggagaccatcgtggacaccctgtgcaccaacatgagaagcgacaaggagcagctgagagacatcgccggcatcggcctgaagaccgtgctgagcgagctgccccccgccgccaccggcagcggcctggccaccaacgtgtgcagaaagatcaccggccagctgaccagcgccatcgcccagcaggaggacgtggccgtgcagctggaggccctggacatcctgagcgacatgctgagcagactgggcgtgcccctgggcgccttccacgccagcctgctgcactgcctgctgccccagctgagcagccccagactggccgtgagaaagagagccgtgggcgccctgggccacctggccgccgcctgcagcaccgacctgttcgtggagctggccgaccacctgctggacagactgcccggccccagagtgcccaccagccccaccgccatcagaaccctgatccagtgcctgggcagcgtgggcagacaggccggccacagactgggcgcccacctggacagactggtgcccctggtggaggacttctgcaacctggacgacgacgagctgagagagagctgcctgcaggccttcgaggccttcctgagaaagtgccccaaggagatgggcccccacgtgcccaacgtgaccagcctgtgcctgcagtacatcaagcacgaccccaactacaactacgacagcgacgaggacgaggagcagatggagaccgaggacagcgagttcagcgagcaggagagcgaggacgagtacagcgacgacgacgacatgagctggaaggtgagaagagccgccgccaagtgcatcgccgccctgatcagcagcagacccgacctgctgcccgacttccactgcaccctggcccccgtgctgatcagaagattcaaggagagagaggagaacgtgaaggccgacgtgttcaccgcctacatcgtgctgctgagacagacccagccccccaagggctggctggaggccatggaggagcccacccagaccggcagcaacctgcacatgctgagaggccaggtgcccctggtggtgaaggccctgcagagacagctgaaggacagaagcgtgagagccagacagggctgcttcagcctgctgaccgagctggccggcgtgctgcccggcagcctggccgagcacatgcccgtgctggtgagcggcatcatcttcagcctggccgacagaagcagcagcagcaccatcagaatggacgccctggccttcctgcagggcctgctgggcaccgagcccgccgaggccttccacccccacctgcccatcctgctgccccccgtgatggcctgcgtggccgacagcttctacaagatcgccgccgaggccctggtggtgctgcaggagctggtgagagccctgtggcccctgcacagacccagaatgctggaccccgagccctacgtgggcgagatgagcgccgtgaccctggccagactgagagccaccgacctggaccaggaggtgaaggagagagccatcagctgcatgggccacctggtgggccacctgggcgacagactgggcgacgacctggagcccaccctgctgctgctgctggacagactgagaaacgagatcaccagactgcccgccatcaaggccctgaccctggtggccgtgagccccctgcagctggacctgcagcccatcctggccgaggccctgcacatcctggccagcttcctgagaaagaaccagagagccctgagactggccaccctggccgccctggacgccctggcccagagccagggcctgagcctgccccccagcgccgtgcaggccgtgctggccgagctgcccgccctggtgaacgagagcgacatgcacgtggcccagctggccgtggacttcctggccaccgtgacccaggcccagcccgccagcctggtggaggtgagcggccccgtgctgagcgagctgctgagactgctgagaagccccctgctgcccgccggcgtgctggccgccgccgagggcttcctgcaggccctggtgggcaccagacccccctgcgtggactacgccaagctgatcagcctgctgaccgcccccgtgtacgagcaggccgtggacggcggccccggcctgcacaagcaggtgttccacagcctggccagatgcgtggccgccctgagcgccgcctgcccccaggaggccgccagcaccgccagcagactggtgtgcgacgccagaagcccccacagcagcaccggcgtgaaggtgctggccttcctgagcctggccgaggtgggccaggtggccggccccggccaccagagagagctgaaggccgtgctgctggaggccctgggcagccccagcgaggacgtgagagccgccgccagctacgccctgggcagagtgggcgccggcagcctgcccgacttcctgcccttcctgctggagcagatcgaggccgagcccagaagacagtacctgctgctgcacagcctgagagaggccctgggcgccgcccagcccgacagcctgaagccctacgccgaggacatctgggccctgctgttccagagatgcgagggcgccgaggagggcaccagaggcgtggtggccgagtgcatcggcaagctggtgctggtgaaccccagcttcctgctgcccagactgagaaagcagctggccgccggcagaccccacaccagaagcaccgtgatcaccgccgtgaagttcctgatcagcgaccagccccaccccatcgaccccctgctgaagagcttcatcggcgagttcatggagagcctgcaggaccccgacctgaacgtgagaagagccaccctggccttcttcaacagcgccgtgcacaacaagcccagcctggtgagagacctgctggacgacatcctgcccctgctgtaccaggagaccaagatcagaagagacctgatcagagaggtggagatgggccccttcaagcacaccgtggacgacggcctggacgtgagaaaggccgccttcgagtgcatgtacagcctgctggagagctgcctgggccagctggacatctgcgagttcctgaaccacgtggaggacggcctgaaggaccactacgacatcagaatgctgaccttcatcatggtggccagactggccaccctgtgccccgcccccgtgctgcagagagtggacagactgatcgagcccctgagagccacctgcaccgccaaggtgaaggccggcagcgtgaagcaggagttcgagaagcaggacgagctgaagagaagcgccatgagagccgtggccgccctgctgaccatccccgaggtgggcaagagccccatcatggccgacttcagcagccagatcagaagcaaccccgagctggccgccctgttcgagagcatccagaaggacagcgccagcgcccccagcaccgacagcatggagctgagctag

SEQ ID NO: 7870 - DNA, 4461 bp, Artificial Sequence
  Description of Artificial Sequence: Synthetic coding sequence
atggccgccaacgtgggcagcatgttccagtactggaagagattcgacctgagaagactgcagaaggagctgaacagcgtggccagcgagctgagcgccagacaggaggagagcgagcacagccacaagcacctgatcgagctgagaagagagttcaagaagaacgtgcccgaggagatcagagagatggtggcccccgtgctgaagagcttccaggccgaggtggtggccctgagcaagagaagccaggaggccgaggccgccttcctgagcgtgtacaagcagctgatcgaggcccccgaccccgtgcccgtgttcgaggccgccagaagcctggacgacagactgcagccccccagcttcgaccccagcggccagcccagaagagacctgcacaccagctggaagagaaaccccgagctgctgagccccaaggagcagagagagggcaccagccccgccggccccaccctgaccgagggcagcagactgcccggcatccccggcaaggccctgctgaccgagaccctgctgcagagaaacgaggccgagaagcagaagggcctgcaggaggtgcagatcaccctggccgccagactgggcgaggccgaggagaagatcaaggtgctgcacagcgccctgaaggccacccaggccgagctgctggagctgagaagaaagtacgacgaggaggccgccagcaaggccgacgaggtgggcctgatcatgaccaacctggagaaggccaaccagagagccgaggccgcccagagagaggtggagagcctgagagagcagctggccagcgtgaacagcagcatcagactggcctgctgcagcccccagggccccagcggcgacaaggtgaacttcaccctgtgcagcggccccagactggaggccgccctggccagcaaggacagagagatcctgagactgctgaaggacgtgcagcacctgcagagcagcctgcaggagctggaggaggccagcgccaaccagatcgccgacctggagagacagctgaccgccaagagcgaggccatcgagaagctggaggagaagctgcaggcccagagcgactacgaggagatcaagaccgagctgagcatcctgaaggccatgaagctggccagcagcacctgcagcctgccccagggcatggccaagcccgaggacagcctgctgatcgccaaggaggccttcttccccacccagaagttcctgctggagaagcccagcctgctggccagccccgaggaggaccccagcgaggacgacagcatcaaggacagcctgggcaccgagcagagctaccccagcccccagcagctgccccccccccccggccccgaggaccccctgagccccagccccggccagcccctgctgggccccagcctgggccccgacggcaccagaaccttcagcctgagccccttccccagcctggccagcggcgagagactgatgatgccccccgccgccttcaagggcgaggccggcggcctgctggtgttcccccccgccttctacggcgccaagccccccaccgcccccgccacccccgcccccggccccgagcccctgggcggccccgagcccgccgacggcggcggcggcggcgccgccggccccggcgccgaggaggagcagctggacaccgccgagatcgccttccaggtgaaggagcagctgctgaagcacaacatcggccagagagtgttcggccactacgtgctgggcctgagccagggcagcgtgagcgagatcctggccagacccaagccctggagaaagctgaccgtgaagggcaaggagcccttcatcaagatgaagcagttcctgagcgacgagcagaacgtgctggccctgagaaccatccaggtgagacagagaggcagcatcacccccagaatcagaacccccgagaccggcagcgacgacgccatcaagagcatcctggagcaggccaagaaggagatcgagagccagaagggcggcgagcccaagaccagcgtggcccccctgagcatcgccaacggcaccacccccgccagcaccagcgaggacgccatcaagagcatcctggagcaggccagaagagagatgcaggcccagcagcaggccctgctggagatggaggtggcccccagaggcagaagcgtgccccccagcccccccgagagacccagcctggccaccgccagccagaacggcgcccccgccctggtgaagcaggaggagggcagcggcggccccgcccaggcccccctgcccgtgctgagccccgccgccttcgtgcagagcatcatcagaaaggtgaagagcgagatcggcgacgccggctacttcgaccaccactgggccagcgacagaggcctgctgagcagaccctacgccagcgtgagccccagcctgagcagcagcagcagcagcggctacagcggccagcccaacggcagagcctggcccagaggcgacgaggcccccgtgccccccgaggacgaggccgccgccggcgccgaggacgagccccccagaaccggcgagctgaaggccgagggcgccaccgccgaggccggcgccagactgccctactaccccgcctacgtgcccagaaccctgaagcccaccgtgccccccctgacccccgagcagtacgagctgtacatgtacagagaggtggacaccctggagctgaccagacaggtgaaggagaagctggccaagaacggcatctgccagagaatcttcggcgagaaggtgctgggcctgagccagggcagcgtgagcgacatgctgagcagacccaagccctggagcaagctgacccagaagggcagagagcccttcatcagaatgcagctgtggctgagcgaccagctgggccaggccgtgggccagcagcccggcgccagccaggccagccccaccgagcccagaagcagccccagccccccccccagccccaccgagcccgagaagagcagccaggagcccctgagcctgagcctggagagcagcaaggagaaccagcagcccgagggcagaagcagcagcagcctgagcggcaagatgtacagcggcagccaggcccccggcggcatccaggagatcgtggccatgagccccgagctggacacctacagcatcaccaagagagtgaaggaggtgctgaccgacaacaacctgggccagagactgttcggcgagagcatcctgggcctgacccagggcagcgtgagcgacctgctgagcagacccaagccctggcacaagctgagcctgaagggcagagagcccttcgtgagaatgcagctgtggctgaacgacccccacaacgtggagaagctgagagacatgaagaagctggagaagaaggcctacctgaagagaagatacggcctgatcagcaccggcagcgacagcgagagccccgccaccagaagcgagtgccccagcccctgcctgcagccccaggacctgagcctgctgcagatcaagaagcccagagtggtgctggcccccgaggagaaggaggccctgagaaaggcctaccagctggagccctaccccagccagcagaccatcgagctgctgagcttccagctgaacctgaagaccaacaccgtgatcaactggttccacaactacagaagcagaatgagaagagagatgctggtggagggcacccaggacgagcccgacctggaccccagcggcggccccggcatcctgccccccggccacagccaccccgaccccaccccccagagccccgacagcgagaccgaggaccagaagcccaccgtgaaggagctggagctgcaggagggccccgaggagaacagcacccccctgaccacccaggacaaggcccaggtgagaatcaagcaggagcagatggaggaggacgccgaggaggaggccggcagccagccccaggacagcggcgagctggacaagggccagggcccccccaaggaggagcaccccgacccccccggcaacgacggcctgcccaaggtggcccccggccccctgctgcccggcggcagcacccccgactgccccagcctgcacccccagcaggagagcgaggccggcgagagactgcaccccgaccccctgagcttcaagagcgccagcgagagcagcagatgcagcctggaggtgagcctgaacagccccagcgccgccagcagccccggcctgatgatgagcgtgagccccgtgcccagcagcagcgcccccatcagccccagcccccccggcgccccccccgccaaggtgcccagcgccagccccaccgccgacatggccggcgccctgcaccccagcgccaaggtgaaccccaacctgcagagaagacacgagaagatggccaacctgaacaacatcatctacagagtggagagagccgccaacagagaggaggccctggagtgggagttctag

SEQ ID NO: 7871 - DNA, 375 bp, Artificial Sequence
  Description of Artificial Sequence: Synthetic coding sequence
atggtggcccccgtgctgaagagcttccaggccgaggtggtggccctgagcaagagaagccaggaggccgaggccgccttcctgagcgtgtacaagcagctgatcgaggcccccgaccccgtgcccgtgttcgaggccgccagaagcctggacgacagactgcagccccccagcttcgaccccagcggccagcccagaagagacctgcacaccagctggaagagaaaccccgagctgctgagccccaaggagcagagagagggcaccagccccgccggccccaccctgaccgagggcagcagactgcccggcatccccggcaaggccctgctgaccgagaccctgctgcagagaaacgaggccgagaagcagtag

SEQ ID NO: 7872 - DNA, 2727 bp, Artificial Sequence
  Description of Artificial Sequence: Synthetic coding sequence
atgaagagcagcgtggcccagatcaagcccagcagcggccacgacagaagagagaacctgaacagctaccagagaaacagcagccccgaggacagatacgaggagcaggagagaagccccagagacagagactacttcgactacagcagaagcgactacgagcacagcagaagaggcagaagctacgacagcagcatggagagcagaaacagagacagagagaagagaagagagagagagagagacaccgacagaaagagaagcagaaagagccccagccccggcagaagaaaccccgagaccagcgtgacccagagcagcagcgcccaggacgagcccgccaccaagaagaagaaggacgagctggaccccctgctgaccagaaccggcggcgcctacatcccccccgccaagctgagaatgatgcaggagcagatcaccgacaagaacagcctggcctaccagagaatgagctgggaggccctgaagaagagcatcaacggcctgatcaacaaggtgaacatcagcaacatcagcatcatcatccaggagctgctgcaggagaacatcgtgagagacagaggcctgctgagcagaagcgtgctgcaggcccagagcgccagccccatcttcacccacgtgtacgccgccctggtggccatcatcaacagcaagttcccccagatcggcgagctgatcctgaagagactgatcctgaacttcagaaagggctacagaagaaacgacaagcagctgtgcctgaccgccagcaagttcgtggcccacctgatcaaccagaacgtggcccacgaggtgctgtgcctggagatgctgaccctgctgctggagagacccaccgacgacagcgtggaggtggccatcggcttcctgaaggagtgcggcctgaagctgacccaggtgagccccagaggcatcaacgccatcttcgagagactgagaaacatcctgcacgagagcgagatcgacaagagagtgcagtacatgatcgaggtgatgttcgccgtgagaaaggacggcttcaaggaccaccccatcatcctggagggcctggacctggtggaggaggacgaccagttcacccacatgctgcccctggaggacgactacaaccccgaggacgtgctgaacgtgttcaagatggaccccaacttcatggagaacgaggagaagtacaaggccatcaagaaggagatcctggacgagggcgacaccgacagcaacaccgaccaggacgccggcagcagcgaggaggacgaggaggaggaggaggaggagggcgaggaggacgaggagggccagaaggtgaccatccacgacaagaccgagatcaacctggtgagcttcagaagaaccatctacctggccatccagagcagcctggacttcgaggagtgcgcccacaagctgctgaagatggagttccccgagagccagaccaaggagctgtgcaacatgatcctggactgctgcgcccagcagagaacctacgagaagttcttcggcctgctggccggcagattctgcatgctgaagaaggagtacatggagagcttcgagggcatcttcaaggagcagtacgacaccatccacagactggagaccaacaagctgagaaacgtggccaagatgttcgcccacctgctgtacaccgacagcctgccctggagcgtgctggagtgcatcaagctgagcgaggagaccaccaccagcagcagcagaatcttcgtgaagatcttcttccaggagctgtgcgagtacatgggcctgcccaagctgaacgccagactgaaggacgagaccctgcagcccttcttcgagggcctgctgcccagagacaaccccagaaacaccagattcgccatcaacttcttcaccagcatcggcctgggcggcctgaccgacgagctgagagagcacctgaagaacacccccaaggtgatcgtggcccagaagcccgacgtggagcagaacaagagcagccccagcagcagcagcagcgccagcagcagcagcgagagcgacagcagcgacagcgacagcgacagcagcgacagcagcagcgagagcagcagcgaggagagcgacagcagcagcatcagcagccacagcagcgccagcgccaacgacgtgagaaagaagggccacggcaagaccagaagcaaggaggtggacaagctgatcagaaaccagcagaccaacgacagaaagcagaaggagagaagacaggagcacggccaccaggagaccagaaccgagagagagagaagaagcgagaagcacagagaccagaacagcagcggcagcaactggagagaccccatcaccaagtacaccagcgacaaggacgtgcccagcgagagaaacaactacagcagagtggccaacgacagagaccaggagatgcacatcgacctggagaacaagcacggcgaccccaagaagaagagaggcgagagaagaaacagcttcagcgagaacgagaagcacacccacagaatcaaggacagcgagaacttcagaagaaaggacagaagcaagagcaaggagatgaacagaaagcacagcggcagcagaagcgacgaggacagataccagaacggcgccgagagaagatgggagaagagcagcagatacagcgagcagagcagagagagcaagaagaaccaggacagaagaagagagaagagccccgccaagcagaagtag

SEQ ID NO: 7873 - DNA, 2238 bp, Artificial Sequence
  Description of Artificial Sequence: Synthetic coding sequence
atgaagagcagcgtggcccagatcaagcccagcagcggccacgacagaagagagaacctgaacagctaccagagaaacagcagccccgaggacagatacgaggagcaggagagaagccccagagacagagactacttcgactacagcagaagcgactacgagcacagcagaagaggcagaagctacgacagcagcatggagagcagaaacagagacagagagaagagaagagagagagagagagacaccgacagaaagagaagcagaaagagccccagccccggcagaagaaaccccgagaccagcgtgacccagagcagcagcgcccaggacgagcccgccaccaagaagaagaaggacgagctggaccccctgctgaccagaaccggcggcgcctacatcccccccgccaagctgagaatgatgcaggagcagatcaccgacaagaacagcctggcctaccagagaatgagctgggaggccctgaagaagagcatcaacggcctgatcaacaaggtgaacatcagcaacatcagcatcatcatccaggagctgctgcaggagaacatcgtgagaggcagaggcctgctgagcagaagcgtgctgcaggcccagagcgccagccccatcttcacccacgtgtacgccgccctggtggccatcatcaacagcaagttcccccagatcggcgagctgatcctgaagagactgatcctgaacttcagaaagggctacagaagaaacgacaagcagctgtgcctgaccgccagcaagttcgtggcccacctgatcaaccagaacgtggcccacgaggtgctgtgcctggagatgctgaccctgctgctggagagacccaccgacgacagcgtggaggtggccatcggcttcctgaaggagtgcggcctgaagctgacccaggtgagccccagaggcatcaacgccatcttcgagagactgagaaacatcctgcacgagagcgagatcgacaagagagtgcagtacatgatcgaggtgatgttcgccgtgagaaaggacggcttcaaggaccaccccatcatcctggagggcctggacctggtggaggaggacgaccagttcacccacatgctgcccctggaggacgactacaaccccgaggacgtgctgaacgtgttcaagatggaccccaacttcatggagaacgaggagaagtacaaggccatcaagaaggagatcctggacgagggcgacaccgacagcaacaccgaccaggacgccggcagcagcgaggaggacgaggaggaggaggaggaggagggcgaggaggacgaggagggccagaaggtgaccatccacgacaagaccgagatcaacctggtgagcttcagaagaaccatctacctggccatccagagcagcctggacttcgaggagtgcgcccacaagctgctgaagatggagttccccgagagccagaccaaggagctgtgcaacatgatcctggactgctgcgcccagcagagaacctacgagaagttcttcggcctgctggccggcagattctgcatgctgaagaaggagtacatggagagcttcgagggcatcttcaaggagcagtacgacaccatccacagactggagaccaacaagctgagaaacgtggccaagatgttcgcccacctgctgtacaccgacagcctgccctggagcgtgctggagtgcatcaagctgagcgaggagaccaccaccagcagcagcagaatcttcgtgaagatcttcttccaggagctgtgcgagtacatgggcctgcccaagctgaacgccagactgaaggacgagaccctgcagcccttcttcgagggcctgctgcccagagacaaccccagaaacaccagattcgccatcaacttcttcaccagcatcggcctgggcggcctgaccgacgagctgagagagcacctgaagaacacccccaaggtgatcgtggcccagaagcccgacgtggagcagaacaagagcagccccagcagcagcagcagcgccagcagcagcagcgagagcgacagcagcgacagcgacagcgacagcagcgacagcagcagcgagagcagcagcgaggagagcgacagcagcagcatcagcagccacagcagcgccagcgccaacgacgtgagaaagaagggccacggcaagaccagaagcaaggaggtggacaagctgatcagaaaccagcagaccaacgacagaaagcagaagtag

SEQ ID NO: 7874 - DNA, 2727 bp, Artificial Sequence
  Description of Artificial Sequence: Synthetic coding sequence
atgaagagcagcgtggcccagatcaagcccagcagcggccacgacagaagagagaacctgaacagctaccagagaaacagcagccccgaggacagatacgaggagcaggagagaagccccagagacagagactacttcgactacagcagaagcgactacgagcacagcagaagaggcagaagctacgacagcagcatggagagcagaaacagagacagagagaagagaagagagagagagagagacaccgacagaaagagaagcagaaagagccccagccccggcagaagaaaccccgagaccagcgtgacccagagcagcagcgcccaggacgagcccgccaccaagaagaagaaggacgagctggaccccctgctgaccagaaccggcggcgcctacatcccccccgccaagctgagaatgatgcaggagcagatcaccgacaagaacagcctggcctaccagagaatgagctgggaggccctgaagaagagcatcaacggcctgatcaacaaggtgaacatcagcaacatcagcatcatcatccaggagctgctgcaggagaacatcgtgagaggcagaggcctgctgagcagaagcgtgctgcaggcccagagcgccagccccatcttcacccacgtgtacgccgccctggtggccatcatcaacagcaagttcccccagatcggcgagctgatcctgaagagactgatcctgaacttcagaaagggctacagaagaaacgacaagcagctgtgcctgaccgccagcaagttcgtggcccacctgatcaaccagaacgtggcccacgaggtgctgtgcctggagatgctgaccctgctgctggagagacccaccgacgacagcgtggaggtggccatcggcttcctgaaggagtgcggcctgaagctgacccaggtgagccccagaggcatcaacgccatcttcgagagactgagaaacatcctgcacgagagcgagatcgacaagagagtgcagtacatgatcgaggtgatgttcgccgtgagaaaggacggcttcaaggaccaccccatcatcctggagggcctggacctggtggaggaggacgaccagttcacccacatgctgcccctggaggacgactacaaccccgaggacgtgctgaacgtgttcaagatggaccccaacttcatggagaacgaggagaagtacaaggccatcaagaaggagatcctggacgagggcgacaccgacagcaacaccgaccaggacgccggcagcagcgaggaggacgaggaggaggaggaggaggagggcgaggaggacgaggagggccagaaggtgaccatccacgacaagaccgagatcaacctggtgagcttcagaagaaccatctacctggccatccagagcagcctggacttcgaggagtgcgcccacaagctgctgaagatggagttccccgagagccagaccaaggagctgtgcaacatgatcctggactgctgcgcccagcagagaacctacgagaagttcttcggcctgctggccggcagattctgcatgctgaagaaggagtacatggagagcttcgagggcatcttcaaggagcagtacgacaccatccacagactggagaccaacaagctgagaaacgtggccaagatgttcgcccacctgctgtacaccgacagcctgccctggagcgtgctggagtgcatcaagctgagcgaggagaccaccaccagcagcagcagaatcttcgtgaagatcttcttccaggagctgtgcgagtacatgggcctgcccaagctgaacgccagactgaaggacgagaccctgcagcccttcttcgagggcctgctgcccagagacaaccccagaaacaccagattcgccatcaacttcttcaccagcatcggcctgggcggcctgaccgacgagctgagagagcacctgaagaacacccccaaggtgatcgtggcccagaagcccgacgtggagcagaacaagagcagccccagcagcagcagcagcgccagcagcagcagcgagagcgacagcagcgacagcgacagcgacagcagcgacagcagcagcgagagcagcagcgaggagagcgacagcagcagcatcagcagccacagcagcgccagcgccaacgacgtgagaaagaagggccacggcaagaccagaagcaaggaggtggacaagctgatcagaaaccagcagaccaacgacagaaagcagaaggagagaagacaggagcacggccaccaggagaccagaaccgagagagagagaagaagcgagaagcacagagaccagaacagcagcggcagcaactggagagaccccatcaccaagtacaccagcgacaaggacgtgcccagcgagagaaacaactacagcagagtggccaacgacagagaccaggagatgcacatcgacctggagaacaagcacggcgaccccaagaagaagagaggcgagagaagaaacagcttcagcgagaacgagaagcacacccacagaatcaaggacagcgagaacttcagaagaaaggacagaagcaagagcaaggagatgaacagaaagcacagcggcagcagaagcgacgaggacagataccagaacggcgccgagagaagatgggagaagagcagcagatacagcgagcagagcagagagagcaagaagaaccaggacagaagaagagagaagagccccgccaagcagaagtag

SEQ ID NO: 7875 - DNA, 1419 bp, Artificial Sequence
  Description of Artificial Sequence: Synthetic coding sequence
atgagcaacatctacatccaggagccccccaccaacggcaaggtgctgctgaagaccaccgccggcgacatcgacatcgagctgtggagcaaggaggcccccaaggcctgcagaaacttcatccagctgtgcctggaggcctactacgacaacaccatcttccacagagtggtgcccggcttcatcgtgcagggcggcgaccccaccggcaccggcagcggcggcgagagcatctacggcgcccccttcaaggacgagttccacagcagactgagattcaacagaagaggcctggtggccatggccaacgccggcagccacgacaacggcagccagttcttcttcaccctgggcagagccgacgagctgaacaacaagcacaccatcttcggcaaggtgaccggcgacaccgtgtacaacatgctgagactgagcgaggtggacatcgacgacgacgagagaccccacaacccccacaagatcaagagctgcgaggtgctgttcaaccccttcgacgacatcatccccagagagatcaagagactgaagaaggagaagcccgaggaggaggtgaagaagctgaagcccaagggcaccaagaacttcagcctgctgagcttcggcgaggaggccgaggaggaggaggaggaggtgaacagagtgagccagagcatgaagggcaagagcaagagcagccacgacctgctgaaggacgacccccacctgagcagcgtgcccgtggtggagagcgagaagggcgacgcccccgacctggtggacgacggcgaggacgagagcgccgagcacgacgagtacatcgacggcgacgagaagaacctgatgagagagagaatcgccaagaagctgaagaaggacaccagcgccaacgtgaagagcgccggcgagggcgaggtggagaagaagagcgtgagcagaagcgaggagctgagaaaggaggccagacagctgaagagagagctgctggccgccaagcagaagaaggtggagaacgccgccaagcaggccgagaagagaagcgaggaggaggaggccccccccgacggcgccgtggccgagtacagaagagagaagcagaagtacgaggccctgagaaagcagcagagcaagaagggcaccagcagagaggaccagaccctggccctgctgaaccagttcaagagcaagctgacccaggccatcgccgagacccccgagaacgacatccccgagaccgaggtggaggacgacgagggctggatgagccacgtgctgcagttcgaggacaagagcagaaaggtgaaggacgccagcatgcaggacagcgacaccttcgagatctacgaccccagaaaccccgtgaacaagagaagaagagaggagagcaagaagctgatgagagagaagaaggagagaagatag

SEQ ID NO: 7876 - DNA, 1173 bp, Artificial Sequence
  Description of Artificial Sequence: Synthetic coding sequence
atgagcaacatctacatccaggagccccccaccaacggcaaggtgctgctgaagaccaccgccggcgacatcgacatcgagctgtggagcaaggaggcccccaaggcctgcagaaacttcatccagctgtgcctggaggcctactacgacaacaccatcttccacagagtggtgcccggcttcatcgtgcagggcggcgaccccaccggcaccggcagcggcggcgagagcatctacggcgcccccttcaaggacgagttccacagcagactgagattcaacagaagaggcctggtggccatggccaacgccggcagccacgacaacggcagccagttcttcttcaccctgggcagagccgacgagctgaacaacaagcacaccatcttcggcaaggtgaccggcgacaccgtgtacaacatgctgagactgagcgaggtggacatcgacgacgacgagagaccccacaacccccacaagatcaagagctgcgaggtgctgttcaaccccttcgacgacatcatccccagagagatcaagagactgaagaaggagaagcccgaggaggaggtgaagaagctgaagcccaagggcaccaagaacttcagcctgctgagcttcggcgaggaggccgaggaggaggaggaggaggtgaacagagtgagccagagcatgaagggcaagagcaagagcagccacgacctgctgaaggacgacccccacctgagcagcgtgcccgtggtggagagcgagaagggcgacgcccccgacctggtggacgacggcgaggacgagagcgccgagcacgacgagtacatcgacggcgacgagaagaacctgatgagagagagaatcgccaagaagctgaagaaggacaccagcgccaacgtgaagagcgccggcgagggcgaggtggagaagaagagcgtgagcagaagcgaggagctgagaaaggaggccagacagctgaagagagagctgctggccgccaagcagaagaaggtggagaacgccgccaagcaggccgagaagagaagcgaggaggaggaggccccccccgacggcgccgtggccgagtacagaagagagaagcagaagtacgaggccctgagaaagcagcagagcaagaagggcaccagcagagaggaccaggagatcaccaagagcagctag

SEQ ID NO: 7877 - DNA, 1971 bp, Artificial Sequence
  Description of Artificial Sequence: Synthetic coding sequence
atggagggcgacggcagcgaccccgagccccccgacgccggcgaggacagcaagagcgagaacggcgagaacgcccccatctactgcatctgcagaaagcccgacatcaactgcttcatgatcggctgcgacaactgcaacgagtggttccacggcgactgcatcagaatcaccgagaagatggccaaggccatcagagagtggtactgcagagagtgcagagagaaggaccccaagctggagatcagatacagacacaagaagagcagagagagagacggcaacgagagagacagcagcgagcccagagacgagggcggcggcagaaagagacccgtgcccgaccccgacctgcagagaagagccggcagcggcaccggcgtgggcgccatgctggccagaggcagcgccagcccccacaagagcagcccccagcccctggtggccacccccagccagcaccaccagcagcagcagcagcagatcaagagaagcgccagaatgtgcggcgagtgcgaggcctgcagaagaaccgaggactgcggccactgcgacttctgcagagacatgaagaagttcggcggccccaacaagatcagacagaagtgcagactgagacagtgccagctgagagccagagagagctacaagtacttccccagcagcctgagccccgtgacccccagcgagagcctgcccagacccagaagacccctgcccacccagcagcagccccagcccagccagaagctgggcagaatcagagaggacgagggcgccgtggccagcagcaccgtgaaggagccccccgaggccaccgccacccccgagcccctgagcgacgaggacctgcccctggaccccgacctgtaccaggacttctgcgccggcgccttcgacgaccacggcctgccctggatgagcgacaccgaggagagccccttcctggaccccgccctgagaaagagagccgtgaaggtgaagcacgtgaagagaagagagaagaagagcgagaagaagaaggaggagagatacaagagacacagacagaagcagaagcacaaggacaagtggaagcaccccgagagagccgacgccaaggaccccgccagcctgccccagtgcctgggccccggctgcgtgagacccgcccagcccagcagcaagtactgcagcgacgactgcggcatgaagctggccgccaacagaatctacgagatcctgccccagagaatccagcagtggcagcagagcccctgcatcgccgaggagcacggcaagaagctgctggagagaatcagaagagagcagcagagcgccagaaccagactgcaggagatggagagaagattccacgagctggaggccatcatcctgagagccaagcagcaggccgtgagagaggacgaggagagcaacgagggcgacagcgacgacaccgacctgcagatcttctgcgtgagctgcggccaccccatcaaccccagagtggccctgagacacatggagagatgctacgccaagtacgagagccagaccagcttcggcagcatgtaccccaccagaatcgagggcgccaccagactgttctgcgacgtgtacaacccccagagcaagacctactgcaagagactgcaggtgctgtgccccgagcacagcagagaccccaaggtgcccgccgacgaggtgtgcggctgccccctggtgagagacgtgttcgagctgaccggcgacttctgcagactgcccaagagacagtgcaacagacactactgctgggagaagctgagaagagccgaggtggacctggagagagtgagagtgtggtacaagctggacgagctgttcgagcaggagagaaacgtgagaaccgccatgaccaacagagccggcctgctggccctgatgctgcaccagaccatccagcacgaccccctgaccaccgacctgagaagcagcgccgacagatag

SEQ ID NO: 7878 - DNA, 1983 bp, Artificial Sequence
  Description of Artificial Sequence: Synthetic coding sequence
atggagggcgacggcagcgaccccgagccccccgacgccggcgaggacagcaagagcgagaacggcgagaacgcccccatctactgcatctgcagaaagcccgacatcaactgcttcatgatcggctgcgacaactgcaacgagtggttccacggcgactgcatcagaatcaccgagaagatggccaaggccatcagagagtggtactgcagagagtgcagagagaaggaccccaagctggagatcagatacagacacaagaagagcagagagagagacggcaacgagagagacagcagcgagcccagagacgagggcggcggcagaaagagacccgtgcccgaccccgacctgcagagaagagccggcagcggcaccggcgtgggcgccatgctggccagaggcagcgccagcccccacaagagcagcccccagcccctggtggccacccccagccagcaccaccagcagcagcagcagcagatcaagagaagcgccagaatgtgcggcgagtgcgaggcctgcagaagaaccgaggactgcggccactgcgacttctgcagagacatgaagaagttcggcggccccaacaagatcagacagaagtgcagactgagacagtgccagctgagagccagagagagctacaagtacttccccagcagcctgagccccgtgacccccagcgagagcctgcccagacccagaagacccctgcccacccagcagcagccccagcccagccagaagctgggcagaatcagagaggacgagggcgccgtggccagcagcaccgtgaaggagccccccgaggccaccgccacccccgagcccctgagcgacgaggacctgcccctggaccccgacctgtaccaggacttctgcgccggcgccttcgacgaccacggcctgccctggatgagcgacaccgaggagagccccttcctggaccccgccctgagaaagagagccgtgaaggtgaagcacgtgaagagaagagagaagaagagcgagaagaaggtgatggagagaaaggaggagagatacaagagacacagacagaagcagaagcacaaggacaagtggaagcaccccgagagagccgacgccaaggaccccgccagcctgccccagtgcctgggccccggctgcgtgagacccgcccagcccagcagcaagtactgcagcgacgactgcggcatgaagctggccgccaacagaatctacgagatcctgccccagagaatccagcagtggcagcagagcccctgcatcgccgaggagcacggcaagaagctgctggagagaatcagaagagagcagcagagcgccagaaccagactgcaggagatggagagaagattccacgagctggaggccatcatcctgagagccaagcagcaggccgtgagagaggacgaggagagcaacgagggcgacagcgacgacaccgacctgcagatcttctgcgtgagctgcggccaccccatcaaccccagagtggccctgagacacatggagagatgctacgccaagtacgagagccagaccagcttcggcagcatgtaccccaccagaatcgagggcgccaccagactgttctgcgacgtgtacaacccccagagcaagacctactgcaagagactgcaggtgctgtgccccgagcacagcagagaccccaaggtgcccgccgacgaggtgtgcggctgccccctggtgagagacgtgttcgagctgaccggcgacttctgcagactgcccaagagacagtgcaacagacactactgctgggagaagctgagaagagccgaggtggacctggagagagtgagagtgtggtacaagctggacgagctgttcgagcaggagagaaacgtgagaaccgccatgaccaacagagccggcctgctggccctgatgctgcaccagaccatccagcacgaccccctgaccaccgacctgagaagcagcgccgacagatag

SEQ ID NO: 7879 - DNA, 834 bp, Artificial Sequence
  Description of Artificial Sequence: Synthetic coding sequence
atgagcctgtgcgaggacatgctgctgtgcaactacagaaagtgcagaatcaagctgagcggctacgcctgggtgaccgcctgcagccacatcttctgcgaccagcacggcagcggcgagttcagcagaagccccgccatctgccccgcctgcaacagcaccctgagcggcaagctggacatcgtgagaaccgagctgagccccagcgaggagtacaaggccatggtgctggccggcctgagacccgagatcgtgctggacatcagcagcagagccctggccttctggacctaccaggtgcaccaggagagactgtaccaggagtacaacttcagcaaggccgagggccacctgaagcagatggagaagatctacacccagcagatccagagcaaggacgtggagctgaccagcatgaagggcgaggtgaccagcatgaagaaggtgctggaggagtacaagaagaagttcagcgacatcagcgagaagctgatggagagaaacagacagtaccagaagctgcagggcctgtacgacagcctgagactgagaaacatcaccatcgccaaccacgagggcaccctggagcccagcatgatcgcccagagcggcgtgctgggcttccccctgggcaacaacagcaagttccccctggacaacacccccgtgagaaacagaggcgacggcgacggcgacttccagttcagacccttcttcgccggcagccccaccgcccccgagcccagcaacagcttcttcagcttcgtgagccccagcagagagctggagcagcagcaggtgagcagcagagccttcaaggtgaagagaatctag

SEQ ID NO: 7880 - DNA, 834 bp, Artificial Sequence; identical to SEQ ID NO: 7879
  Description of Artificial Sequence: Synthetic coding sequence

SEQ ID NO: 7881 - DNA, 834 bp, Artificial Sequence; identical to SEQ ID NO: 7879
  Description of Artificial Sequence: Synthetic coding sequence

SEQ ID NO: 7882 - DNA, 834 bp, Artificial Sequence; identical to SEQ ID NO: 7879
  Description of Artificial Sequence: Synthetic coding sequence

SEQ ID NO: 7883 - DNA, 834 bp, Artificial Sequence; identical to SEQ ID NO: 7879
  Description of Artificial Sequence: Synthetic coding sequence

SEQ ID NO: 7884 - DNA, 834 bp, Artificial Sequence; identical to SEQ ID NO: 7879
  Description of Artificial Sequence: Synthetic coding sequence

SEQ ID NO: 7885 - DNA, 15 bp, Artificial Sequence
  Description of Artificial Sequence: Synthetic coding sequence
atgagcctgtgctag

SEQ ID NO: 7886 - DNA, 465 bp, Artificial Sequence
  Description of Artificial Sequence: Synthetic coding sequence
atgagcctgtgcgaggacatgctgctgtgcaactacagaaagtgcagaatcaagctgagcggctacgcctgggtgaccgcctgcagccacatcttctgcgaccagcacggcagcggcgagttcagcagaagccccgccatctgccccgcctgcaacagcaccctgagcggcaagctggacatcgtgagaaccgagctgagccccagcgaggagtacaaggccatggtgctggccggcctgagacccgagatcgtgctggacatcagcagcagagccctggccttctggacctaccaggtgcaccaggagagactgtaccaggagtacaacttcagcaaggccgagggccacctgaagcagatggagaagatctacacccagcagatccagagcaaggacgtggagctgaccagcatgaagggcgaggtgaccagcatgaagaaggtgctggaggagtacaagtag

SEQ ID NO: 7887 - DNA, 1119 bp, Artificial Sequence
  Description of Artificial Sequence: Synthetic coding sequence
atggagctggagggccagtggtggagaggccagctggccgccgacatccaccaggccctgagatacaaggagctgaagctgcccagctacaagggccagagcccccagctgagcctgagaagatacttcgccgacctgatcgccatcgtgagcaacagattcaccctgtgccccagcgccagacacctggccgtgtacctgctggacctgttcatggacagatacgacatcagcatccagcagctgcacctggtggccctgagctgcctgctgctggccagcaagttcgaggagaaggaggacagcgtgcccaagctggagcagctgaacagcctgggctgcatgaccaacatgaacctggtgctgaccaagcagaacctgctgcacatggagctgctgctgctggagaccttccagtggaacctgtgcctgcccaccgccgcccacttcatcgagtactacctgagcgaggccgtgcacgagaccgacctgcacgacggctggcccatgatctgcctggagaagaccaagctgtacatggccaagtacgccgactacttcctggaggtgagcctgcaggtggccgccgcctgcgtggccagcagcagaatcatcctgagactgagccccacctggcccaccagactgcacagactgaccgcctacagctgggacttcctggtgcagtgcatcgagagactgctgatcgcccacgacaacgacgtgaaggaggccaacaagcagagaggccaggccggcccccagagcgcccagctgagcgtgttccagaccgccagccagcccagcagacccgtgcacttccagcagccccagtacctgcaccagacccaccagaccagcctgcagtacagacaccccaccagcgagcagcccagctgccagcagatcgtgagcaccacccacaccagcagctacaccctgcagacctgccccgccggcttccagaccagcgtgcagggcctgggccacatgcagaccggcgtgggcatgagcctggccatccccgtggaggtgaagccctgcctgagcgtgagctacaacagaagctaccagatcaacgagcactacccctgcatcaccccctgcttcgagagatag

SEQ ID NO: 7888 - DNA, 1116 bp, Artificial Sequence
  Description of Artificial Sequence: Synthetic coding sequence
atggagctggagggccagtggtggagaggccagctggccgccgacatccaccaggccctgagatacaaggagctgaagctgcccagctacaagggccagagcccccagctgagcctgagaagatacttcgccgacctgatcgccatcgtgagcaacagattcaccctgtgccccagcgccagacacctggccgtgtacctgctggacctgttcatggacagatacgacatcagcatccagcagctgcacctggtggccctgagctgcctgctgctggccagcaagttcgaggagaaggaggacagcgtgcccaagctggagcagctgaacagcctgggctgcatgaccaacatgaacctggtgctgaccaagcagaacctgctgcacatggagctgctgctgctggagaccttccagtggaacctgtgcctgcccaccgccgcccacttcatcgagtactacctgagcgaggccgtgcacgagaccgacctgcacgacggctggcccatgatctgcctggagaagaccaagctgtacatggccaagtacgccgactacttcctggaggtgagcctgcaggccgccgcctgcgtggccagcagcagaatcatcctgagactgagccccacctggcccaccagactgcacagactgaccgcctacagctgggacttcctggtgcagtgcatcgagagactgctgatcgcccacgacaacgacgtgaaggaggccaacaagcagagaggccaggccggcccccagagcgcccagctgagcgtgttccagaccgccagccagcccagcagacccgtgcacttccagcagccccagtacctgcaccagacccaccagaccagcctgcagtacagacaccccaccagcgagcagcccagctgccagcagatcgtgagcaccacccacaccagcagctacaccctgcagacctgccccgccggcttccagaccagcgtgcagggcctgggccacatgcagaccggcgtgggcatgagcctggccatccccgtggaggtgaagccctgcctgagcgtgagctacaacagaagctaccagatcaacgagcactacccctgcatcaccccctgcttcgagagatag

SEQ ID NO: 7889 - DNA, 1152 bp, Artificial Sequence
  Description of Artificial Sequence: Synthetic coding sequence
atggagctggagggccagtggtggagaggccagctggccgccgacatccaccaggccctgagatacaaggagctgaagctgcccagctacaagggccagagcccccagctgagcctgagaagatacttcgccgacctgatcgccatcgtgagcaacagattcaccctgtgccccagcgccagacacctggccgtgtacctgctggacctgttcatggacagatacgacatcagcatccagcagctgcacctggtggccctgagctgcctgctgctggccagcaagttcgaggagaaggaggacagcgtgcccaagctggagcagctgaacagcctgggctgcatgaccaacatgaacctggtgctgaccaagcagaacctgctgcacatggagctgctgctgctggagaccttccagtggaacctgtgcctgcccaccgccgcccacttcatcgagtactacctgagcgaggccgtgcacgagaccgacctgcacgacggctggcccatgatctgcctggagaagaccaagctgtacatggccaagtacgccgactacttcctggaggtgagcctgcaggactacgccttcctgaactacgcccccagcctggtggccgccgcctgcgtggccagcagcagaatcatcctgagactgagccccacctggcccaccagactgcacagactgaccgcctacagctgggacttcctggtgcagtgcatcgagagactgctgatcgcccacgacaacgacgtgaaggaggccaacaagcagagaggccaggccggcccccagagcgcccagctgagcgtgttccagaccgccagccagcccagcagacccgtgcacttccagcagccccagtacctgcaccagacccaccagaccagcctgcagtacagacaccccaccagcgagcagcccagctgccagcagatcgtgagcaccacccacaccagcagctacaccctgcagacctgccccgccggcttccagaccagcgtgcagggcctgggccacatgcagaccggcgtgggcatgagcctggccatccccgtggaggtgaagccctgcctgagcgtgagctacaacagaagctaccagatcaacgagcactacccctgcatcaccccctgcttcgagagatag

SEQ ID NO: 7890 - DNA, 1119 bp, Artificial Sequence; identical to SEQ ID NO: 7887
  Description of Artificial Sequence: Synthetic coding sequence

SEQ ID NO: 7891 - DNA, 4446 bp, Artificial Sequence
  Description of Artificial Sequence: Synthetic coding sequence
atgcccaacagcgagagacacggcggcaagaaggacggcagcggcggcgccagcggcaccctgcagcccagcagcggcggcggcagcagcaacagcagagagagacacagactggtgagcaagcacaagagacacaagagcaagcacagcaaggacatgggcctggtgacccccgaggccgccagcctgggcaccgtgatcaagcccctggtggagtacgacgacatcagcagcgacagcgacaccttcagcgacgacatggccttcaagctggacagaagagagaacgacgagagaagaggcagcgacagaagcgacagactgcacaagcacagacaccaccagcacagaagaagcagagacctgctgaaggccaagcagaccgagaaggagaagagccaggaggtgagcagcaagagcggcagcatgaaggacagaatcagcggcagcagcaagagaagcaacgaggagaccgacgactacggcaaggcccaggtggccaagagcagcagcaaggagagcagaagcagcaagctgcacaaggagaagaccagaaaggagagagagctgaagagcggccacaaggacagaagcaagagccacagaaagagagagacccccaagagctacaagaccgtggacagccccaagagaagaagcagaagcccccacagaaagtggagcgacagcagcaagcaggacgacagccccagcggcgccagctacggccaggactacgacctgagccccagcagaagccacaccagcagcaactacgacagctacaagaagagccccggcagcaccagcagaagacagagcgtgagccccccctacaaggagcccagcgcctaccagagcagcaccagaagccccagcccctacagcagaagacagagaagcgtgagcccctacagcagaagaagaagcagcagctacgagagaagcggcagctacagcggcagaagccccagcccctacggcagaagaagaagcagcagccccttcctgagcaagagaagcctgagcagaagccccctgcccagcagaaagagcatgaagagcagaagcagaagccccgcctacagcagacacagcagcagccacagcaagaagaagagaagcagcagcagaagcagacacagcagcatcagccccgtgagactgcccctgaacagcagcctgggcgccgagctgagcagaaagaagaaggagagagccgccgccgccgccgccgccaagatggacggcaaggagagcaagggcagccccgtgttcctgcccagaaaggagaacagcagcgtggaggccaaggacagcggcctggagagcaagaagctgcccagaagcgtgaagctggagaagagcgcccccgacaccgagctggtgaacgtgacccacctgaacaccgaggtgaagaacagcagcgacaccggcaaggtgaagctggacgagaacagcgagaagcacctggtgaaggacctgaaggcccagggcaccagagacagcaagcccatcgccctgaaggaggagatcgtgacccccaaggagaccgagaccagcgagaaggagacccccccccccctgcccaccatcgccagcccccccccccccctgcccaccaccaccccccccccccagaccccccccctgccccccctgccccccatccccgccctgccccagcagccccccctgccccccagccagcccgccttcagccaggtgcccgccagcagcaccagcaccctgccccccagcacccacagcaagaccagcgccgtgagcagccaggccaacagccagccccccgtgcaggtgagcgtgaagacccaggtgagcgtgaccgccgccatcccccacctgaagaccagcaccctgccccccctgcccctgccccccctgctgcccggcgacgacgacatggacagccccaaggagaccctgcccagcaagcccgtgaagaaggagaaggagcagagaaccagacacctgctgaccgacctgcccctgccccccgagctgcccggcggcgacctgagcccccccgacagccccgagcccaaggccatcacccccccccagcagccctacaagaagagacccaagatctgctgccccagatacggcgagagaagacagaccgagagcgactggggcaagagatgcgtggacaagttcgacatcatcggcatcatcggcgagggcacctacggccaggtgtacaaggccaaggacaaggacaccggcgagctggtggccctgaagaaggtgagactggacaacgagaaggagggcttccccatcaccgccatcagagagatcaagatcctgagacagctgatccacagaagcgtggtgaacatgaaggagatcgtgaccgacaagcaggacgccctggacttcaagaaggacaagggcgccttctacctggtgttcgagtacatggaccacgacctgatgggcctgctggagagcggcctggtgcacttcagcgaggaccacatcaagagcttcatgaagcagctgatggagggcctggagtactgccacaagaagaacttcctgcacagagacatcaagtgcagcaacatcctgctgaacaacagcggccagatcaagctggccgacttcggcctggccagactgtacaacagcgaggagagcagaccctacaccaacaaggtgatcaccctgtggtacagaccccccgagctgctgctgggcgaggagagatacacccccgccatcgacgtgtggagctgcggctgcatcctgggcgagctgttcaccaagaagcccatcttccaggccaacctggagctggcccagctggagctgatcagcagactgtgcggcagcccctgccccgccgtgtggcccgacgtgatcaagctgccctacttcaacaccatgaagcccaagaagcagtacagaagaagactgagagaggagttcagcttcatccccagcgccgccctggacctgctggaccacatgctgaccctggaccccagcaagagatgcaccgccgagcagaccctgcagagcgacttcctgaaggacgtggagctgagcaagatggccccccccgacctgccccactggcaggactgccacgagctgtggagcaagaagagaagaagacagagacagagcggcgtggtggtggaggagcccccccccagcaagaccagcagaaaggagaccaccagcggcaccagcaccgagcccgtgaagaacagcagccccgcccccccccagcccgcccccggcaaggtggagagcggcgccggcgacgccatcggcctggccgacatcacccagcagctgaaccagagcgagctggccgtgctgctgaacctgctgcagagccagaccgacctgagcatcccccagatggcccagctgctgaacatccacagcaaccccgagatgcagcagcagctggaggccctgaaccagagcatcagcgccctgaccgaggccaccagccagcagcaggacagcgagaccatggcccccgaggagagcctgaaggaggcccccagcgcccccgtgatcctgcccagcgccgagcagaccaccctggaggccagcagcacccccgccgacatgcagaacatcctggccgtgctgctgagccagctgatgaagacccaggagcccgccggcagcctggaggagaacaacagcgacaagaacagcggcccccagggccccagaagaacccccaccatgccccaggaggaggccgccgagaagagaccccccgagccccccggccccccccccccccccccccccccccccctggtggagggcgacctgagcagcgccccccaggagctgaaccccgccgtgaccgccgccctgctgcagctgctgagccagcccgaggccgagccccccggccacctgccccacgagcaccaggccctgagacccatggagtacagcaccagacccagacccaacagaacctacggcaacaccgacggccccgagaccggcttcagcgccatcgacaccgacgagagaaacagcggccccgccctgaccgagagcctggtgcagaccctggtgaagaacagaaccttcagcggcagcctgagccacctgggcgagagcagcagctaccagggcaccggcagcgtgcagttccccggcgaccaggacctgagattcgccagagtgcccctggccctgcaccccgtggtgggccagcccttcctgaaggccgagggcagcagcaacagcgtggtgcacgccgagaccaagctgcagaactacggcgagctgggccccggcaccaccggcgccagcagcagcggcgccggcctgcactggggcggccccacccagagcagcgcctacggcaagctgtacagaggccccaccagagtgccccccagaggcggcagaggcagaggcgtgccctactag

SEQ ID NO: 7892 - DNA, 4473 bp, Artificial Sequence
  Description of Artificial Sequence: Synthetic coding sequence
atgcccaacagcgagagacacggcggcaagaaggacggcagcggcggcgccagcggcaccctgcagcccagcagcggcggcggcagcagcaacagcagagagagacacagactggtgagcaagcacaagagacacaagagcaagcacagcaaggacatgggcctggtgacccccgaggccgccagcctgggcaccgtgatcaagcccctggtggagtacgacgacatcagcagcgacagcgacaccttcagcgacgacatggccttcaagctggacagaagagagaacgacgagagaagaggcagcgacagaagcgacagactgcacaagcacagacaccaccagcacagaagaagcagagacctgctgaaggccaagcagaccgagaaggagaagagccaggaggtgagcagcaagagcggcagcatgaaggacagaatcagcggcagcagcaagagaagcaacgaggagaccgacgactacggcaaggcccaggtggccaagagcagcagcaaggagagcagaagcagcaagctgcacaaggagaagaccagaaaggagagagagctgaagagcggccacaaggacagaagcaagagccacagaaagagagagacccccaagagctacaagaccgtggacagccccaagagaagaagcagaagcccccacagaaagtggagcgacagcagcaagcaggacgacagccccagcggcgccagctacggccaggactacgacctgagccccagcagaagccacaccagcagcaactacgacagctacaagaagagccccggcagcaccagcagaagacagagcgtgagccccccctacaaggagcccagcgcctaccagagcagcaccagaagccccagcccctacagcagaagacagagaagcgtgagcccctacagcagaagaagaagcagcagctacgagagaagcggcagctacagcggcagaagccccagcccctacggcagaagaagaagcagcagccccttcctgagcaagagaagcctgagcagaagccccctgcccagcagaaagagcatgaagagcagaagcagaagccccgcctacagcagacacagcagcagccacagcaagaagaagagaagcagcagcagaagcagacacagcagcatcagccccgtgagactgcccctgaacagcagcctgggcgccgagctgagcagaaagaagaaggagagagccgccgccgccgccgccgccaagatggacggcaaggagagcaagggcagccccgtgttcctgcccagaaaggagaacagcagcgtggaggccaaggacagcggcctggagagcaagaagctgcccagaagcgtgaagctggagaagagcgcccccgacaccgagctggtgaacgtgacccacctgaacaccgaggtgaagaacagcagcgacaccggcaaggtgaagctggacgagaacagcgagaagcacctggtgaaggacctgaaggcccagggcaccagagacagcaagcccatcgccctgaaggaggagatcgtgacccccaaggagaccgagaccagcgagaaggagacccccccccccctgcccaccatcgccagcccccccccccccctgcccaccaccaccccccccccccagaccccccccctgccccccctgccccccatccccgccctgccccagcagccccccctgccccccagccagcccgccttcagccaggtgcccgccagcagcaccagcaccctgccccccagcacccacagcaagaccagcgccgtgagcagccaggccaacagccagccccccgtgcaggtgagcgtgaagacccaggtgagcgtgaccgccgccatcccccacctgaagaccagcaccctgccccccctgcccctgccccccctgctgcccggcgacgacgacatggacagccccaaggagaccctgcccagcaagcccgtgaagaaggagaaggagcagagaaccagacacctgctgaccgacctgcccctgccccccgagctgcccggcggcgacctgagcccccccgacagccccgagcccaaggccatcacccccccccagcagccctacaagaagagacccaagatctgctgccccagatacggcgagagaagacagaccgagagcgactggggcaagagatgcgtggacaagttcgacatcatcggcatcatcggcgagggcacctacggccaggtgtacaaggccaaggacaaggacaccggcgagctggtggccctgaagaaggtgagactggacaacgagaaggagggcttccccatcaccgccatcagagagatcaagatcctgagacagctgatccacagaagcgtggtgaacatgaaggagatcgtgaccgacaagcaggacgccctggacttcaagaaggacaagggcgccttctacctggtgttcgagtacatggaccacgacctgatgggcctgctggagagcggcctggtgcacttcagcgaggaccacatcaagagcttcatgaagcagctgatggagggcctggagtactgccacaagaagaacttcctgcacagagacatcaagtgcagcaacatcctgctgaacaacagcggccagatcaagctggccgacttcggcctggccagactgtacaacagcgaggagagcagaccctacaccaacaaggtgatcaccctgtggtacagaccccccgagctgctgctgggcgaggagagatacacccccgccatcgacgtgtggagctgcggctgcatcctgggcgagctgttcaccaagaagcccatcttccaggccaacctggagctggcccagctggagctgatcagcagactgtgcggcagcccctgccccgccgtgtggcccgacgtgatcaagctgccctacttcaacaccatgaagcccaagaagcagtacagaagaagactgagagaggagttcagcttcatccccagcgccgccctggacctgctggaccacatgctgaccctggaccccagcaagagatgcaccgccgagcagaccctgcagagcgacttcctgaaggacgtggagctgagcaagatggccccccccgacctgccccactggcaggactgccacgagctgtggagcaagaagagaagaagacagagacagagcggcgtggtggtggaggagcccccccccagcaagaccagcagaaaggagaccaccagcggcaccagcaccgagcccgtgaagaacagcagccccgcccccccccagcccgcccccggcaaggtggagagcggcgccggcgacgccatcggcctggccgacatcacccagcagctgaaccagagcgagctggccgtgctgctgaacctgctgcagagccagaccgacctgagcatcccccagatggcccagctgctgaacatccacagcaaccccgagatgcagcagcagctggaggccctgaaccagagcatcagcgccctgaccgaggccaccagccagcagcaggacagcgagaccatggcccccgaggagagcctgaaggaggcccccagcgcccccgtgatcctgcccagcgccgagcagaccaccctggaggccagcagcacccccgccgacatgcagaacatcctggccgtgctgctgagccagctgatgaagacccaggagcccgccggcagcctggaggagaacaacagcgacaagaacagcggcccccagggccccagaagaacccccaccatgccccaggaggaggccgccgcctgccccccccacatcctgccccccgagaagagaccccccgagccccccggccccccccccccccccccccccccccccctggtggagggcgacctgagcagcgccccccaggagctgaaccccgccgtgaccgccgccctgctgcagctgctgagccagcccgaggccgagccccccggccacctgccccacgagcaccaggccctgagacccatggagtacagcaccagacccagacccaacagaacctacggcaacaccgacggccccgagaccggcttcagcgccatcgacaccgacgagagaaacagcggccccgccctgaccgagagcctggtgcagaccctggtgaagaacagaaccttcagcggcagcctgagccacctgggcgagagcagcagctaccagggcaccggcagcgtgcagttccccggcgaccaggacctgagattcgccagagtgcccctggccctgcaccccgtggtgggccagcccttcctgaaggccgagggcagcagcaacagcgtggtgcacgccgagaccaagctgcagaactacggcgagctgggccccggcaccaccggcgccagcagcagcggcgccggcctgcactggggcggccccacccagagcagcgcctacggcaagctgtacagaggccccaccagagtgccccccagaggcggcagaggcagaggcgtgccctactag

SEQ ID NO: 7893 - DNA, 4539 bp, Artificial Sequence
  Description of Artificial Sequence: Synthetic coding sequence
atgcccagcagcagcgacaccgccctgggcggcggcggcggcctgagctgggccgagaagaagctggaggagagaagaaagagaagaagattcctgagcccccagcagccccccctgctgctgcccctgctgcagccccagctgctgcagcccccccccccccccccccccctgctgttcctggccgcccccggcaccgccgccgccgccgccgccgccgccgccgccagcagcagctgcttcagccccggcccccccctggaggtgaagagactggccagaggcaagagaagagccggcggcagacagaagagaagaagaggccccagagccggccaggaggccgagaagagaagagtgttcagcctgccccagccccagcaggacggcggcggcggcgccagcagcggcggcggcgtgacccccctggtggagtacgaggacgtgagcagccagagcgagcagggcctgctgctgggcggcgccagcgccgccaccgccgccaccgccgccggcggcaccggcggcagcggcggcagccccgccagcagcagcggcacccagagaagaggcgagggcagcgagagaagacccagaagagacagaagaagcagcagcggcagaagcaaggagagacacagagagcacagaagaagagacggccagagaggcggcagcgaggccagcaagagcagaagcagacacagccacagcggcgaggagagagccgaggtggccaagagcggcagcagcagcagcagcggcggcagaagaaagagcgccagcgccaccagcagcagcagcagcagcagaaaggacagagacagcaaggcccacagaagcagaaccaagagcagcaaggagccccccagcgcctacaaggagccccccaaggcctacagagaggacaagaccgagcccaaggcctacagaagaagaagaagcctgagccccctgggcggcagagacgacagccccgtgagccacagagccagccagagcctgagaagcagaaagagccccagccccgccggcggcggcagcagcccctacagcagaagactgcccagaagccccagcccctacagcagaagaagaagccccagctacagcagacacagcagctacgagagaggcggcgacgtgagccccagcccctacagcagcagcagctggagaagaagcagaagcccctacagccccgtgctgagaagaagcggcaagagcagaagcagaagcccctacagcagcagacacagcagaagcagaagcagacacagactgagcagaagcagaagcagacacagcagcatcagccccagcaccctgaccctgaagagcagcctggccgccgagctgaacaagaacaagaaggccagagccgccgaggccgccagagccgccgaggccgccaaggccgccgaggccaccaaggccgccgaggccgccgccaaggccgccaaggccagcaacaccagcacccccaccaagggcaacaccgagaccagcgccagcgccagccagaccaaccacgtgaaggacgtgaagaagatcaagatcgagcacgcccccagccccagcagcggcggcaccctgaagaacgacaaggccaagaccaagccccccctgcaggtgaccaaggtggagaacaacctgatcgtggacaaggccaccaagaaggccgtgatcgtgggcaaggagagcaagagcgccgccaccaaggaggagagcgtgagcctgaaggagaagaccaagcccctgacccccagcatcggcgccaaggagaaggagcagcacgtggccctggtgaccagcaccctgccccccctgcccctgccccccatgctgcccgaggacaaggaggccgacagcctgagaggcaacatcagcgtgaaggccgtgaagaaggaggtggagaagaagctgagatgcctgctggccgacctgcccctgccccccgagctgcccggcggcgacgacctgagcaagagccccgaggagaagaagaccgccacccagctgcacagcaagagaagacccaagatctgcggccccagatacggcgagaccaaggagaaggacatcgactggggcaagagatgcgtggacaagttcgacatcatcggcatcatcggcgagggcacctacggccaggtgtacaaggccagagacaaggacaccggcgagatggtggccctgaagaaggtgagactggacaacgagaaggagggcttccccatcaccgccatcagagagatcaagatcctgagacagctgacccaccagagcatcatcaacatgaaggagatcgtgaccgacaaggaggacgccctggacttcaagaaggacaagggcgccttctacctggtgttcgagtacatggaccacgacctgatgggcctgctggagagcggcctggtgcacttcaacgagaaccacatcaagagcttcatgagacagctgatggagggcctggactactgccacaagaagaacttcctgcacagagacatcaagtgcagcaacatcctgctgaacaacagaggccagatcaagctggccgacttcggcctggccagactgtacagcagcgaggagagcagaccctacaccaacaaggtgatcaccctgtggtacagaccccccgagctgctgctgggcgaggagagatacacccccgccatcgacgtgtggagctgcggctgcatcctgggcgagctgttcaccaagaagcccatcttccaggccaaccaggagctggcccagctggagctgatcagcagaatctgcggcagcccctgccccgccgtgtggcccgacgtgatcaagctgccctacttcaacaccatgaagcccaagaagcagtacagaagaaagctgagagaggagttcgtgttcatccccgccgccgccctggacctgttcgactacatgctggccctggaccccagcaagagatgcaccgccgagcaggccctgcagtgcgagttcctgagagacgtggagcccagcaagatgcccccccccgacctgcccctgtggcaggactgccacgagctgtggagcaagaagagaagaagacagaagcagatgggcatgaccgacgacgtgagcaccatcaaggcccccagaaaggacctgagcctgggcctggacgacagcagaaccaacaccccccagggcgtgctgcccagcagccagctgaagagccagggcagcagcaacgtggcccccgtgaagaccggccccggccagcacctgaaccacagcgagctggccatcctgctgaacctgctgcagagcaagaccagcgtgaacatggccgacttcgtgcaggtgctgaacatcaaggtgaacagcgagacccagcagcagctgaacaagatcaacctgcccgccggcatcctggccaccggcgagaagcagaccgaccccagcaccccccagcaggagagcagcaagcccctgggcggcatccagcccagcagccagaccatccagcccaaggtggagaccgacgccgcccaggccgccgtgcagagcgccttcgccgtgctgctgacccagctgatcaaggcccagcagagcaagcagaaggacgtgctgctggaggagagagagaacggcagcggccacgaggccagcctgcagctgagacccccccccgagcccagcacccccgtgagcggccaggacgacctgatccagcaccaggacatgagaatcctggagctgacccccgagcccgacagacccagaatcctgccccccgaccagagaccccccgagccccccgagcccccccccgtgaccgaggaggacctggactacagaaccgagaaccagcacgtgcccaccaccagcagcagcctgaccgacccccacgccggcgtgaaggccgccctgctgcagctgctggcccagcaccagccccaggacgaccccaagagagagggcggcatcgactaccaggccggcgacacctacgtgagcaccagcgactacaaggacaacttcggcagcagcagcttcagcagcgccccctacgtgagcaacgacggcctgggcagcagcagcgccccccccctggagagaagaagcttcatcggcaacagcgacatccagagcctggacaactacagcaccgccagcagccacagcggcggccccccccagcccagcgccttcagcgagagcttccccagcagcgtggccggctacggcgacatctacctgaacgccggccccatgctgttcagcggcgacaaggaccacagattcgagtacagccacggccccatcgccgtgctggccaacagcagcgaccccagcaccggccccgagagcacccaccccctgcccgccaagatgcacaactacaactacggcggcaacctgcaggagaaccccagcggccccagcctgatgcacggccagacctggaccagccccgcccagggccccggctacagccagggctacagaggccacatcagcaccagcaccggcagaggcagaggcagaggcctgccctactag

SEQ ID NO: 7894 - DNA, 4359 bp, Artificial Sequence
  Description of Artificial Sequence: Synthetic coding sequence
atgcccagcagcagcgacaccgccctgggcggcggcggcggcctgagctgggccgagaagaagctggaggagagaagaaagagaagaagattcctgagcccccagcagccccccctgctgctgcccctgctgcagccccagctgctgcagcccccccccccccccccccccctgctgttcctggccgcccccggcaccgccgccgccgccgccgccgccgccgccgccagcagcagctgcttcagccccggcccccccctggaggtgaagagactggccagaggcaagagaagagccggcggcagacagaagagaagaagaggccccagagccggccaggaggccgagaagagaagagtgttcagcctgccccagccccagcaggacggcggcggcggcgccagcagcggcggcggcgtgacccccctggtggagtacgaggacgtgagcagccagagcgagcagggcctgctgctgggcggcgccagcgccgccaccgccgccaccgccgccggcggcaccggcggcagcggcggcagccccgccagcagcagcggcacccagagaagaggcgagggcagcgagagaagacccagaagagacagaagaagcagcagcggcagaagcaaggagagacacagagagcacagaagaagagacggccagagaggcggcagcgaggccagcaagagcagaagcagacacagccacagcggcgaggagagagccgaggtggccaagagcggcagcagcagcagcagcggcggcagaagaaagagcgccagcgccaccagcagcagcagcagcagcagaaaggacagagacagcaaggcccacagaagcagaaccaagagcagcaaggagccccccagcgcctacaaggagccccccaaggcctacagagaggacaagaccgagcccaaggcctacagaagaagaagaagcctgagccccctgggcggcagagacgacagccccgtgagccacagagccagccagagcctgagaagcagaaagagccccagccccgccggcggcggcagcagcccctacagcagaagactgcccagaagccccagcccctacagcagaagaagaagccccagctacagcagacacagcagctacgagagaggcggcgacgtgagccccagcccctacagcagcagcagctggagaagaagcagaagcccctacagccccgtgctgagaagaagcggcaagagcagaagcagaagcccctacagcagcagacacagcagaagcagaagcagacacagactgagcagaagcagaagcagacacagcagcatcagccccagcaccctgaccctgaagagcagcctggccgccgagctgaacaagaacaagaaggccagagccgccgaggccgccagagccgccgaggccgccaaggccgccgaggccaccaaggccgccgaggccgccgccaaggccgccaaggccagcaacaccagcacccccaccaagggcaacaccgagaccagcgccagcgccagccagaccaaccacgtgaaggacgtgaagaagatcaagatcgagcacgcccccagccccagcagcggcggcaccctgaagaacgacaaggccaagaccaagccccccctgcaggtgaccaaggtggagaacaacctgatcgtggacaaggccaccaagaaggccgtgatcgtgggcaaggagagcaagagcgccgccaccaaggaggagagcgtgagcctgaaggagaagaccaagcccctgacccccagcatcggcgccaaggagaaggagcagcacgtggccctggtgaccagcaccctgccccccctgcccctgccccccatgctgcccgaggacaaggaggccgacagcctgagaggcaacatcagcgtgaaggccgtgaagaaggaggtggagaagaagctgagatgcctgctggccgacctgcccctgccccccgagctgcccggcggcgacgacctgagcaagagccccgaggagaagaagaccgccacccagctgcacagcaagagaagacccaagatctgcggccccagatacggcgagaccaaggagaaggacatcgactggggcaagagatgcgtggacaagttcgacatcatcggcatcatcggcgagggcacctacggccaggtgtacaaggccagagacaaggacaccggcgagatggtggccctgaagaaggtgagactggacaacgagaaggagggcttccccatcaccgccatcagagagatcaagatcctgagacagctgacccaccagagcatcatcaacatgaaggagatcgtgaccgacaaggaggacgccctggacttcaagaaggacaagggcgccttctacctggtgttcgagtacatggaccacgacctgatgggcctgctggagagcggcctggtgcacttcaacgagaaccacatcaagagcttcatgagacagctgatggagggcctggactactgccacaagaagaacttcctgcacagagacatcaagtgcagcaacatcctgctgaacaacagaggccagatcaagctggccgacttcggcctggccagactgtacagcagcgaggagagcagaccctacaccaacaaggtgatcaccctgtggtacagaccccccgagctgctgctgggcgaggagagatacacccccgccatcgacgtgtggagctgcggctgcatcctgggcgagctgttcaccaagaagcccatcttccaggccaaccaggagctggcccagctggagctgatcagcagaatctgcggcagcccctgccccgccgtgtggcccgacgtgatcaagctgccctacttcaacaccatgaagcccaagaagcagtacagaagaaagctgagagaggagttcgtgttcatccccgccgccgccctggacctgttcgactacatgctggccctggaccccagcaagagatgcaccgccgagcaggccctgcagtgcgagttcctgagagacgtggagcccagcaagatgcccccccccgacctgcccctgtggcaggactgccacgagctgtggagcaagaagagaagaagacagaagcagatgggcatgaccgacgacgtgagcaccatcaaggcccccagaaaggacctgagcctgggcctggacgacagcagaaccaacaccccccagggcgtgctgcccagcagccagctgaagagccagggcagcagcaacgtggcccccggcgagaagcagaccgaccccagcaccccccagcaggagagcagcaagcccctgggcggcatccagcccagcagccagaccatccagcccaaggtggagaccgacgccgcccaggccgccgtgcagagcgccttcgccgtgctgctgacccagctgatcaaggcccagcagagcaagcagaaggacgtgctgctggaggagagagagaacggcagcggccacgaggccagcctgcagctgagacccccccccgagcccagcacccccgtgagcggccaggacgacctgatccagcaccaggacatgagaatcctggagctgacccccgagcccgacagacccagaatcctgccccccgaccagagaccccccgagccccccgagcccccccccgtgaccgaggaggacctggactacagaaccgagaaccagcacgtgcccaccaccagcagcagcctgaccgacccccacgccggcgtgaaggccgccctgctgcagctgctggcccagcaccagccccaggacgaccccaagagagagggcggcatcgactaccaggccggcgacacctacgtgagcaccagcgactacaaggacaacttcggcagcagcagcttcagcagcgccccctacgtgagcaacgacggcctgggcagcagcagcgccccccccctggagagaagaagcttcatcggcaacagcgacatccagagcctggacaactacagcaccgccagcagccacagcggcggccccccccagcccagcgccttcagcgagagcttccccagcagcgtggccggctacggcgacatctacctgaacgccggccccatgctgttcagcggcgacaaggaccacagattcgagtacagccacggccccatcgccgtgctggccaacagcagcgaccccagcaccggccccgagagcacccaccccctgcccgccaagatgcacaactacaactacggcggcaacctgcaggagaaccccagcggccccagcctgatgcacggccagacctggaccagccccgcccagggccccggctacagccagggctacagaggccacatcagcaccagcaccggcagaggcagaggcagaggcctgccctactag

SEQ ID NO: 7895 - DNA, 1770 bp, Artificial Sequence
  Description of Artificial Sequence: Synthetic coding sequence
atgaccggcctgctgaagagaaagttcgaccagctggacgaggacaacagcagcgtgagcagcagcagcagcagcagcggctgccagagcagaagctgcagccccagcagcagcgtgagcagagcctgggacagcgaggaggagggcccctgggaccagatgcccctgcccgacagagacttctgcggccccagaagcttcacccccctgagcatcctgaagagagccagaagagagagacccggcagagtggccttcgacggcatcaccgtgttctacttccccagatgccagggcttcaccagcgtgcccagcagaggcggctgcaccctgggcatggccctgagacacagcgcctgcagaagattcagcctggccgagttcgcccaggagcaggccagagccagacacgagaagctgagacagagactgaaggaggagaagctggagatgctgcagtggaagctgagcgccgccggcgtgccccaggccgaggccggcctgccccccgtggtggacgccatcgacgacgccagcgtggaggaggacctggccgtggccgtggccggcggcagactggaggaggtgagcttcctgcagccctaccccgccagaagaagaagagccctgctgagagccagcggcgtgagaagaatcgacagagaggagaagagagagctgcaggccctgagacagagcagagaggactgcggctgccactgcgacagaatctgcgaccccgagacctgcagctgcagcctggccggcatcaagtgccagatggaccacaccgccttcccctgcggctgctgcagagagggctgcgagaaccccatgggcagagtggagttcaaccaggccagagtgcagacccacttcatccacaccctgaccagactgcagctggagcaggaggccgagagcttcagagagctggaggcccccgcccagggcagcccccccagccccggcgaggaggccctggtgcccaccttccccctggccaagccccccatgaacaacgagctgggcgacaacagctgcagcagcgacatgaccgacagcagcaccgccagcagcagcgccagcggcaccagcgaggcccccgactgccccacccaccccggcctgcccggccccggcttccagcccggcgtggacgacgacagcctggccagaatcctgagcttcagcgacagcgacttcggcggcgaggaggaggaggaggaggagggcagcgtgggcaacctggacaacctgagctgcttccaccccgccgacatcttcggcaccagcgaccccggcggcctggccagctggacccacagctacagcggctgcagcttcaccagcggcgtgctggacgagaacgccaacctggacgccagctgcttcctgaacggcggcctggagggcagcagagagggcagcctgcccggcaccagcgtgccccccagcatggacgccggcagaagcagcagcgtggacctgagcctgagcagctgcgacagcttcgagctgctgcaggccctgcccgactacagcctgggcccccactacaccagccagaaggtgagcgacagcctggacaacatcgaggccccccacttccccctgcccggcctgagcccccccggcgacgccagcagctgcttcctggagagcctgatgggcttcagcgagcccgccgccgaggccctggaccccttcatcgacagccagttcgaggacaccgtgcccgccagcctgatggagcccgtgcccgtgtag

SEQ ID NO: 7896 - DNA, 744 bp, Artificial Sequence
  Description of Artificial Sequence: Synthetic coding sequence
agaagaagatgcagaaccagaagagccagaggcggctggaccgacggctgcagagccgagagaaccgagagcagaagaagaggcagacccagacccggcagaggcagcagaagatgcccccccagagccagcggcctgcaggccgtgtgcccccagacccccgagcacgtgagacaccaccacgactgggccgtggaggaggaggagggcagcgtgggcaacctggacaacctgagctgcttccaccccgccgacatcttcggcaccagcgaccccggcggcctggccagctggacccacagctacagcggctgcagcttcaccagcggcgtgctggacgagaacgccaacctggacgccagctgcttcctgaacggcggcctggagggcagcagagagggcagcctgcccggcaccagcgtgccccccagcatggacgccggcagaagcagcagcgtggacctgagcctgagcagctgcgacagcttcgagctgctgcaggccctgcccgactacagcctgggcccccactacaccagccagaaggtgagcgacagcctggacaacatcgaggccccccacttccccctgcccggcctgagcccccccggcgacgccagcagctgcttcctggagagcctgatgggcttcagcgagcccgccgccgaggccctggaccccttcatcgacagccagttcgaggacaccgtgcccgccagcctgatggagcccgtgcccgtgtag

SEQ ID NO: 7897 - DNA, 1770 bp, Artificial Sequence; identical to SEQ ID NO: 7895
  Description of Artificial Sequence: Synthetic coding sequence

SEQ ID NO: 7898 - DNA, 1191 bp, Artificial Sequence
  Description of Artificial Sequence: Synthetic coding sequence
atgctgagcgaggtgctgctggtgagcgcccccggcaaggtgatcctgcacggcgagcacgccgtggtgcacggcaaggtggccctggccgtgagcctgaacctgagaaccttcctgagactgcagccccacagcaacggcaaggtggacctgagcctgcccaacatcggcatcaagagagcctgggacgtggccagactgcagagcctggacaccagcttcctggagcagggcgacgtgaccacccccaccagcgagcaggtggagaagctgaaggaggtggccggcctgcccgacgactgcgccgtgaccgagagactggccgtgctggccttcctgtacctgtacctgagcatctgcagaaagcagagagccctgcccagcctggacatcgtggtgtggagcgagctgccccccggcgccggcctgggcagcagcgccgcctacagcgtgtgcctggccgccgccctgctgaccgtgtgcgaggagatccccaaccccctgaaggacggcgactgcgtgaacagatggaccaaggaggacctggagctgatcaacaagtgggccttccagggcgagagaatgatccacggcaaccccagcggcgtggacaacgccgtgagcacctggggcggcgccctgagataccaccagggcaagatcagcagcctgaagagaagccccgccctgcagatcctgctgaccaacaccaaggtgcccagaaacaccagagccctggtggccggcgtgagaaacagactgctgaagttccccgagatcgtggcccccctgctgaccagcatcgacgccatcagcctggagtgcgagagagtgctgggcgagatgggcgaggcccccgcccccgagcagtacctggtgctggaggagctgatcgacatgaaccagcaccacctgaacgccctgggcgtgggccacgccagcctggaccagctgtgccaggtgaccagagccagaggcctgcacagcaagctgaccggcgccggcggcggcggctgcggcatcaccctgctgaagcccggcctggagcagcccgaggtggaggccaccaagcaggccctgaccagctgcggcttcgactgcctggagaccagcatcggcgcccccggcgtgagcatccacagcgccaccagcctggacagcagagtgcagcaggccctggacggcctgtag

SEQ ID NO: 7899 - DNA, 177 bp, Artificial Sequence
  Description of Artificial Sequence: Synthetic coding sequence
atggacgccttcaccggcagcggcctgaagagaaagttcgacgacgtggacgtgggcagcagcgtgagcaacagcgacgacgagatcagcagcagcgacagcgccgacagctgcgacagcctgaacccccccaccaccgccagcttcacccccaccagcatcctgaagagacagtag

SEQ ID NO: 7900 - DNA, 345 bp, Artificial Sequence
  Description of Artificial Sequence: Synthetic coding sequence
atggacgccttcaccggcagcggcctgaagagaaagttcgacgacgtggacgtgggcagcagcgtgagcaacagcgacgacgagatcagcagcagcgacagcgccgacagctgcgacagcctgaacccccccaccaccgccagcttcacccccaccagcatcctgaagagacagaagcagctgagaagaaagaacgtgagattcgaccaggtgaccgtgtactacttcgccagaagacagggcttcaccagcgtgcccagccagggcggcagcagcctgggcatggcccagagacacaacagcgtgagaagctacaccctgtgcgagttcgcccaggagcagtag

SEQ ID NO: 7901 - DNA, 261 bp, Artificial Sequence
  Description of Artificial Sequence: Synthetic coding sequence
atggacgccttcaccggcagcggcctgaagagaaagttcgacgacgtggacgtgggcagcagcgtgagcaacagcgacgacgagatcagcagcagcgacagcgccgacagctgcgacagcctgaacccccccaccaccgccagcttcacccccaccagcatcctgaagagacagaagcagctgagaagaaagaacgtgagattcgaccaggtgaccgtgtactacttcgccagaagacagggcttcaccagcgtgccctag

SEQ ID NO: 7902 - DNA, 1758 bp, Artificial Sequence
  Description of Artificial Sequence: Synthetic coding sequence
atgagcggcatcctgaagagaaagttcgaggaggtggacggcagcagcccctgcagcagcgtgagagagagcgacgacgaggtgagcagcagcgagagcgccgacagcggcgacagcgtgaaccccagcaccagcagccacttcacccccagcagcatcctgaagagagagaagagactgagaaccaagaacgtgcacttcagctgcgtgaccgtgtactacttcaccagaagacagggcttcaccagcgtgcccagccagggcggcagcaccctgggcatgagcagcagacacaacagcgtgagacagtacaccctgggcgagttcgccagagagcaggagagactgcacagagagatgctgagagagcacctgagagaggagaagctgaacagcctgaagctgaagatgaccaagaacggcaccgtggagagcgaggaggccagcaccctgaccctggacgacatcagcgacgacgacatcgacctggacaacaccgaggtggacgagtacttcttcctgcagcccctgcccaccaagaagagaagagccctgctgagagccagcggcgtgaagaagatcgacgtggaggagaagcacgagctgagagccatcagactgagcagagaggactgcggctgcgactgcagagtgttctgcgaccccgacacctgcacctgcagcctggccggcatcaagtgccaggtggacagaatgagcttcccctgcggctgcaccaaggagggctgcagcaacaccgccggcagaatcgagttcaaccccatcagagtgagaacccacttcctgcacaccatcatgaagctggagctggagaagaacagagagcagcagatccccaccctgaacggctgccacagcgagatcagcgcccacagcagcagcatgggccccgtggcccacagcgtggagtacagcatcgccgacagcttcgagatcgagaccgagccccaggccgccgtgctgcacctgcagagcgccgaggagctggactgccagggcgaggaggaggaggaggaggaggacggcagcagcttctgcagcggcgtgaccgacagcagcacccagagcctggcccccagcgagagcgacgaggaggaggaggaggaggaggaggaggaggaggaggaggacgacgacgacgacaagggcgacggcttcgtggagggcctgggcacccacgccgaggtggtgcccctgcccagcgtgctgtgctacagcgacggcaccgccgtgcacgagagccacgccaagaacgccagcttctacgccaacagcagcaccctgtactaccagatcgacagccacatccccggcacccccaaccagatcagcgagaactacagcgagagagacaccgtgaagaacggcaccctgagcctggtgccctacaccatgacccccgagcagttcgtggactacgccagacaggccgaggaggcctacggcgccagccactaccccgccgccaaccccagcgtgatcgtgtgctgcagcagcagcgagaacgacagcggcgtgccctgcaacagcctgtaccccgagcacagaagcaaccacccccaggtggagttccacagctacctgaagggccccagccaggagggcttcgtgagcgccctgaacggcgacagccacatcagcgagcaccccgccgagaacagcctgagcctggccgagaagagcatcctgcacgaggagtgcatcaagagccccgtggtggagaccgtgcccgtgtag

SEQ ID NO: 7903 - DNA, 1758 bp, Artificial Sequence; identical to SEQ ID NO: 7902
  Description of Artificial Sequence: Synthetic coding sequence

SEQ ID NO: 7904 - DNA, 1854 bp, Artificial Sequence
  Description of Artificial Sequence: Synthetic coding sequence
atgaagtgcgccctgttcctgagagtgaagatcctgcagagagtgtgcagaagcagatacatcgtgcacgccggcacctgcgacagcaccgccgccatgagcggcatcctgaagagaaagttcgaggaggtggacggcagcagcccctgcagcagcgtgagagagagcgacgacgaggtgagcagcagcgagagcgccgacagcggcgacagcgtgaaccccagcaccagcagccacttcacccccagcagcatcctgaagagagagaagagactgagaaccaagaacgtgcacttcagctgcgtgaccgtgtactacttcaccagaagacagggcttcaccagcgtgcccagccagggcggcagcaccctgggcatgagcagcagacacaacagcgtgagacagtacaccctgggcgagttcgccagagagcaggagagactgcacagagagatgctgagagagcacctgagagaggagaagctgaacagcctgaagctgaagatgaccaagaacggcaccgtggagagcgaggaggccagcaccctgaccctggacgacatcagcgacgacgacatcgacctggacaacaccgaggtggacgagtacttcttcctgcagcccctgcccaccaagaagagaagagccctgctgagagccagcggcgtgaagaagatcgacgtggaggagaagcacgagctgagagccatcagactgagcagagaggactgcggctgcgactgcagagtgttctgcgaccccgacacctgcacctgcagcctggccggcatcaagtgccaggtggacagaatgagcttcccctgcggctgcaccaaggagggctgcagcaacaccgccggcagaatcgagttcaaccccatcagagtgagaacccacttcctgcacaccatcatgaagctggagctggagaagaacagagagcagcagatccccaccctgaacggctgccacagcgagatcagcgcccacagcagcagcatgggccccgtggcccacagcgtggagtacagcatcgccgacagcttcgagatcgagaccgagccccaggccgccgtgctgcacctgcagagcgccgaggagctggactgccagggcgaggaggaggaggaggaggaggacggcagcagcttctgcagcggcgtgaccgacagcagcacccagagcctggcccccagcgagagcgacgaggaggaggaggaggaggaggaggaggaggaggaggaggacgacgacgacgacaagggcgacggcttcgtggagggcctgggcacccacgccgaggtggtgcccctgcccagcgtgctgtgctacagcgacggcaccgccgtgcacgagagccacgccaagaacgccagcttctacgccaacagcagcaccctgtactaccagatcgacagccacatccccggcacccccaaccagatcagcgagaactacagcgagagagacaccgtgaagaacggcaccctgagcctggtgccctacaccatgacccccgagcagttcgtggactacgccagacaggccgaggaggcctacggcgccagccactaccccgccgccaaccccagcgtgatcgtgtgctgcagcagcagcgagaacgacagcggcgtgccctgcaacagcctgtaccccgagcacagaagcaaccacccccaggtggagttccacagctacctgaagggccccagccaggagggcttcgtgagcgccctgaacggcgacagccacatcagcgagcaccccgccgagaacagcctgagcctggccgagaagagcatcctgcacgaggagtgcatcaagagccccgtggtggagaccgtgcccgtgtag

SEQ ID NO: 7905 - DNA, 417 bp, Artificial Sequence
  Description of Artificial Sequence: Synthetic coding sequence
atgagcggcatcctgaagagaaagttcgaggaggtggacggcagcagcccctgcagcagcgtgagagagagcgacgacgaggtgagcagcagcgagagcgccgacagcggcgacagcgtgaaccccagcaccagcagccacttcacccccagcagcatcctgaagagagagaagagactgagaaccaagaacgtgcacttcagctgcgtgaccgtgtactacttcaccagaagacagggcttcaccagcgtgcccagccagggcggcagcaccctgggcatgagcagcagacacaacagcgtgagacagtacaccctgggcgagttcgccagagagcaggagagactgcacagagagatgctgagagagcacctgagagaggagaagctgaacagcctgaagctgaagatgacctag

SEQ ID NO: 7906 - DNA, 1314 bp, Artificial Sequence
  Description of Artificial Sequence: Synthetic coding sequence
atgagcggcatcctgaagagaaagttcgaggaggtggacggcagcagcccctgcagcagcgtgagagagagcgacgacgaggtgagcagcagcgagagcgccgacagcggcgacagcgtgaaccccagcaccagcagccacttcacccccagcagcatcctgaagagagagaagagactgagaaccaagaacgtgcacttcagctgcgtgaccgtgtactacttcaccagaagacagggcttcaccagcgtgcccagccagggcggcagcaccctgggcatgagcagcagacacaacagcgtgagacagtacaccctgggcgagttcgccagagagcaggagagactgcacagagagatgctgagagagcacctgagagaggagaagctgaacagcctgaagctgaagatgaccaagaacggcaccgtggagagcgaggaggccagcaccctgaccctggacgacatcagcgacgacgacatcgacctggacaacaccgaggtggacgagtacttcttcctgcagcccctgcccaccaagaagagaagagccctgctgagagccagcggcgtgaagaagatcgacgtggaggagaagcacgagctgagagccatcagactgagcagagaggactgcggctgcgactgcagagtgttctgcgaccccgacacctgcacctgcagcctggccggcatcaagtgccaggtggacagaatgagcttcccctgcggctgcaccaaggagggctgcagcaacaccgccggcagaatcgagttcaaccccatcagagtgagaacccacttcctgcacaccatcatgaagctggagctggagaagaacagagagcagcagatccccaccctgaacggctgccacagcgagatcagcgcccacagcagcagcatgggccccgtggcccacagcgtggagtacagcatcgccgacagcttcgagatcgagaccgagccccaggccgccgtgctgcacctgcagagcgccgaggagctggactgccagggcgaggaggaggaggaggaggaggacggcagcagcttctgcagcggcgtgaccgacagcagcacccagagcctggcccccagcgagagcgacgaggaggaggaggaggaggaggaggaggaggaggaggaggacgacgacgacgacaagggcgacggcttcgtggagggcctgggcacccacgccgaggtggtgcccctgcccagcgtgctgtgctacagcgacggcaccgccgtgcacgagagccacgccaagaacgccagcttctacgccaacagcagcaccctgtactactag

SEQ ID NO: 7907 - DNA, 1569 bp, Artificial Sequence
  Description of Artificial Sequence: Synthetic coding sequence
acctgcgacagcaccgccgccatgagcggcatcctgaagagaaagttcgaggaggtggacggcagcagcccctgcagcagcgtgagagagagcgacgacgaggtgagcagcagcgagagcgccgacagcggcgacagcgtgaaccccagcaccagcagccacttcacccccagcagcatcctgaagagagagaagagactgagaaccaagaacgtgcacttcagctgcgtgaccgtgtactacttcaccagaagacagggcttcaccagcgtgcccagccagggcggcagcaccctgggcatgagcagcagacacaacagcgtgagacagtacaccctgggcgagttcgccagagagcaggagagactgcacagagagatgctgagagagcacctgagagaggagaagctgaacagcctgaagctgaagatgaccaagaacggcaccgtggagagcgaggaggccagcaccctgaccctggacgacatcagcgacgacgacatcgacctggacaacaccgaggtggacgagtacttcttcctgcagcccctgcccaccaagaagagaagagccctgctgagagccagcggcgtgaagaagatcgacgtggaggagaagcacgagctgagagccatcagactgagcagagaggactgcggctgcgactgcagagtgttctgcgaccccgacacctgcacctgcagcctggccggcatcaagtgccaggtggacagaatgagcttcccctgcggctgcaccaaggagggctgcagcaacaccgccggcagaatcgagttcaaccccatcagagtgagaacccacttcctgcacaccatcatgaagctggagctggagaagaacagagagcagcagatccccaccctgaacggctgccacagcgagatcagcgcccacagcagcagcatgggccccgtggcccacagcgtggagtacagcatcgccgacagcttcgagatcgagaccgagccccaggccgccgtgctgcacctgcagagcgccgaggagctggactgccagggcgaggaggaggaggaggaggaggacggcagcagcttctgcagcggcgtgaccgacagcagcacccagagcctggcccccagcgagagcgacgaggaggaggaggaggaggaggaggaggaggaggaggaggacgacgacgacgacaagggcgacggcttcgtggagggcctgggcacccacgccgaggtggtgcccctgcccagcgtgctgtgctacagcgacggcaccgccgtgcacgagagccacgccaagaacgccagcttctacgccaacagcagcaccctgtactaccagaacgacagcggcgtgccctgcaacagcctgtaccccgagcacagaagcaaccacccccaggtggagttccacagctacctgaagggccccagccaggagggcttcgtgagcgccctgaacggcgacagccacatcagcgagcaccccgccgagaacagcctgagcctggccgagaagagcatcctgcacgaggagtgcatcaagagccccgtggtggagaccgtgcccgtgtag

SEQ ID NO: 7908 - DNA, 2127 bp, Artificial Sequence
  Description of Artificial Sequence: Synthetic coding sequence
atggccgtgcccgccgccctgatcccccccacccagctggtgcccccccagccccccatcagcaccagcgccagcagcagcggcaccaccaccagcaccagcagcgccaccagcagccccgcccccagcatcggcccccccgccagcagcggccccaccctgttcagacccgagcccatcgccagcgccgccgccgccgccgccaccgtgaccagcaccggcggcggcggcggcggcggcggcggcggcagcggcggcggcggcggcagcagcggcaacggcggcggcggcggcggcggcggcggcggcagcaactgcaaccccaacctggccgccgccagcaacggcagcggcggcggcggcggcggcatcagcgccggcggcggcgtggccagcagcacccccatcaacgccagcaccggcagcagcagcagcagcagcagcagcagcagcagcagcagcagcagcagcagcagcagcagcagcagcagcagctgcggccccctgcccggcaagcccgtgtacagcacccccagccccgtggagaacaccccccagaacaacgagtgcaagatggtggacctgagaggcgccaaggtggccagcttcaccgtggagggctgcgagctgatctgcctgccccaggccttcgacctgttcctgaagcacctggtgggcggcctgcacaccgtgtacaccaagctgaagagactggagatcacccccgtggtgtgcaacgtggagcaggtgagaatcctgagaggcctgggcgccatccagcccggcgtgaacagatgcaagctgatcagcagaaaggacttcgagaccctgtacaacgactgcaccaacgccagcagcagacccggcagaccccccaagagaacccagagcgtgaccagccccgagaacagccacatcatgccccacagcgtgcccggcctgatgagccccggcatcatcccccccaccggcctgaccgccgccgccgccgccgccgccgccgccaccaacgccgccatcgccgaggccatgaaggtgaagaagatcaagctggaggccatgagcaactaccacgccagcaacaaccagcacggcgccgacagcgagaacggcgacatgaacagcagcgtgggcctggagctgcccttcatgatgatgccccaccccctgatccccgtgagcctgccccccgccagcgtgaccatggccatgagccagatgaaccacctgagcaccatcgccaacatggccgccgccgcccaggtgcagagcccccccagcagagtggagaccagcgtgatcaaggagagagtgcccgacagccccagccccgcccccagcctggaggagggcagaagacccggcagccaccccagcagccacagaagcagcagcgtgagcagcagccccgccagaaccgagagcagcagcgacagaatccccgtgcaccagaacggcctgagcatgaaccagatgctgatgggcctgagccccaacgtgctgcccggccccaaggagggcgacctggccggccacgacatgggccacgagagcaagagaatgcacatcgagaaggacgagacccccctgagcacccccaccgccagagacagcctggacaagctgagcctgaccggccacggccagcccctgccccccggcttccccagccccttcctgttccccgacggcctgagcagcatcgagaccctgctgaccaacatccagggcctgctgaaggtggccatcgacaacgccagagcccaggagaagcaggtgcagctggagaagaccgagctgaagatggacttcctgagagagagagagctgagagagaccctggagaagcagctggccatggagcagaagaacagagccatcgtgcagaagagactgaagaaggagaagaaggccaagagaaagctgcaggaggccctggagttcgagaccaagagaagagagcaggccgagcagaccctgaagcaggccgccagcaccgacagcctgagagtgctgaacgacagcctgacccccgagatcgaggccgacagaagcggcggcagaaccgacgccgagagaaccatccaggacggcagactgtacctgaagaccaccgtgatgtactag

SEQ ID NO: 7909 - DNA, 1683 bp, Artificial Sequence
  Description of Artificial Sequence: Synthetic coding sequence
atggccgtgcccgccgccctgatcccccccacccagctggtgcccccccagccccccatcagcaccagcgccagcagcagcggcaccaccaccagcaccagcagcgccaccagcagccccgcccccagcatcggcccccccgccagcagcggccccaccctgttcagacccgagcccatcgccagcgccgccgccgccgccgccaccgtgaccagcaccggcggcggcggcggcggcggcggcggcggcagcggcggcggcggcggcagcagcggcaacggcggcggcggcggcggcggcggcggcggcagcaactgcaaccccaacctggccgccgccagcaacggcagcggcggcggcggcggcggcatcagcgccggcggcggcgtggccagcagcacccccatcaacgccagcaccggcagcagcagcagcagcagcagcagcagcagcagcagcagcagcagcagcagcagcagcagcagcagcagcagctgcggccccctgcccggcaagcccgtgtacagcacccccagccccgtggagaacaccccccagaacaacgagtgcaagatggtggacctgagaggcgccaaggtggccagcttcaccgtggagggctgcgagctgatctgcctgccccaggccttcgacctgttcctgaagcacctggtgggcggcctgcacaccgtgtacaccaagctgaagagactggagatcacccccgtggtgtgcaacgtggagcaggtgagaatcctgagaggcctgggcgccatccagcccggcgtgaacagatgcaagctgatcagcagaaaggacttcgagaccctgtacaacgactgcaccaacgccagcagcagacccggcagaccccccaagagaacccagagcgtgaccagccccgagaacagccacatcatgccccacagcgtgcccggcctgatgagccccggcatcatcccccccaccggcctgaccgccgccgccgccgccgccgccgccgccaccaacgccgccatcgccgaggccatgaaggtgaagaagatcaagctggaggccatgagcaactaccacgccagcaacaaccagcacggcgccgacagcgagaacggcgacatgaacagcagcgtggacgagacccccctgagcacccccaccgccagagacagcctggacaagctgagcctgaccggccacggccagcccctgccccccggcttccccagccccttcctgttccccgacggcctgagcagcatcgagaccctgctgaccaacatccagggcctgctgaaggtggccatcgacaacgccagagcccaggagaagcaggtgcagctggagaagaccgagctgaagatggacttcctgagagagagagagctgagagagaccctggagaagcagctggccatggagcagaagaacagagccatcgtgcagaagagactgaagaaggagaagaaggccaagagaaagctgcaggaggccctggagttcgagaccaagagaagagagcaggccgagcagaccctgaagcaggccgccagcaccgacagcctgagagtgctgaacgacagcctgacccccgagatcgaggccgacagaagcggcggcagaaccgacgccgagagaaccatccaggacggcagactgtacctgaagaccaccgtgatgtactag

SEQ ID NO: 7910 - DNA, 1521 bp, Artificial Sequence
  Description of Artificial Sequence: Synthetic coding sequence
atggccgtgcccgccgccctgatcccccccacccagctggtgcccccccagccccccatcagcaccagcgccagcagcagcggcaccaccaccagcaccagcagcgccaccagcagccccgcccccagcatcggcccccccgccagcagcggccccaccctgttcagacccgagcccatcgccagcgccgccgccgccgccgccaccgtgaccagcaccggcggcggcggcggcggcggcggcggcggcagcggcggcggcggcggcagcagcggcaacggcggcggcggcggcggcggcggcggcggcagcaactgcaaccccaacctggccgccgccagcaacggcagcggcggcggcggcggcggcatcagcgccggcggcggcgtggccagcagcacccccatcaacgccagcaccggcagcagcagcagcagcagcagcagcagcagcagcagcagcagcagcagcagcagcagcagcagcagcagcagctgcggccccctgcccggcaagcccgtgtacagcacccccagccccgtggagaacaccccccagaacaacgagtgcaagatggtggacctgagaggcgccaaggtggccagcttcaccgtggagggctgcgagctgatctgcctgccccaggccttcgacctgttcctgaagcacctggtgggcggcctgcacaccgtgtacaccaagctgaagagactggagatcacccccgtggtgtgcaacgtggagcaggtgagaatcctgagaggcctgggcgccatccagcccggcgtgaacagatgcaagctgatcagcagaaaggacttcgagaccctgtacaacgactgcaccaacgccagcagcagacccggcagaccccccaagagaacccagagcgtgaccagccccgagaacagccacatcatgccccacagcgtgcccggcctgatgagccccggcatcatcccccccaccgacgagacccccctgagcacccccaccgccagagacagcctggacaagctgagcctgaccggccacggccagcccctgccccccggcttccccagccccttcctgttccccgacggcctgagcagcatcgagaccctgctgaccaacatccagggcctgctgaaggtggccatcgacaacgccagagcccaggagaagcaggtgcagctggagaagaccgagctgaagatggacttcctgagagagagagagctgagagagaccctggagaagcagctggccatggagcagaagaacagagccatcgtgcagaagagactgaagaaggagaagaaggccaagagaaagctgcaggaggccctggagttcgagaccaagagaagagagcaggccgagcagaccctgaagcaggccgccagcaccgacagcctgagagtgctgaacgacagcctgacccccgagatcgaggccgacagaagcggcggcagaaccgacgccgagagaaccatccaggacggcagactgtacctgaagaccaccgtgatgtactag

SEQ ID NO: 7911 - DNA, 2283 bp, Artificial Sequence
  Description of Artificial Sequence: Synthetic coding sequence
atggccgtgcccgccgccctgatcccccccacccagctggtgcccccccagccccccatcagcaccagcgccagcagcagcggcaccaccaccagcaccagcagcgccaccagcagccccgcccccagcatcggcccccccgccagcagcggccccaccctgttcagacccgagcccatcgccagcgccgccgccgccgccgccaccgtgaccagcaccggcggcggcggcggcggcggcggcggcggcagcggcggcggcggcggcagcagcggcaacggcggcggcggcggcggcggcggcggcggcagcaactgcaaccccaacctggccgccgccagcaacggcagcggcggcggcggcggcggcatcagcgccggcggcggcgtggccagcagcacccccatcaacgccagcaccggcagcagcagcagcagcagcagcagcagcagcagcagcagcagcagcagcagcagcagcagcagcagcagcagctgcggccccctgcccggcaagcccgtgtacagcacccccagccccgtggagaacaccccccagaacaacgagtgcaagatggtggacctgagaggcgccaaggtggccagcttcaccgtggagggctgcgagctgatctgcctgccccaggccttcgacctgttcctgaagcacctggtgggcggcctgcacaccgtgtacaccaagctgaagagactggagatcacccccgtggtgtgcaacgtggagcaggtgagaatcctgagaggcctgggcgccatccagcccggcgtgaacagatgcaagctgatcagcagaaaggacttcgagaccctgtacaacgactgcaccaacgccagcagcagacccggcagaccccccaagagaacccagagcgtgaccagccccgagaacagccacatcatgccccacagcgtgcccggcctgatgagccccggcatcatcccccccaccggcctgaccgccgccgccgccgccgccgccgccgccaccaacgccgccatcgccgaggccatgaaggtgaagaagatcaagctggaggccatgagcaactaccacgccagcaacaaccagcacggcgccgacagcgagaacggcgacatgaacagcagcgtgggcagcagcgacggcagctgggacaaggagaccctgcccagcagccccagccagggcccccaggccagcatcacccaccccagaatgcccggcgccagaagcctgcccctgagccaccccctgaaccacctgcagcagagccacctgctgcccaacggcctggagctgcccttcatgatgatgccccaccccctgatccccgtgagcctgccccccgccagcgtgaccatggccatgagccagatgaaccacctgagcaccatcgccaacatggccgccgccgcccaggtgcagagcccccccagcagagtggagaccagcgtgatcaaggagagagtgcccgacagccccagccccgcccccagcctggaggagggcagaagacccggcagccaccccagcagccacagaagcagcagcgtgagcagcagccccgccagaaccgagagcagcagcgacagaatccccgtgcaccagaacggcctgagcatgaaccagatgctgatgggcctgagccccaacgtgctgcccggccccaaggagggcgacctggccggccacgacatgggccacgagagcaagagaatgcacatcgagaaggacgagacccccctgagcacccccaccgccagagacagcctggacaagctgagcctgaccggccacggccagcccctgccccccggcttccccagccccttcctgttccccgacggcctgagcagcatcgagaccctgctgaccaacatccagggcctgctgaaggtggccatcgacaacgccagagcccaggagaagcaggtgcagctggagaagaccgagctgaagatggacttcctgagagagagagagctgagagagaccctggagaagcagctggccatggagcagaagaacagagccatcgtgcagaagagactgaagaaggagaagaaggccaagagaaagctgcaggaggccctggagttcgagaccaagagaagagagcaggccgagcagaccctgaagcaggccgccagcaccgacagcctgagagtgctgaacgacagcctgacccccgagatcgaggccgacagaagcggcggcagaaccgacgccgagagaaccatccaggacggcagactgtacctgaagaccaccgtgatgtactag

SEQ ID NO: 7912 - DNA, 2283 bp, Artificial Sequence
  Description of Artificial Sequence: Synthetic coding sequence
atggccgtgcccgccgccctgatcccccccacccagctggtgcccccccagccccccatcagcaccagcgccagcagcagcggcaccaccaccagcaccagcagcgccaccagcagccccgcccccagcatcggcccccccgccagcagcggccccaccctgttcagacccgagcccatcgccagcgccgccgccgccgccgccaccgtgaccagcaccggcggcggcggcggcggcggcggcggcggcagcggcggcggcggcggcagcagcggcaacggcggcggcggcggcggcggcggcggcggcagcaactgcaaccccaacctggccgccgccagcaacggcagcggcggcggcggcggcggcatcagcgccggcggcggcgtggccagcagcacccccatcaacgccagcaccggcagcagcagcagcagcagcagcagcagcagcagcagcagcagcagcagcagcagcagcagcagcagcagcagctgcggccccctgcccggcaagcccgtgtacagcacccccagccccgtggagaacaccccccagaacaacgagtgcaagatggtggacctgagaggcgccaaggtggccagcttcaccgtggagggctgcgagctgatctgcctgccccaggccttcgacctgttcctgaagcacctggtgggcggcctgcacaccgtgtacaccaagctgaagagactggagatcacccccgtggtgtgcaacgtggagcaggtgagaatcctgagaggcctgggcgccatccagcccggcgtgaacagatgcaagctgatcagcagaaaggacttcgagaccctgtacaacgactgcaccaacgccagcagcagacccggcagaccccccaagagaacccagagcgtgaccagccccgagaacagccacatcatgccccacagcgtgcccggcctgatgagccccggcatcatcccccccaccggcctgaccgccgccgccgccgccgccgccgccgccaccaacgccgccatcgccgaggccatgaaggtgaagaagatcaagctggaggccatgagcaactaccacgccagcaacaaccagcacggcgccgacagcgagaacggcgacatgaacagcagcgtgggcagcagcgacggcagctgggacaaggagaccctgcccagcagccccagccagggcccccaggccagcatcacccaccccagaatgcccggcgccagaagcctgcccctgagccaccccctgaaccacctgcagcagagccacctgctgcccaacggcctggagctgcccttcatgatgatgccccaccccctgatccccgtgagcctgccccccgccagcgtgaccatggccatgagccagatgaaccacctgagcaccatcgccaacatggccgccgccgcccaggtgcagagcccccccagcagagtggagaccagcgtgatcaaggagagagtgcccgacagccccagccccgcccccagcctggaggagggcagaagacccggcagccaccccagcagccacagaagcagcagcgtgagcagcagccccgccagaaccgagagcagcagcgacagaatccccgtgcaccagaacggcctgagcatgaaccagatgctgatgggcctgagccccaacgtgctgcccggccccaaggagggcgacctggccggccacgacatgggccacgagagcaagagaatgcacatcgagaaggacgagacccccctgagcacccccaccgccagagacagcctggacaagctgagcctgaccggccacggccagcccctgccccccggcttccccagccccttcctgttccccgacggcctgagcagcatcgagaccctgctgaccaacatccagggcctgctgaaggtggccatcgacaacgccagagcccaggagaagcaggtgcagctggagaagaccgagctgaagatggacttcctgagagagagagagctgagagagaccctggagaagcagctggccatggagcagaagaacagagccatcgtgcagaagagactgaagaaggagaagaaggccaagagaaagctgcaggaggccctggagttcgagaccaagagaagagagcaggccgagcagaccctgaagcaggccgccagcaccgacagcctgagagtgctgaacgacagcctgacccccgagatcgaggccgacagaagcggcggcagaaccgacgccgagagaaccatccaggccgccagactgtacatcaagaccgtgtgcatgtactag

SEQ ID NO: 7913 - DNA, 1800 bp, Artificial Sequence
  Description of Artificial Sequence: Synthetic coding sequence
atggccgtgagcgccagccccgtgatcagcgccaccagcagcggcgccggcgtgcccggcggcctgttcagagccgagcccctgtacagcacccccagagagccccccagactgacccccaacatgatcaacagcttcgtggtgaacaaccacagcaacagcgccggcggcggcggcagaggcaacaccaacaccaacgagtgcagaatggtggacatgcacggcatgaaggtggccagcttcctgatggacggccaggagctgatctgcctgccccaggtgttcgacctgttcctgaagcacctggtgggcggcctgcacaccgtgtacaccaagctgaagagactggacatcagccccgtggtgtgcaccgtggagcaggtgagaatcctgagaggcctgggcgccatccagcccggcgtgaacagatgcaagctgatcaccagaaaggacttcgagaccctgttcaccgactgcaccaacgccagaagaaagagacagatgaccagaaagcaggccgtgaacagcagcagacccggcagaccccccaagagaagcctgggcgtgctgcaggagaacgccagactgctgacccacgccgtgcccggcctgctgagccccggcctgatcacccccaccggcatcaccgccgccgccatggccgaggccatgaagctgcagaagatgaagctgatggccatgaacaccctgcagggcaacggcagccagaacggcaccgagagcgagcccgacgacctgaacagcaacaccggcggcagcgagagcagctgggacaaggacaagatgcagagccccttcgccgcccccggcccccagcacggcatcgcccacgccgccctggccggccagcccggcatcggcggcgcccccaccctgaaccccctgcagcagaaccacctgctgaccaacagactggacctgcccttcatgatgatgccccaccccctgctgcccgtgagcctgccccccgccagcgtggccatggccatgaaccagatgaaccacctgaacaccatcgccaacatggccgccgccgcccagatccacagccccctgagcagagccggcaccagcgtgatcaaggagagaatccccgagagccccagccccgcccccagcctggaggagaaccacagacccggcagccagaccagcagccacaccagcagcagcgtgagcagcagccccagccagatggaccaccacctggagagaatggaggaggtgcccgtgcagatccccatcatgaagagccccctggacaagatccagctgacccccggccaggccctgcccgccggcttccccggccccttcatcttcgccgacagcctgagcagcgtggagaccctgctgaccaacatccagggcctgctgaaggtggccctggacaacgccagaatccaggagaagcagatccagcaggagaagaaggagctgagactggagctgtacagagagagagagatcagagagaacctggagagacagctggccgtggagctgcagagcagaaccaccatgcagaagagactgaagaaggagaagaagaccaagagaaagctgcaggaggccctggagttcgagagcaagagaagagagcaggtggagcaggccctgaagcaggccaccaccagcgacagcggcctgagaatgctgaaggacaccggcatccccgacatcgagatcgagaacaacggcaccccccacgacagcgccgccatgcagggcggcaactactactgcctggagatggcccagcagctgtacagcgcctag

SEQ ID NO: 7914 - DNA, 1800 bp, Artificial Sequence; identical to SEQ ID NO: 7913
  Description of Artificial Sequence: Synthetic coding sequence

SEQ ID NO: 7915 - DNA, 1716 bp, Artificial Sequence
  Description of Artificial Sequence: Synthetic coding sequence
atggccgtgagcgccagccccgtgatcagcgccaccagcagcggcgccggcgtgcccggcggcctgttcagagccgagcccctgtacagcacccccagagagccccccagactgacccccaacatgatcaacagcttcgtggtgaacaaccacagcaacagcgccggcggcggcggcagaggcaacaccaacaccaacgagtgcagaatggtggacatgcacggcatgaaggtggccagcttcctgatggacggccaggagctgatctgcctgccccaggtgttcgacctgttcctgaagcacctggtgggcggcctgcacaccgtgtacaccaagctgaagagactggacatcagccccgtggtgtgcaccgtggagcaggtgagaatcctgagaggcctgggcgccatccagcccggcgtgaacagatgcaagctgatcaccagaaaggacttcgagaccctgttcaccgactgcaccaacgccagcagcagacccggcagaccccccaagagaagcctgggcgtgctgcaggagaacgccagactgctgacccacgccgtgcccggcctgctgagccccggcctgatcacccccaccggcatcaccgccgccgccatggccgaggccatgaagctgcagaagatgaagctgatggccatgaacaccctgcagggcaacggcagccagaacggcaccgagagcgagcccgacgacctgaacagcaacaccggcggcagcgagagcagctgggacaaggacaagatgcagagccccttcgccgcccccggcccccagcacggcatcgcccacgccgccctggccggccagcccggcatcggcggcgcccccaccctgaaccccctgcagcagaaccacctgctgaccaacagactggacctgcccttcatgatgatgccccaccccctgctgcccgtgagcctgccccccgccagcgtggccatggccatgaaccagatgaaccacctgaacaccatcgccaacatggccgccgccgcccagatccacagccccctgagcagagccggcaccagcgtgatcaaggagagaatccccgagagccccagccccgcccccagcctggaggagaaccacagacccggcagccagaccagcagccacaccagcagcagcgtgagcagcagccccagccagatggaccaccacctggagagaatggaggaggtgcccgtgcagatccccatcatgaagagccccctggacaagatccagctgacccccggccaggccctgcccgccggcttccccggccccttcatcttcgccgacagcctgagcagcgtggagaccctgctgaccaacatccagggcctgctgaaggtggccctggacaacgccagaatccaggagaagcagatccagcaggagaagaaggagctgagactggagctgtacagagagagagagatcagagagaacctggagagacagctggccgtggagctgcagagcagaaccaccatgcagaagagactgaagaaggagaagaagaccaagagaaagctgcaggaggccctggagttcgagagcaagagaagagagcaggtggagcaggccctgaagcaggccaccaccagcgacagcggcctgagaatgctgaaggacaccggcatccccgacatcgagatcgagaacaacggcaccccccacgacagcgccgccatgcaggcctag

SEQ ID NO: 7916 - DNA, 1299 bp, Artificial Sequence
  Description of Artificial Sequence: Synthetic coding sequence
atggcccagaaccagttcttcaacagcagcagacccggcagaccccccaagagaagcctgggcgtgctgcaggagaacgccagactgctgacccacgccgtgcccggcctgctgagccccggcctgatcacccccaccggcatcaccgccgccgccatggccgaggccatgaagctgcagaagatgaagctgatggccatgaacaccctgcagggcaacggcagccagaacggcaccgagagcgagcccgacgacctgaacagcaacaccggcggcagcgagagcagctgggacaaggacaagatgcagagccccttcgccgcccccggcccccagcacggcatcgcccacgccgccctggccggccagcccggcatcggcggcgcccccaccctgaaccccctgcagcagaaccacctgctgaccaacagactggacctgcccttcatgatgatgccccaccccctgctgcccgtgagcctgccccccgccagcgtggccatggccatgaaccagatgaaccacctgaacaccatcgccaacatggccgccgccgcccagatccacagccccctgagcagagccggcaccagcgtgatcaaggagagaatccccgagagccccagccccgcccccagcctggaggagaaccacagacccggcagccagaccagcagccacaccagcagcagcgtgagcagcagccccagccagatggaccaccacctggagagaatggaggaggtgcccgtgcagatccccatcatgaagagccccctggacaagatccagctgacccccggccaggccctgcccgccggcttccccggccccttcatcttcgccgacagcctgagcagcgtggagaccctgctgaccaacatccagggcctgctgaaggtggccctggacaacgccagaatccaggagaagcagatccagcaggagaagaaggagctgagactggagctgtacagagagagagagatcagagagaacctggagagacagctggccgtggagctgcagagcagaaccaccatgcagaagagactgaagaaggagaagaagaccaagagaaagctgcaggaggccctggagttcgagagcaagagaagagagcaggtggagcaggccctgaagcaggccaccaccagcgacagcggcctgagaatgctgaaggacaccggcatccccgacatcgagatcgagaacaacggcaccccccacgacagcgccgccatgcagggcggcaactactactgcctggagatggcccagcagctgtacagcgcctag

SEQ ID NO: 7917 - DNA, 1299 bp, Artificial Sequence
  Description of Artificial Sequence: Synthetic coding sequence
atgaccagaaagcaggccgtgaacagcagcagacccggcagaccccccaagagaagcctgggcgtgctgcaggagaacgccagactgctgacccacgccgtgcccggcctgctgagccccggcctgatcacccccaccggcatcaccgccgccgccatggccgaggccatgaagctgcagaagatgaagctgatggccatgaacaccctgcagggcaacggcagccagaacggcaccgagagcgagcccgacgacctgaacagcaacaccggcggcagcgagagcagctgggacaaggacaagatgcagagccccttcgccgcccccggcccccagcacggcatcgcccacgccgccctggccggccagcccggcatcggcggcgcccccaccctgaaccccctgcagcagaaccacctgctgaccaacagactggacctgcccttcatgatgatgccccaccccctgctgcccgtgagcctgccccccgccagcgtggccatggccatgaaccagatgaaccacctgaacaccatcgccaacatggccgccgccgcccagatccacagccccctgagcagagccggcaccagcgtgatcaaggagagaatccccgagagccccagccccgcccccagcctggaggagaaccacagacccggcagccagaccagcagccacaccagcagcagcgtgagcagcagccccagccagatggaccaccacctggagagaatggaggaggtgcccgtgcagatccccatcatgaagagccccctggacaagatccagctgacccccggccaggccctgcccgccggcttccccggccccttcatcttcgccgacagcctgagcagcgtggagaccctgctgaccaacatccagggcctgctgaaggtggccctggacaacgccagaatccaggagaagcagatccagcaggagaagaaggagctgagactggagctgtacagagagagagagatcagagagaacctggagagacagctggccgtggagctgcagagcagaaccaccatgcagaagagactgaagaaggagaagaagaccaagagaaagctgcaggaggccctggagttcgagagcaagagaagagagcaggtggagcaggccctgaagcaggccaccaccagcgacagcggcctgagaatgctgaaggacaccggcatccccgacatcgagatcgagaacaacggcaccccccacgacagcgccgccatgcagggcggcaactactactgcctggagatggcccagcagctgtacagcgcctag

SEQ ID NO: 7918 - DNA, 1143 bp, Artificial Sequence
  Description of Artificial Sequence: Synthetic coding sequence
atggccgaggccatgaagctgcagaagatgaagctgatggccatgaacaccctgcagggcaacggcagccagaacggcaccgagagcgagcccgacgacctgaacagcaacaccggcggcagcgagagcagctgggacaaggacaagatgcagagccccttcgccgcccccggcccccagcacggcatcgcccacgccgccctggccggccagcccggcatcggcggcgcccccaccctgaaccccctgcagcagaaccacctgctgaccaacagactggacctgcccttcatgatgatgccccaccccctgctgcccgtgagcctgccccccgccagcgtggccatggccatgaaccagatgaaccacctgaacaccatcgccaacatggccgccgccgcccagatccacagccccctgagcagagccggcaccagcgtgatcaaggagagaatccccgagagccccagccccgcccccagcctggaggagaaccacagacccggcagccagaccagcagccacaccagcagcagcgtgagcagcagccccagccagatggaccaccacctggagagaatggaggaggtgcccgtgcagatccccatcatgaagagccccctggacaagatccagctgacccccggccaggccctgcccgccggcttccccggccccttcatcttcgccgacagcctgagcagcgtggagaccctgctgaccaacatccagggcctgctgaaggtggccctggacaacgccagaatccaggagaagcagatccagcaggagaagaaggagctgagactggagctgtacagagagagagagatcagagagaacctggagagacagctggccgtggagctgcagagcagaaccaccatgcagaagagactgaagaaggagaagaagaccaagagaaagctgcaggaggccctggagttcgagagcaagagaagagagcaggtggagcaggccctgaagcaggccaccaccagcgacagcggcctgagaatgctgaaggacaccggcatccccgacatcgagatcgagaacaacggcaccccccacgacagcgccgccatgcagggcggcaactactactgcctggagatggcccagcagctgtacagcgcctag

SEQ ID NO: 7919 - DNA, 1794 bp, Artificial Sequence
  Description of Artificial Sequence: Synthetic coding sequence
atgcagtggccccccccctggagaagaagccccctggtgagcgccacccccccccccggccccaccagaggcctgctgtgccccagaagagtgagcgaggccggcgacagcagcaccgagggcgccagaaccggccacagacactacgtgacccccgccgagagcgccatggagggcagaagccagcccctgcccagcctgagacccgccagccccaccaacgcccccgcccacggcagaggcagcgactgcaccgccaaggagccccccctggccaacgtgtgcagacagaactacggcgccgcccaggaccccgtggagcccgccggcagaagaagcgccagccacgtgaccggcagcagcctgggcaaggccgaggtggcctgcggcagaagatggagatgggccgagctgctggccgacaccagctggagccccgccggcagagccaccgagatgaaggtgaagatgctgagcagaaaccccgacaactacgtgagagagaccaagctggacctgcagagagtgcccagaaactacgaccccgccctgcaccccttcgaggtgcccagagagtacatcagagccctgaacgccaccaagctggagagagtgttcgccaagcccttcctggccagcctggacggccacagagacggcgtgaactgcctggccaagcaccccgagaagctggccaccgtgctgagcggcgcctgcgacggcgaggtgagaatctggaacctgacccagagaaactgcatcagaaccatccaggcccacgagggcttcgtgagaggcatctgcaccagattctgcggcaccagcttcttcaccgtgggcgacgacaagaccgtgaagcagtggaagatggacggccccggctacggcgacgaggaggagcccctgcacaccatcctgggcaagaccgtgtacaccggcatcgaccaccactggaaggaggccgtgttcgccacctgcggccagcaggtggacatctgggacgagcagagaaccaaccccatctgcagcatgacctggggcttcgacagcatcagcagcgtgaagttcaaccccatcgagaccttcctgctgggcagctgcgccagcgacagaaacatcgtgctgtacgacatgagacaggccacccccctgaagaaggtgatcctggacatgagaaccaacaccatctgctggaaccccatggaggccttcatcttcaccgccgccaacgaggactacaacctgtacaccttcgacatgagagccctggacacccccgtgatggtgcacatggaccacgtgagcgccgtgctggacgtggactacagccccaccggcaaggagttcgtgagcgccagcttcgacaagagcatcagaatcttccccgtggacaagagcagaagcagagaggtgtaccacaccaagagaatgcagcacgtgatctgcgtgaagtggaccagcgacagcaagtacatcatgtgcggcagcgacgagatgaacatcagactgtggaaggccaacgccagcgagaagctgggcgtgctgaccagcagagagaaggccgccaaggactacaaccagaagctgaaggagaagttccagcactacccccacatcaagagaatcgccagacacagacacctgcccaagagcatctacagccagatccaggagcagagaatcatgaaggaggccagaagaagaaaggaggtgaacagaatcaagcacagcaagcccggcagcgtgcccctggtgagcgagaagaagaagcacgtggtggccgtggtgaagtag

SEQ ID NO: 7920 - DNA, 291 bp, Artificial Sequence
  Description of Artificial Sequence: Synthetic coding sequence
atgaaggtgaagatgctgagcagaaaccccgacaactacgtgagagagaccaagctggacctgcagagagtgcccagaaactacgaccccgccctgcaccccttcgaggtgcccagagagtacatcagagccctgaacgccaccaagctggagagagtgttcgccaagcccttcctggccagcctggacggccacagagacggcgtgaactgcctggccaagcaccccgagaagctggccaccgtgctgagcggcgcctgcgacggcgagctgaacatgatcaagctgtag

SEQ ID NO: 7921 - DNA, 2583 bp, Artificial Sequence
  Description of Artificial Sequence: Synthetic coding sequence
atgagcagaggcggcagctacccccacctgctgtgggacgtgagaaagagaagcctgggcctggaggaccccagcagactgagaagcagatacctgggcagaagagagttcatccagagactgaagctggaggccaccctgaacgtgcacgacggctgcgtgaacaccatctgctggaacgacaccggcgagtacatcctgagcggcagcgacgacaccaagctggtgatcagcaacccctacagcagaaaggtgctgaccaccatcagaagcggccacagagccaacatcttcagcgccaagttcctgccctgcaccaacgacaagcagatcgtgagctgcagcggcgacggcgtgatcttctacaccaacgtggagcaggacgccgagaccaacagacagtgccagttcacctgccactacggcaccacctacgagatcatgaccgtgcccaacgacccctacaccttcctgagctgcggcgaggacggcaccgtgagatggttcgacaccagaatcaagaccagctgcaccaaggaggactgcaaggacgacatcctgatcaactgcagaagagccgccaccagcgtggccatctgcccccccatcccctactacctggccgtgggctgcagcgacagcagcgtgagaatctacgacagaagaatgctgggcaccagagccaccggcaactacgccggcagaggcaccaccggcatggtggccagattcatccccagccacctgaacaacaagagctgcagagtgaccagcctgtgctacagcgaggacggccaggagatcctggtgagctacagcagcgactacatctacctgttcgaccccaaggacgacaccgccagagagctgaagacccccagcgccgaggagagaagagaggagctgagacagccccccgtgaagagactgagactgagaggcgactggagcgacaccggccccagagccagacccgagagcgagagagagagagacggcgagcagagccccaacgtgagcctgatgcagagaatgagcgacatgctgagcagatggttcgaggaggccagcgaggtggcccagagcaacagaggcagaggcagaagcagacccagaggcggcaccagccagagcgacatcagcaccctgcccaccgtgcccagcagccccgacctggaggtgagcgagaccgccatggaggtggacacccccgccgagcagttcctgcagcccagcaccagcagcaccatgagcgcccaggcccacagcaccagcagccccaccgagagcccccacagcacccccctgctgagcagccccgacagcgagcagagacagagcgtggaggccagcggccaccacacccaccaccagagcgacaacaacaacgagaagctgagccccaagcccggcaccggcgagcccgtgctgagcctgcactacagcaccgagggcaccaccaccagcaccatcaagctgaacttcaccgacgagtggagcagcatcgccagcagcagcagaggcatcggcagccactgcaagagcgagggccaggaggagagcttcgtgccccagagcagcgtgcagccccccgagggcgacagcgagaccaaggcccccgaggagagcagcgaggacgtgaccaagtaccaggagggcgtgagcgccgagaaccccgtggagaaccacatcaacatcacccagagcgacaagttcaccgccaagcccctggacagcaacagcggcgagagaaacgacctgaacctggacagaagctgcggcgtgcccgaggagagcgccagcagcgagaaggccaaggagcccgagaccagcgaccagaccagcaccgagagcgccaccaacgagaacaacaccaaccccgagccccagttccagaccgaggccaccggccccagcgcccacgaggagaccagcaccagagacagcgccctgcaggacaccgacgacagcgacgacgaccccgtgctgatccccggcgccagatacagagccggccccggcgacagaagaagcgccgtggccagaatccaggagttcttcagaagaagaaaggagagaaaggagatggaggagctggacaccctgaacatcagaagacccctggtgaagatggtgtacaagggccacagaaacagcagaaccatgatcaaggaggccaacttctggggcgccaacttcgtgatgagcggcagcgactgcggccacatcttcatctgggacagacacaccgccgagcacctgatgctgctggaggccgacaaccacgtggtgaactgcctgcagccccaccccttcgaccccatcctggccagcagcggcatcgactacgacatcaagatctggagccccctggaggagagcagaatcttcaacagaaagctggccgacgaggtgatcaccagaaacgagctgatgctggaggagaccagaaacaccatcaccgtgcccgccagcttcatgctgagaatgctggccagcctgaaccacatcagagccgacagactggagggcgacagaagcgagggcagcggccaggagaacgagaacgaggacgaggagtag

SEQ ID NO: 7922 - DNA, 2856 bp, Artificial Sequence
  Description of Artificial Sequence: Synthetic coding sequence
atgagcagaggcggcagctacccccacctgctgtgggacgtgagaaagagaagcctgggcctggaggaccccagcagactgagaagcagatacctgggcagaagagagttcatccagagactgaagctggaggccaccctgaacgtgcacgacggctgcgtgaacaccatctgctggaacgacaccggcgagtacatcctgagcggcagcgacgacaccaagctggtgatcagcaacccctacagcagaaaggtgctgaccaccatcagaagcggccacagagccaacatcttcagcgccaagttcctgccctgcaccaacgacaagcagatcgtgagctgcagcggcgacggcgtgatcttctacaccaacgtggagcaggacgccgagaccaacagacagtgccagttcacctgccactacggcaccacctacgagatcatgaccgtgcccaacgacccctacaccttcctgagctgcggcgaggacggcaccgtgagatggttcgacaccagaatcaagaccagctgcaccaaggaggactgcaaggacgacatcctgatcaactgcagaagagccgccaccagcgtggccatctgcccccccatcccctactacctggccgtgggctgcagcgacagcagcgtgagaatctacgacagaagaatgctgggcaccagagccaccggcaactacgccggcagaggcaccaccggcatggtggccagattcatccccagccacctgaacaacaagagctgcagagtgaccagcctgtgctacagcgaggacggccaggagatcctggtgagctacagcagcgactacatctacctgttcgaccccaaggacgacaccgccagagagctgaagacccccagcgccgaggagagaagagaggagctgagacagccccccgtgaagagactgagactgagaggcgactggagcgacaccggccccagagccagacccgagagcgagagagagagagacggcgagcagagccccaacgtgagcctgatgcagagaatgagcgacatgctgagcagatggttcgaggaggccagcgaggtggcccagagcaacagaggcagaggcagaagcagacccagaggcggcaccagccagagcgacatcagcaccctgcccaccgtgcccagcagccccgacctggaggtgagcgagaccgccatggaggtggacacccccgccgagcagttcctgcagcccagcaccagcagcaccatgagcgcccaggcccacagcaccagcagccccaccgagagcccccacagcacccccctgctgagcagccccgacagcgagcagagacagagcgtggaggccagcggccaccacacccaccaccagagcgagttcctgagaggccccgagatcgccctgctgagaaagagactgcagcagctgagactgaagaaggccgagcagcagagacagcaggagctggccgcccacacccagcagcagcccagcaccagcgaccagagcagccacgagggcagcagccaggacccccacgccagcgacagccccagcagcgtggtgaacaagcagctgggcagcatgagcctggacgagcagcaggacaacaacaacgagaagctgagccccaagcccggcaccggcgagcccgtgctgagcctgcactacagcaccgagggcaccaccaccagcaccatcaagctgaacttcaccgacgagtggagcagcatcgccagcagcagcagaggcatcggcagccactgcaagagcgagggccaggaggagagcttcgtgccccagagcagcgtgcagccccccgagggcgacagcgagaccaaggcccccgaggagagcagcgaggacgtgaccaagtaccaggagggcgtgagcgccgagaaccccgtggagaaccacatcaacatcacccagagcgacaagttcaccgccaagcccctggacagcaacagcggcgagagaaacgacctgaacctggacagaagctgcggcgtgcccgaggagagcgccagcagcgagaaggccaaggagcccgagaccagcgaccagaccagcaccgagagcgccaccaacgagaacaacaccaaccccgagccccagttccagaccgaggccaccggccccagcgcccacgaggagaccagcaccagagacagcgccctgcaggacaccgacgacagcgacgacgaccccgtgctgatccccggcgccagatacagagccggccccggcgacagattcaacatcagaggcaccaccatcggcgacagaatcatgagaagaagcgccgtggccagaatccaggagttcttcagaagaagaaaggagagaaaggagatggaggagctggacaccctgaacatcagaagacccctggtgaagatggtgtacaagggccacagaaacagcagaaccatgatcaaggaggccaacttctggggcgccaacttcgtgatgagcggcagcgactgcggccacatcttcatctgggacagacacaccgccgagcacctgatgctgctggaggccgacaaccacgtggtgaactgcctgcagccccaccccttcgaccccatcctggccagcagcggcatcgactacgacatcaagatctggagccccctggaggagagcagaatcttcaacagaaagctggccgacgaggtgatcaccagaaacgagctgatgctggaggagaccagaaacaccatcaccgtgcccgccagcttcatgctgagaatgctggccagcctgaaccacatcagagccgacagactggagggcgacagaagcgagggcagcggccaggagaacgagaacgaggacgaggagtag

SEQ ID NO: 7923 - DNA, 2643 bp, Artificial Sequence
  Description of Artificial Sequence: Synthetic coding sequence
atgagcagaggcggcagctacccccacctgctgtgggacgtgagaaagagaagcctgggcctggaggaccccagcagactgagaagcagatacctgggcagaagagagttcatccagagactgaagctggaggccaccctgaacgtgcacgacggctgcgtgaacaccatctgctggaacgacaccggcgagtacatcctgagcggcagcgacgacaccaagctggtgatcagcaacccctacagcagaaaggtgctgaccaccatcagaagcggccacagagccaacatcttcagcgccaagttcctgccctgcaccaacgacaagcagatcgtgagctgcagcggcgacggcgtgatcttctacaccaacgtggagcaggacgccgagaccaacagacagtgccagttcacctgccactacggcaccacctacgagatcatgaccgtgcccaacgacccctacaccttcctgagctgcggcgaggacggcaccgtgagatggttcgacaccagaatcaagaccagctgcaccaaggaggactgcaaggacgacatcctgatcaactgcagaagagccgccaccagcgtggccatctgcccccccatcccctactacctggccgtgggctgcagcgacagcagcgtgagaatctacgacagaagaatgctgggcaccagagccaccggcaactacgccggcagaggcaccaccggcatggtggccagattcatccccagccacctgaacaacaagagctgcagagtgaccagcctgtgctacagcgaggacggccaggagatcctggtgagctacagcagcgactacatctacctgttcgaccccaaggacgacaccgccagagagctgaagacccccagcgccgaggagagaagagaggagctgagacagccccccgtgaagagactgagactgagaggcgactggagcgacaccggccccagagccagacccgagagcgagagagagagagacggcgagcagagccccaacgtgagcctgatgcagagaatgagcgacatgctgagcagatggttcgaggaggccagcgaggtggcccagagcaacagaggcagaggcagaagcagacccagaggcggcaccagccagagcgacatcagcaccctgcccaccgtgcccagcagccccgacctggaggtgagcgagaccgccatggaggtggacacccccgccgagcagttcctgcagcccagcaccagcagcaccatgagcgcccaggcccacagcaccagcagccccaccgagagcccccacagcacccccctgctgagcagccccgacagcgagcagagacagagcgtggaggccagcggccaccacacccaccaccagagcgacagccccagcagcgtggtgaacaagcagctgggcagcatgagcctggacgagcagcaggacaacaacaacgagaagctgagccccaagcccggcaccggcgagcccgtgctgagcctgcactacagcaccgagggcaccaccaccagcaccatcaagctgaacttcaccgacgagtggagcagcatcgccagcagcagcagaggcatcggcagccactgcaagagcgagggccaggaggagagcttcgtgccccagagcagcgtgcagccccccgagggcgacagcgagaccaaggcccccgaggagagcagcgaggacgtgaccaagtaccaggagggcgtgagcgccgagaaccccgtggagaaccacatcaacatcacccagagcgacaagttcaccgccaagcccctggacagcaacagcggcgagagaaacgacctgaacctggacagaagctgcggcgtgcccgaggagagcgccagcagcgagaaggccaaggagcccgagaccagcgaccagaccagcaccgagagcgccaccaacgagaacaacaccaaccccgagccccagttccagaccgaggccaccggccccagcgcccacgaggagaccagcaccagagacagcgccctgcaggacaccgacgacagcgacgacgaccccgtgctgatccccggcgccagatacagagccggccccggcgacagaagaagcgccgtggccagaatccaggagttcttcagaagaagaaaggagagaaaggagatggaggagctggacaccctgaacatcagaagacccctggtgaagatggtgtacaagggccacagaaacagcagaaccatgatcaaggaggccaacttctggggcgccaacttcgtgatgagcggcagcgactgcggccacatcttcatctgggacagacacaccgccgagcacctgatgctgctggaggccgacaaccacgtggtgaactgcctgcagccccaccccttcgaccccatcctggccagcagcggcatcgactacgacatcaagatctggagccccctggaggagagcagaatcttcaacagaaagctggccgacgaggtgatcaccagaaacgagctgatgctggaggagaccagaaacaccatcaccgtgcccgccagcttcatgctgagaatgctggccagcctgaaccacatcagagccgacagactggagggcgacagaagcgagggcagcggccaggagaacgagaacgaggacgaggagtag

SEQ ID NO: 7924 - DNA, 2763 bp, Artificial Sequence
  Description of Artificial Sequence: Synthetic coding sequence
atgagcagaggcggcagctacccccacctgctgtgggacgtgagaaagagaagcctgggcctggaggaccccagcagactgagaagcagatacctgggcagaagagagttcatccagagactgaagctggaggccaccctgaacgtgcacgacggctgcgtgctgaccaccatcagaagcggccacagagccaacatcttcagcgccaagttcctgccctgcaccaacgacaagcagatcgtgagctgcagcggcgacggcgtgatcttctacaccaacgtggagcaggacgccgagaccaacagacagtgccagttcacctgccactacggcaccacctacgagatcatgaccgtgcccaacgacccctacaccttcctgagctgcggcgaggacggcaccgtgagatggttcgacaccagaatcaagaccagctgcaccaaggaggactgcaaggacgacatcctgatcaactgcagaagagccgccaccagcgtggccatctgcccccccatcccctactacctggccgtgggctgcagcgacagcagcgtgagaatctacgacagaagaatgctgggcaccagagccaccggcaactacgccggcagaggcaccaccggcatggtggccagattcatccccagccacctgaacaacaagagctgcagagtgaccagcctgtgctacagcgaggacggccaggagatcctggtgagctacagcagcgactacatctacctgttcgaccccaaggacgacaccgccagagagctgaagacccccagcgccgaggagagaagagaggagctgagacagccccccgtgaagagactgagactgagaggcgactggagcgacaccggccccagagccagacccgagagcgagagagagagagacggcgagcagagccccaacgtgagcctgatgcagagaatgagcgacatgctgagcagatggttcgaggaggccagcgaggtggcccagagcaacagaggcagaggcagaagcagacccagaggcggcaccagccagagcgacatcagcaccctgcccaccgtgcccagcagccccgacctggaggtgagcgagaccgccatggaggtggacacccccgccgagcagttcctgcagcccagcaccagcagcaccatgagcgcccaggcccacagcaccagcagccccaccgagagcccccacagcacccccctgctgagcagccccgacagcgagcagagacagagcgtggaggccagcggccaccacacccaccaccagagcgagttcctgagaggccccgagatcgccctgctgagaaagagactgcagcagctgagactgaagaaggccgagcagcagagacagcaggagctggccgcccacacccagcagcagcccagcaccagcgaccagagcagccacgagggcagcagccaggacccccacgccagcgacagccccagcagcgtggtgaacaagcagctgggcagcatgagcctggacgagcagcaggacaacaacaacgagaagctgagccccaagcccggcaccggcgagcccgtgctgagcctgcactacagcaccgagggcaccaccaccagcaccatcaagctgaacttcaccgacgagtggagcagcatcgccagcagcagcagaggcatcggcagccactgcaagagcgagggccaggaggagagcttcgtgccccagagcagcgtgcagccccccgagggcgacagcgagaccaaggcccccgaggagagcagcgaggacgtgaccaagtaccaggagggcgtgagcgccgagaaccccgtggagaaccacatcaacatcacccagagcgacaagttcaccgccaagcccctggacagcaacagcggcgagagaaacgacctgaacctggacagaagctgcggcgtgcccgaggagagcgccagcagcgagaaggccaaggagcccgagaccagcgaccagaccagcaccgagagcgccaccaacgagaacaacaccaaccccgagccccagttccagaccgaggccaccggccccagcgcccacgaggagaccagcaccagagacagcgccctgcaggacaccgacgacagcgacgacgaccccgtgctgatccccggcgccagatacagagccggccccggcgacagattcaacatcagaggcaccaccatcggcgacagaatcatgagaagaagcgccgtggccagaatccaggagttcttcagaagaagaaaggagagaaaggagatggaggagctggacaccctgaacatcagaagacccctggtgaagatggtgtacaagggccacagaaacagcagaaccatgatcaaggaggccaacttctggggcgccaacttcgtgatgagcggcagcgactgcggccacatcttcatctgggacagacacaccgccgagcacctgatgctgctggaggccgacaaccacgtggtgaactgcctgcagccccaccccttcgaccccatcctggccagcagcggcatcgactacgacatcaagatctggagccccctggaggagagcagaatcttcaacagaaagctggccgacgaggtgatcaccagaaacgagctgatgctggaggagaccagaaacaccatcaccgtgcccgccagcttcatgctgagaatgctggccagcctgaaccacatcagagccgacagactggagggcgacagaagcgagggcagcggccaggagaacgagaacgaggacgaggagtag

SEQ ID NO: 7925 - DNA, 1524 bp, Artificial Sequence
  Description of Artificial Sequence: Synthetic coding sequence
atggaggacagcgaggccctgggcttcgagcacatgggcctggaccccagactgctgcaggccgtgaccgacctgggctggagcagacccaccctgatccaggagaaggccatccccctggccctggagggcaaggacctgctggccagagccagaaccggcagcggcaagaccgccgcctacgccatccccatgctgcagctgctgctgcacagaaaggccaccggccccgtggtggagcaggccgtgagaggcctggtgctggtgcccaccaaggagctggccagacaggcccagagcatgatccagcagctggccacctactgcgccagagacgtgagagtggccaacgtgagcgccgccgaggacagcgtgagccagagagccgtgctgatggagaagcccgacgtggtggtgggcacccccagcagaatcctgagccacctgcagcaggacagcctgaagctgagagacagcctggagctgctggtggtggacgaggccgacctgctgttcagcttcggcttcgaggaggagctgaagagcctgctgtgccacctgcccagaatctaccaggccttcctgatgagcgccaccttcaacgaggacgtgcaggccctgaaggagctgatcctgcacaaccccgtgaccctgaagctgcaggagagccagctgcccggccccgaccagctgcagcagttccaggtggtgtgcgagaccgaggaggacaagttcctgctgctgtacgccctgctgaagctgagcctgatcagaggcaagagcctgctgttcgtgaacaccctggagagaagctacagactgagactgttcctggagcagttcagcatccccacctgcgtgctgaacggcgagctgcccctgagaagcagagccagcgaccccgaggccggcgtggccagaggcatcgacttccaccacgtgagcgccgtgctgaacttcgacctgccccccacccccgaggcctacatccacagagccggcagaaccgccagagccaacaaccccggcatcgtgctgaccttcgtgctgcccaccgagcagttccacctgggcaagatcgaggagctgctgagcggcgagaacagaggccccatcctgctgccctaccagttcagaatggaggagatcgagggcttcagatacagatgcagagacgccatgagaagcgtgaccaagcaggccatcagagaggccagactgaaggagatcaaggaggagctgctgcacagcgagaagctgaagacctacttcgaggacaaccccagagacctgcagctgctgagacacgacctgcccctgcaccccgccgtggtgaagccccacctgggccacgtgcccgactacctggtgccccccgccctgagaggcctggtgagaccccacaagaagagaaagaagctgagcagcagctgcagaaaggccaagagagccaagagccagaaccccctgagaagcttcaagcacaagggcaagaagttcagacccaccgccaagcccagctag

SEQ ID NO: 7926 - DNA, 2391 bp, Artificial Sequence
  Description of Artificial Sequence: Synthetic coding sequence
atggtgctggcccagagaagaagaggcggctgcgagaagctgagagccggcccccaggccgtgctggccagcggcagcggcttctgcgacaacatgctggccgacctgggcctgatcggcaccatcggcgaggacgacgaggtgcccgtggagcccgagagcgacagcggcgacgaggaggaggagggccccatcgtgctgggcagaagacagaaggccctgggcaagaacagaagcgccgacttcaaccccgacttcgtgttcaccgagaaggagggcacctacgacggcagctgggccctggccgacgtgatgagccagctgaagaagaagagagccgccaccaccctggacgagaagatcgagaaggtgagaaagaagagaaagaccgaggacaaggaggccaagagcggcaagctggagaaggagaaggaggccaaggagggcagcgagcccaaggagcaggaggacctgcaggagaacgacgaggagggcagcgaggacgaggccagcgagaccgactacagcagcgccgacgagaacatcctgaccaaggccgacaccctgaaggtgaaggacagaaagaagaagaagaagaagggccaggaggccggcggcttcttcgaggacgccagccagtacgacgagaacctgagcttccaggacatgaacctgagcagacccctgctgaaggccatcaccgccatgggcttcaagcagcccacccccatccagaaggcctgcatccccgtgggcctgctgggcaaggacatctgcgcctgcgccgccaccggcaccggcaagaccgccgccttcgccctgcccgtgctggagagactgatctacaagcccagacaggcccccgtgaccagagtgctggtgctggtgcccaccagagagctgggcatccaggtgcacagcgtgaccagacagctggcccagttctgcaacatcaccacctgcctggccgtgggcggcctggacgtgaagagccaggaggccgccctgagagccgcccccgacatcctgatcgccacccccggcagactgatcgaccacctgcacaactgccccagcttccacctgagcagcatcgaggtgctgatcctggacgaggccgacagaatgctggacgagtacttcgaggagcagatgaaggagatcatcagaatgtgcagccaccacagacagaccatgctgttcagcgccaccatgaccgacgaggtgaaggacctggccagcgtgagcctgaagaaccccgtgagaatcttcgtgaacagcaacaccgacgtggcccccttcctgagacaggagttcatcagaatcagacccaacagagagggcgacagagaggccatcgtggccgccctgctgaccagaaccttcaccgaccacgtgatgctgttcacccagaccaagaagcaggcccacagaatgcacatcctgctgggcctgatgggcctgcaggtgggcgagctgcacggcaacctgagccagacccagagactggaggccctgagaagattcaaggacgagcagatcgacatcctggtggccaccgacgtggccgccagaggcctggacatcgagggcgtgaagaccgtgatcaacttcaccatgcccaacaccatcaagcactacgtgcacagagtgggcagaaccgccagagccggcagagccggcagaagcgtgagcctggtgggcgaggacgagagaaagatgctgaaggagatcgtgaaggccgccaaggcccccgtgaaggccagaatcctgccccaggacgtgatcctgaagttcagagacaagatcgagaagatggagaaggacgtgtacgccgtgctgcagctggaggccgaggagaaggagatgcagcagagcgaggcccagatcaacaccgccaagagactgctggagaagggcaaggaggccgtggtgcaggagcccgagagaagctggttccagaccaaggaggagagaaagaaggagaagatcgccaaggccctgcaggagttcgacctggccctgagaggcaagaagaagagaaagaagttcatgaaggacgccaagaagaagggcgagatgaccgccgaggagagaagccagttcgagatcctgaaggcccagatgttcgccgagagactggccaagagaaacagaagagccaagagagccagagccatgcccgaggaggagcccgtgagaggccccgccaagaagcagaagcagggcaagaagagcgtgttcgacgaggagctgaccaacaccagcaagaaggccctgaagcagtacagagccggccccagcttcgaggagagaaagcagctgggcctgccccaccagagaagaggcggcaacttcaagagcaagagcagatacaagagaagaaagtag

SEQ ID NO: 7927 - DNA, 411 bp, Artificial Sequence
  Description of Artificial Sequence: Synthetic coding sequence
atggtgctggcccagagaagaagaggcggctgcgagaagctgagagccggcccccaggccgtgctggccagcggcagcggcttctgcgacaacatgctggccgacctgggcctgatcggcaccatcggcgaggacgacgaggtgcccgtggagcccgagagcgacagcggcgacgaggaggaggagggccccatcgtgctgggcagaagacagaaggccctgggcaagaacagaagcgccgacttcaaccccgacttcgtgttcaccgagaaggagggcacctacgacggcagctgggccctggccgacgtgatgagccagctgaagaagaagagagccgccaccaccctggacgagaagatcgagaaggtgagaaagaagagaaagaagaagaagaagaagaagaagtag

SEQ ID NO: 7928 - DNA, 1758 bp, Artificial Sequence
  Description of Artificial Sequence: Synthetic coding sequence
atggcccccgacctggccagccagagacacagcgagagcttccccagcgtgaacagcagacccaacgtgatcctgcccggcagagagggcagaagagagggcctgccccccggcggcggcaccagaggcagcctggtgcccaccagacccgtgccccccagccccgcccccctgggcaccagcccctacagctggagcagaagcggccccggcagaggcggcggcgccggcagcagcagagtgcccagaggcgtgcccggccccgccgtgtgcgcccccggcagcctgctgcaccacgccagccccacccagaccatggccgccgccgacggcagcctgttcgacaaccccagaaccttcagcagaagaccccccgcccaggccagcagacaggccaaggccaccaagagaaagtaccaggccagcagcgaggccccccccgccaagagaagaaacgagaccagcttcctgcccgccaagaagaccagcgtgaaggagacccagagaaccttcaagggcaacgcccagaagatgttcagccccaagaagcacagcgtgagcaccagcgacagaaaccaggaggagagacagtgcatcaagaccagcagcctgttcaagaacaaccccgacatccccgagctgcacagacccgtggtgaagcaggtgcaggagaaggtgttcaccagcgccgccttccacgagctgggcctgcacccccacctgatcagcaccatcaacaccgtgctgaagatgagcagcatgaccagcgtgcagaagcagagcatccccgtgctgctggagggcagagacgccctggtgagaagccagaccggcagcggcaagaccctggcctactgcatccccgtggtgcagagcctgcaggccatggagagcaagatccagagaagcgacggcccctacgccctggtgctggtgcccaccagagagctggccctgcagagcttcgacaccgtgcagaagctgctgaagcccttcacctggatcgtgcccggcgtgctgatgggcggcgagaagagaaagagcgagaaggccagactgagaaagggcatcaacatcctgatcagcacccccggcagactggtggaccacatcaagagcaccaagaacatccacttcagcagactgagatggctggtgttcgacgaggccgacagaatcctggacctgggcttcgagaaggacatcaccgtgatcctgaacgccgtgaacgccgagtgccagaagagacagaacgtgctgctgagcgccaccctgaccgagggcgtgaccagactggccgacatcagcctgcacgaccccgtgagcatcagcgtgctggacaagagccacgaccagctgaaccccaaggacaaggccgtgcaggaggtgtgccccccccccgccggcgacaagctggacagcttcgccatccccgagagcctgaagcagcacgtgaccgtggtgcccagcaagctgagactggtgtgcctggccgccttcatcctgcagaagtgcaagttcgaggaggaccagaagatggtggtgttcttcagcagctgcgagctggtggagttccactacagcctgttcctgcagaccctgctgagcagcagcggcgcccccgccagcggccagctgcccagcgccagcatgagactgaagttcctgagactgcacggcggcatggagcaggaggagagaaccgccgtgttccaggagttcagccacagcagaagaggcgtgctgctgtgcacctag

SEQ ID NO: 7929 - DNA, 2337 bp, Artificial Sequence
  Description of Artificial Sequence: Synthetic coding sequence
atggcccccgacctggccagccagagacacagcgagagcttccccagcgtgaacagcagacccaacgtgatcctgcccggcagagagggcagaagagagggcctgccccccggcggcggcaccagaggcagcctggtgcccaccagacccgtgccccccagccccgcccccctgggcaccagcccctacagctggagcagaagcggccccggcagaggcggcggcgccggcagcagcagagtgcccagaggcgtgcccggccccgccgtgtgcgcccccggcagcctgctgcaccacgccagccccacccagaccatggccgccgccgacggcagcctgttcgacaaccccagaaccttcagcagaagaccccccgcccaggccagcagacaggccaaggccaccaagagaaagtaccaggccagcagcgaggccccccccgccaagagaagaaacgagaccagcttcctgcccgccaagaagaccagcgtgaaggagacccagagaaccttcaagggcaacgcccagaagatgttcagccccaagaagcacagcgtgagcaccagcgacagaaaccaggaggagagacagtgcatcaagaccagcagcctgttcaagaacaaccccgacatccccgagctgcacagacccgtggtgaagcaggtgcaggagaaggtgttcaccagcgccgccttccacgagctgggcctgcacccccacctgatcagcaccatcaacaccgtgctgaagatgagcagcatgaccagcgtgcagaagcagagcatccccgtgctgctggagggcagagacgccctggtgagaagccagaccggcagcggcaagaccctggcctactgcatccccgtggtgcagagcctgcaggccatggagagcaagatccagagaagcgacggcccctacgccctggtgctggtgcccaccagagagctggccctgcagagcttcgacaccgtgcagaagctgctgaagcccttcacctggatcgtgcccggcgtgctgatgggcggcgagaagagaaagagcgagaaggccagactgagaaagggcatcaacatcctgatcagcacccccggcagactggtggaccacatcaagagcaccaagaacatccacttcagcagactgagatggctggtgttcgacgaggccgacagaatcctggacctgggcttcgagaaggacatcaccgtgatcctgaacgccgtgaacgccgagtgccagaagagacagaacgtgctgctgagcgccaccctgaccgagggcgtgaccagactggccgacatcagcctgcacgaccccgtgagcatcagcgtgctggacaagagccacgaccagctgaaccccaaggacaaggccgtgcaggaggtgtgccccccccccgccggcgacaagctggacagcttcgccatccccgagagcctgaagcagcacgtgaccgtggtgcccagcaagctgagactggtgtgcctggccgccttcatcctgcagaagtgcaagttcgaggaggaccagaagatggtggtgttcttcagcagctgcgagctggtggagttccactacagcctgttcctgcagaccctgctgagcagcagcggcgcccccgccagcggccagctgcccagcgccagcatgagactgaagttcctgagactgcacggcggcatggagcaggaggagagaaccgccgtgttccaggagttcagccacagcagaagaggcgtgctgctgtgcaccgacgtggccgccagaggcctggacctgccccaggtgacctggatcgtgcagaacaccagcaccggcctggaggagccccccggcctggccgccatgggcgccgcctgcagcttctggctgctgagaagacagaacatgagcaccagatggctgctgaccaagagcaccctgcagagcttcatccaggcctacgccacctaccccagagagctgaagcacatcttccacgtgagaagcctgcacctgggccacgtggccaagagcttcggcctgagagacgcccccagaaacctgagcgccctgaccagaaagaagagaaaggcccacgtgaagagacccgacctgcacaagaagacccagagcaagcacagcctggccgagatcctgagaagcgagtacagcagcggcatggaggccgacatcgccaaggtgaagaagcagaacgcccccggcgagcccggcggcagacccctgcagcacagcctgcagcccaccccctgcttcggcagaggcaagaccctgaagtggagaaagacccagaagggcgtgcagagagacagcaagaccagccagaaggtgtag

SEQ ID NO: 7930 - DNA, 2328 bp, Artificial Sequence
  Description of Artificial Sequence: Synthetic coding sequence
atggcccccgacctggccagccagagacacagcgagagcttccccagcgtgaacagcagacccaacgtgatcctgcccggcagagagggcagaagagagggcctgccccccggcggcggcaccagaggcagcctggtgcccaccagacccgtgccccccagccccgcccccctgggcaccagcccctacagctggagcagaagcggccccggcagaggcggcggcgccggcagcagcagagtgcccagaggcgtgcccggccccgccgtgtgcgcccccggcagcctgctgcaccacgccagccccacccagaccatggccgccgccgacggcagcctgttcgacaaccccagaaccttcagcagaagaccccccgcccaggccagcagacaggccaaggccaccaagagaaagtaccaggccagcagcgaggccccccccgccaagagaagaaacgagaccagcttcctgcccgccaagaagaccagcgtgaaggagacccagagaaccttcaagggcaacgcccagaagatgttcagccccaagaagcacagcgtgagcaccagcgacagaaaccaggaggagagacagtgcatcaagaccagcagcctgttcaagaacaaccccgacatccccgagctgcacagacccgtggtgaagcaggtgcaggagaaggtgttcaccagcgccgccttccacgagctgggcctgcacccccacctgatcagcaccatcaacaccgtgctgaagatgagcagcatgaccagcgtgcagaagcagagcatccccgtgctgctggagggcagagacgccctggtgagaagccagaccggcagcggcaagaccctggcctactgcatccccgtggtgcagagcctgcaggccatggagagcaagatccagagaagcgacggcccctacgccctggtgctggtgcccaccagagagctggccctgcagagcttcgacaccgtgcagaagctgctgaagcccttcacctggatcgtgcccggcgtgctgatgggcggcgagaagagaaagagcgagaaggccagactgagaaagggcatcaacatcctgatcagcacccccggcagactggtggaccacatcaagagcaccaagaacatccacttcagcagactgagatggctggtgttcgacgaggccgacagaatcctggacctgggcttcgagaaggacatcaccgtgatcctgaacgccgtgaacgccgagtgccagaagagacagaacgtgctgctgagcgccaccctgaccgagggcgtgaccagactggccgacatcagcctgcacgaccccgtgagcatcagcgtgctggacaagagccacgaccagctgaaccccaaggacaaggccgtgcaggaggtgtgccccccccccgccggcgacaagctggacagcttcgccatccccgagagcctgaagcagcacgtgaccgtggtgcccagcaagctgagactggtgtgcctggccgccttcatcctgcagaagtgcaagttcgaggaggaccagaagatggtggtgttcttcagcagctgcgagctggtggagttccactacagcctgttcctgcagaccctgctgagcagcagcggcgcccccgccagcggccagctgcccagcgccagcatgagactgaagttcctgagactgcacggcggcatggagcaggaggagagaaccgccgtgttccaggagttcagccacagcagaagaggcgtgctgctgtgcaccgacgtggccgccagaggcctggacctgccccaggtgacctggatcgtgcagtacaacgcccccagcagccccgccgagtacatccacagaatcggcagaaccgccagaatcggctgccacggcagcagcctgctgatcctggcccccagcgaggccgagtacgtgaacagcctggccagccacaagatcaacgtgagcgagatcaagatggaggacatcctgtgcgtgctgaccagagacgactgcttcaagggcaagagatggggcgcccagaagagccacgccgtgggcccccaggagatcagagagagagccaccgtgctgcagaccgtgttcgaggactacgtgcacagcagcgagagaagagtgagctgggccaagaaggtgtggagcctggagacccccgtgctgaccgccagcctgcccgccctgttcagcttcagcagcgccgtgctgcaccccagcctgagacacctgccccagggcgccgaggcccacctgcccagacccatcccccccccctgggcctgcggcgaggagctgagaaccaagagatgcccccaggagagctag

SEQ ID NO: 7931 - DNA, 2556 bp, Artificial Sequence
  Description of Artificial Sequence: Synthetic coding sequence
atggcccccgacctggccagccagagacacagcgagagcttccccagcgtgaacagcagacccaacgtgatcctgcccggcagagagggcagaagagagggcctgccccccggcggcggcaccagaggcagcctggtgcccaccagacccgtgccccccagccccgcccccctgggcaccagcccctacagctggagcagaagcggccccggcagaggcggcggcgccggcagcagcagagtgcccagaggcgtgcccggccccgccgtgtgcgcccccggcagcctgctgcaccacgccagccccacccagaccatggccgccgccgacggcagcctgttcgacaaccccagaaccttcagcagaagaccccccgcccaggccagcagacaggccaaggccaccaagagaaagtaccaggccagcagcgaggccccccccgccaagagaagaaacgagaccagcttcctgcccgccaagaagaccagcgtgaaggagacccagagaaccttcaagggcaacgcccagaagatgttcagccccaagaagcacagcgtgagcaccagcgacagaaaccaggaggagagacagtgcatcaagaccagcagcctgttcaagaacaaccccgacatccccgagctgcacagacccgtggtgaagcaggtgcaggagaaggtgttcaccagcgccgccttccacgagctgggcctgcacccccacctgatcagcaccatcaacaccgtgctgaagatgagcagcatgaccagcgtgcagaagcagagcatccccgtgctgctggagggcagagacgccctggtgagaagccagaccggcagcggcaagaccctggcctactgcatccccgtggtgcagagcctgcaggccatggagagcaagatccagagaagcgacggcccctacgccctggtgctggtgcccaccagagagctggccctgcagagcttcgacaccgtgcagaagctgctgaagcccttcacctggatcgtgcccggcgtgctgatgggcggcgagaagagaaagagcgagaaggccagactgagaaagggcatcaacatcctgatcagcacccccggcagactggtggaccacatcaagagcaccaagaacatccacttcagcagactgagatggctggtgttcgacgaggccgacagaatcctggacctgggcttcgagaaggacatcaccgtgatcctgaacgccgtgaacgccgagtgccagaagagacagaacgtgctgctgagcgccaccctgaccgagggcgtgaccagactggccgacatcagcctgcacgaccccgtgagcatcagcgtgctggacaagagccacgaccagctgaaccccaaggacaaggccgtgcaggaggtgtgccccccccccgccggcgacaagctggacagcttcgccatccccgagagcctgaagcagcacgtgaccgtggtgcccagcaagctgagactggtgtgcctggccgccttcatcctgcagaagtgcaagttcgaggaggaccagaagatggtggtgttcttcagcagctgcgagctggtggagttccactacagcctgttcctgcagaccctgctgagcagcagcggcgcccccgccagcggccagctgcccagcgccagcatgagactgaagttcctgagactgcacggcggcatggagcaggaggagagaaccgccgtgttccaggagttcagccacagcagaagaggcgtgctgctgtgcaccgacgtggccgccagaggcctggacctgccccaggtgacctggatcgtgcagtacaacgcccccagcagccccgccgagtacatccacagaatcggcagaaccgccagaatcggctgccacggcagcagcctgctgatcctggcccccagcgaggccgagtacgtgaacagcctggccagccacaagatcaacgtgagcgagatcaagatggaggacatcctgtgcgtgctgaccagagacgactgcttcaagggcaagagatggggcgcccagaagagccacgccgtgggcccccaggagatcagagagagagccaccgtgctgcagaccgtgttcgaggactacgtgcacagcagcgagagaagagtgagctgggccaagaaggccctgcagagcttcatccaggcctacgccacctaccccagagagctgaagcacatcttccacgtgagaagcctgcacctgggccacgtggccaagagcttcggcctgagagacgcccccagaaacctgagcgccctgaccagaaagaagagaaaggcccacgtgaagagacccgacctgcacaagaagacccagagcaagcacagcctggccgagatcctgagaagcgagtacagcagcggcatggaggccgacatcgccaaggtgaagaagcagaacgcccccggcgagcccggcggcagacccctgcagcacagcctgcagcccaccccctgcttcggcagaggcaagaccctgaagtggagaaagacccagaagggcgtgcagagagacagcaagaccagccagaaggtgtag

SEQ ID NO: 7932 - DNA, 2169 bp, Artificial Sequence
  Description of Artificial Sequence: Synthetic coding sequence
atgcaggccaaggccaccaagagaaagtaccaggccagcagcgaggccccccccgccaagagaagaaacgagaccagcttcctgcccgccaagaagaccagcgtgaaggagacccagagaaccttcaagggcaacgcccagaagatgttcagccccaagaagcacagcgtgagcaccagcgacagaaaccaggaggagagacagtgcatcaagaccagcagcctgttcaagaacaaccccgacatccccgagctgcacagacccgtggtgaagcaggtgcaggagaaggtgttcaccagcgccgccttccacgagctgggcctgcacccccacctgatcagcaccatcaacaccgtgctgaagatgagcagcatgaccagcgtgcagaagcagagcatccccgtgctgctggagggcagagacgccctggtgagaagccagaccggcagcggcaagaccctggcctactgcatccccgtggtgcagagcctgcaggccatggagagcaagatccagagaagcgacggcccctacgccctggtgctggtgcccaccagagagctggccctgcagagcttcgacaccgtgcagaagctgctgaagcccttcacctggatcgtgcccggcgtgctgatgggcggcgagaagagaaagagcgagaaggccagactgagaaagggcatcaacatcctgatcagcacccccggcagactggtggaccacatcaagagcaccaagaacatccacttcagcagactgagatggctggtgttcgacgaggccgacagaatcctggacctgggcttcgagaaggacatcaccgtgatcctgaacgccgtgaacgccgagtgccagaagagacagaacgtgctgctgagcgccaccctgaccgagggcgtgaccagactggccgacatcagcctgcacgaccccgtgagcatcagcgtgctggacaagagccacgaccagctgaaccccaaggacaaggccgtgcaggaggtgtgccccccccccgccggcgacaagctggacagcttcgccatccccgagagcctgaagcagcacgtgaccgtggtgcccagcaagctgagactggtgtgcctggccgccttcatcctgcagaagtgcaagttcgaggaggaccagaagatggtggtgttcttcagcagctgcgagctggtggagttccactacagcctgttcctgcagaccctgctgagcagcagcggcgcccccgccagcggccagctgcccagcgccagcatgagactgaagttcctgagactgcacggcggcatggagcaggaggagagaaccgccgtgttccaggagttcagccacagcagaagaggcgtgctgctgtgcaccgacgtggccgccagaggcctggacctgccccaggtgacctggatcgtgcagtacaacgcccccagcagccccgccgagtacatccacagaatcggcagaaccgccagaatcggctgccacggcagcagcctgctgatcctggcccccagcgaggccgagtacgtgaacagcctggccagccacaagatcaacgtgagcgagatcaagatggaggacatcctgtgcgtgctgaccagagacgactgcttcaagggcaagagatggggcgcccagaagagccacgccgtgggcccccaggagatcagagagagagccaccgtgctgcagaccgtgttcgaggactacgtgcacagcagcgagagaagagtgagctgggccaagaaggccctgcagagcttcatccaggcctacgccacctaccccagagagctgaagcacatcttccacgtgagaagcctgcacctgggccacgtggccaagagcttcggcctgagagacgcccccagaaacctgagcgccctgaccagaaagaagagaaaggcccacgtgaagagacccgacctgcacaagaagacccagagcaagcacagcctggccgagatcctgagaagcgagtacagcagcggcatggaggccgacatcgccaaggtgaagaagcagaacgcccccggcgagcccggcggcagacccctgcagcacagcctgcagcccaccccctgcttcggcagaggcaagaccctgaagtggagaaagacccagaagggcgtgcagagagacagcaagaccagccagaaggtgtag

SEQ ID NO: 7933 - DNA, 483 bp, Artificial Sequence
  Description of Artificial Sequence: Synthetic coding sequence
atgagactggaggccggcagcggcgccgtgtggagaggcggcgagctggcccccgcccccagaaaggtgaaggagggcatcagaggctgcttcccctggaagcaggccaaggccaccaagagaaagtaccaggccagcagcgaggccccccccgccaagagaagaaacgagaccagcttcctgcccgccaagaagaccagcgtgaaggagacccagagaaccttcaagggcaacgcccagaagatgttcagccccaagaagcacagcgtgagcaccagcgacagaaaccaggaggagagacagtgcatcaagaccagcagcctgttcaagaacaaccccgacatccccgagctgcacagacccgtggtgaagcaggtgcaggagaaggtgttcaccagcgccgccttccacgagctgggcctgcacccccacctgatcagcaccatcaacaccgtgctgaagatgagcagcatgaccagatag

SEQ ID NO: 7934 - DNA, 1284 bp, Artificial Sequence
  Description of Artificial Sequence: Synthetic coding sequence
atggccgagcaggacgtggagaacgacctgctggactacgacgaggaggaggagccccaggccccccaggagagcacccccgccccccccaagaaggacatcaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagatcgagcccgtgaacggccaggtgaccgtgctggtgatgtgccacaccagagagctggccttccagatcagcaaggagtacgagagattcagcaagtacatgcccagcgtgaaggtgagcgtgttcttcggcggcctgagcatcaagaaggacgaggaggtgctgaagaagaactgcccccacgtggtggtgggcacccccggcagaatcctggccctggtgagaaacagaagcttcagcctgaagaacgtgaagcacttcgtgctggacgagtgcgacaagatgctggagcagctggacatgagaagagacgtgcaggagatcttcagactgaccccccacgagaagcagtgcatgatgttcagcgccaccctgagcaaggacatcagacccgtgtgcagaaagttcatgcaggaccccatggaggtgttcgtggacgacgagaccaagctgaccctgcacggcctgcagcagtactacgtgaagctgaaggacagcgagaagaacagaaagctgttcgacctgctggacgtgctggagttcaaccaggtgatcatcttcgtgaagagcgtgcagagatgcatggccctggcccagctgctggtggagcagaacttccccgccatcgccatccacagaggcatggcccaggaggagagactgagcagataccagcagttcaaggacttccagagaagaatcctggtggccaccaacctgttcggcagaggcatggacatcgagagagtgaacatcgtgttcaactacgacatgcccgaggacagcgacacctacctgcacagagtggccagagccggcagattcggcaccaagggcctggccatcaccttcgtgagcgacgagaacgacgccaagatcctgaacgacgtgcaggacagattcgaggtgaacgtggccgagctgcccgaggagatcgacatcagcacctacatcgagcagagcagatag

SEQ ID NO: 7935 - DNA, 969 bp, Artificial Sequence
  Description of Artificial Sequence: Synthetic coding sequence
atggccgagcaggacgtggagaacgacctgctggactacgacgaggaggaggagccccaggccccccaggagagcacccccgccccccccaagaaggacatcaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagatcgagcccgtgaacggccaggtgaccgtgctggtgatgtgccacaccagagagctggccttccagatcagcaaggagtacgagagattcagcaagtacatgcccagcgtgaaggtgagcgtgttcttcggcggcctgagcatcaagaaggacgaggaggtgctgaagaagaactgcccccacgtggtggtgggcacccccggcagaatcctggccctggtgagaaacagaagcttcagcctgaagaacgtgaagcacttcgtgctggacgagtgcgacaagatgctggagcagctggacatgagaagagacgtgcaggagatcttcagactgaccccccacgagaagcagtgcatgatgttcagcgccaccctgagcaaggacatcagacccgtgtgcagaaagttcatgcaggaccccatggaggtgttcgtggacgacgagaccaagctgaccctgcacggcctgcagcagtactacgtgaagctgaaggacagcgagaagaacagaaagctgttcgacctgctggacgtgctggagttcaaccagcccgtgaccctgagcgccgtgcagggcttccccgccgccgaccccggcggccaccagagcgtgtggcccggcgacggccacagagccagccagcacagactgtag

SEQ ID NO: 7936 - DNA, 1413 bp, Artificial Sequence
  Description of Artificial Sequence: Synthetic coding sequence
atggcctacggcgcccccagccccacctggagcctgagcgtgagacccaacagacccagaggcggcctgggccccttcggcgaggtgcaggtgatcctgctgccccccagcagctgggactacagcatcatggccgagcaggacgtggagaacgacctgctggactacgacgaggaggaggagccccaggccccccaggagagcacccccgccccccccaagaaggacatcaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagatcgagcccgtgaacggccaggtgaccgtgctggtgatgtgccacaccagagagctggccttccagatcagcaaggagtacgagagattcagcaagtacatgcccagcgtgaaggtgagcgtgttcttcggcggcctgagcatcaagaaggacgaggaggtgctgaagaagaactgcccccacgtggtggtgggcacccccggcagaatcctggccctggtgagaaacagaagcttcagcctgaagaacgtgaagcacttcgtgctggacgagtgcgacaagatgctggagcagctggacatgagaagagacgtgcaggagatcttcagactgaccccccacgagaagcagtgcatgatgttcagcgccaccctgagcaaggacatcagacccgtgtgcagaaagttcatgcaggaccccatggaggtgttcgtggacgacgagaccaagctgaccctgcacggcctgcagcagtactacgtgaagctgaaggacagcgagaagaacagaaagctgttcgacctgctggacgtgctggagttcaaccaggtgatcatcttcgtgaagagcgtgcagagatgcatggccctggcccagctgctggtggagcagaacttccccgccatcgccatccacagaggcatggcccaggaggagagactgagcagataccagcagttcaaggacttccagagaagaatcctggtggccaccaacctgttcggcagaggcatggacatcgagagagtgaacatcgtgttcaactacgacatgcccgaggacagcgacacctacctgcacagagtggccagagccggcagattcggcaccaagggcctggccatcaccttcgtgagcgacgagaacgacgccaagatcctgaacgacgtgcaggacagattcgaggtgaacgtggccgagctgcccgaggagatcgacatcagcacctacatcgagcagagcagatag

SEQ ID NO: 7937 - DNA, 804 bp, Artificial Sequence
  Description of Artificial Sequence: Synthetic coding sequence
atggccgagcaggacgtggagaacgacctgctggactacgacgaggaggaggagccccaggccccccaggagagcacccccgccccccccaagaaggacatcaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagatcgagcccgtgaacggccaggtgaccgtgctggtgatgtgccacaccagagagctggccttccagatcagcaaggagtacgagagattcagcaagtacatgcccagcgtgaaggtgagcgtgttcttcggcggcctgagcatcaagaaggacgaggaggtgctgaagaagaactgcccccacgtggtggtgggcacccccggcagaatcctggccctggtgagaaacagaagcttcagcctgaagaacgtgaagcacttcgtgctggacgagtgcgacaagatgctggagcagctggacatgagaagagacgtgcaggagatcttcagactgaccccccacgagaagcagtgcatgatgttcagcgccaccctgagcaaggacatcagacccgtgtgcagaaagttcatgcaggacgtgctgtgggaggtgagccacaagggcgtggcccactggaaggtgctgggcagaagagacgcccagagatag

SEQ ID NO: 7938 - DNA, 3096 bp, Artificial Sequence
  Description of Artificial Sequence: Synthetic coding sequence
atgggcagagagagcagacactacagaaagagaagcgccagcagaggcagaagcggcagcagaagcagaagcagaagccccagcgacaagagaagcaagagaggcgacgacagaagaagcagaagcagagacagagacagaagaagagagagaagcagaagcagagacaagagaagaagcagaagcagagacagaaagagactgagaagaagcagaagcagagagagagacagaagcagagagagaagaagaagcagaagcagagacagaagaagaagcagaagcagaagcagaggcagaagaagcagaagcagcagccccggcaacaagagcaagaagaccgagaacagaagcagaagcaaggagaagaccgacggcggcgagagcagcaaggagaagaagaaggacaaggacgacaaggaggacgagaaggagaaggacgccggcaacttcgaccagaacaagctggaggaggagatgagaaagagaaaggagagagtggagaagtggagagaggagcagagaaagaaggccatggagaacatcggcgagctgaagaaggagatcgaggagatgaagcagggcaagaagtggagcctggaggacgacgacgacgacgaggacgaccccgccgaggccgagaaggagggcaacgagatggagggcgaggagctggaccccctggacgcctacatggaggaggtgaaggaggaggtgaagaagttcaacatgagaagcgtgaagggcggcggcggcaacgagaagaagagcggccccaccgtgaccaaggtggtgaccgtggtgaccaccaagaaggccgtggtggacagcgacaagaagaagggcgagctgatggagaacgaccaggacgccatggagtacagcagcgaggaggaggaggtggacctgcagaccgccctgaccggctaccagaccaagcagagaaagctgctggagcccgtggaccacggcaagatcgagtacgagcccttcagaaagaacttctacgtggaggtgcccgagctggccaagatgagccaggaggaggtgaacgtgttcagactggagatggagggcatcaccgtgaagggcaagggctgccccaagcccatcaagagctgggtgcagtgcggcatcagcatgaagatcctgaacagcctgaagaagcacggctacgagaagcccacccccatccagacccaggccatccccgccatcatgagcggcagagacctgatcggcatcgccaagaccggcagcggcaagaccatcgccttcctgctgcccatgttcagacacatcatggaccagagaagcctggaggagggcgagggccccatcgccgtgatcatgacccccaccagagagctggccctgcagatcaccaaggagtgcaagaagttcagcaagaccctgggcctgagagtggtgtgcgtgtacggcggcaccggcatcagcgagcagatcgccgagctgaagagaggcgccgagatcatcgtgtgcacccccggcagaatgatcgacatgctggccgccaacagcggcagagtgaccaacctgagaagagtgacctacgtggtgctggacgaggccgacagaatgttcgacatgggcttcgagccccaggtgatgagaatcgtggacaacgtgagacccgacagacagaccgtgatgttcagcgccaccttccccagagccatggaggccctggccagaagaatcctgagcaagcccatcgaggtgcaggtgggcggcagaagcgtggtgtgcagcgacgtggagcagcaggtgatcgtgatcgaggaggagaagaagttcctgaagctgctggagctgctgggccactaccaggagagcggcagcgtgatcatcttcgtggacaagcaggagcacgccgacggcctgctgaaggacctgatgagagccagctacccctgcatgagcctgcacggcggcatcgaccagtacgacagagacagcatcatcaacgacttcaagaacggcacctgcaagctgctggtggccaccagcgtggccgccagaggcctggacgtgaagcacctgatcctggtggtgaactacagctgccccaaccactacgaggactacgtgcacagagccggcagaaccggcagagccggcaacaagggctacgcctacaccttcatcaccgaggaccaggccagatacgccggcgacatcatcaaggccctggagctgagcggcaccgccgtgccccccgacctggagaagctgtggagcgacttcaaggaccagcagaaggccgagggcaagatcatcaagaagagcagcggcttcagcggcaagggcttcaagttcgacgagaccgagcaggccctggccaacgagagaaagaagctgcagaaggccgccctgggcctgcaggacagcgacgacgaggacgccgccgtggacatcgacgagcagatcgagagcatgttcaacagcaagaagagagtgaaggacatggccgcccccggcaccagcagcgtgcccgcccccaccgccggcaacgccgagaagctggagatcgccaagagactggccctgagaatcaacgcccagaagaacctgggcatcgagagccaggacgtgatgcagcaggccaccaacgccatcctgagaggcggcaccatcctggcccccaccgtgagcgccaagaccatcgccgagcagctggccgagaagatcaacgccaagctgaactacgtgcccctggagaagcaggaggaggagagacaggacggcggccagaacgagagcttcaagagatacgaggaggagctggagatcaacgacttcccccagaccgccagatggaaggtgaccagcaaggaggccctgcagagaatcagcgagtacagcgaggccgccatcaccatcagaggcacctacttcccccccggcaaggagcccaaggagggcgagagaaagatctacctggccatcgagagcgccaacgagctggccgtgcagaaggccaaggccgagatcaccagactgatcaaggaggagctgatcagactgcagaacagctaccagcccaccaacaagggcagatacaaggtgctgtag

SEQ ID NO: 7939 - DNA, 3099 bp, Artificial Sequence
  Description of Artificial Sequence: Synthetic coding sequence
atgggcagagagagcagacactacagaaagagaagcgccagcagaggcagaagcggcagcagaagcagaagcagaagccccagcgacaagagaagcaagagaggcgacgacagaagaagcagaagcagagacagagacagaagaagagagagaagcagaagcagagacaagagaagaagcagaagcagagacagaaagagactgagaagaagcagaagcagagagagagacagaagcagagagagaagaagaagcagaagcagagacagaagaagaagcagaagcagaagcagaggcagaagaagcagaagcagcagccccggcaacaagagcaagaagaccgagaacagaagcagaagcaaggagaagaccgacggcggcgagagcagcaaggagaagaagaaggacaaggacgacaaggaggacgagaaggagaaggacgccggcaacttcgaccagaacaagctggaggaggagatgagaaagagaaaggagagagtggagaagtggagagaggagcagagaaagaaggccatggagaacatcggcgagctgaagaaggagatcgaggagatgaagcagggcaagaagtggagcctggaggacgacgacgacgacgaggacgaccccgccgaggccgagaaggagggcaacgagatggagggcgaggagctggaccccctggacgcctacatggaggaggtgaaggaggaggtgaagaagttcaacatgagaagcgtgaagggcggcggcggcaacgagaagaagagcggccccaccgtgaccaaggtggtgaccgtggtgaccaccaagaaggccgtggtggacagcgacaagaagaagggcgagctgatggagaacgaccaggacgccatggagtacagcagcgaggaggaggaggtggacctgcagaccgccctgaccggctaccagaccaagcagagaaagctgctggagcccgtggaccacggcaagatcgagtacgagcccttcagaaagaacttctacgtggaggtgcccgagctggccaagatgagccaggaggaggtgaacgtgttcagactggagatggagggcatcaccgtgaagggcaagggctgccccaagcccatcaagagctgggtgcagtgcggcatcagcatgaagatcctgaacagcctgaagaagcacggctacgagaagcccacccccatccagacccaggccatccccgccatcatgagcggcagagacctgatcggcatcgccaagaccggcagcggcaagaccatcgccttcctgctgcccatgttcagacacatcatggaccagagaagcctggaggagggcgagggccccatcgccgtgatcatgacccccaccagagagctggccctgcagatcaccaaggagtgcaagaagttcagcaagaccctgggcctgagagtggtgtgcgtgtacggcggcaccggcatcagcgagcagatcgccgagctgaagagaggcgccgagatcatcgtgtgcacccccggcagaatgatcgacatgctggccgccaacagcggcagagtgaccaacctgagaagagtgacctacgtggtgctggacgaggccgacagaatgttcgacatgggcttcgagccccaggtgatgagaatcgtggacaacgtgagacccgacagacagaccgtgatgttcagcgccaccttccccagagccatggaggccctggccagaagaatcctgagcaagcccatcgaggtgcaggtgggcggcagaagcgtggtgtgcagcgacgtggagcagcaggtgatcgtgatcgaggaggagaagaagttcctgaagctgctggagctgctgggccactaccaggagagcggcagcgtgatcatcttcgtggacaagcaggagcacgccgacggcctgctgaaggacctgatgagagccagctacccctgcatgagcctgcacggcggcatcgaccagtacgacagagacagcatcatcaacgacttcaagaacggcacctgcaagctgctggtggccaccagcgtggccgccagaggcctggacgtgaagcacctgatcctggtggtgaactacagctgccccaaccactacgaggactacgtgcacagagccggcagaaccggcagagccggcaacaagggctacgcctacaccttcatcaccgaggaccaggccagatacgccggcgacatcatcaaggccctggagctgagcggcaccgccgtgccccccgacctggagaagctgtggagcgacttcaaggaccagcagaaggccgagggcaagatcatcaagaagagcagcggcttcagcggcaagggcttcaagttcgacgagaccgagcaggccctggccaacgagagaaagaagctgcagaaggccgccctgggcctgcaggacagcgacgacgaggacgccgccgtggacatcgacgagcagatcgagagcatgttcaacagcaagaagagagtgaaggacatggccgcccccggcaccagcagcgtgcccgcccccaccgccggcaacgccgagaagctggagatcgccaagagactggccctgagaatcaacgcccagaagaacctgggcatcgagagccaggtggacgtgatgcagcaggccaccaacgccatcctgagaggcggcaccatcctggcccccaccgtgagcgccaagaccatcgccgagcagctggccgagaagatcaacgccaagctgaactacgtgcccctggagaagcaggaggaggagagacaggacggcggccagaacgagagcttcaagagatacgaggaggagctggagatcaacgacttcccccagaccgccagatggaaggtgaccagcaaggaggccctgcagagaatcagcgagtacagcgaggccgccatcaccatcagaggcacctacttcccccccggcaaggagcccaaggagggcgagagaaagatctacctggccatcgagagcgccaacgagctggccgtgcagaaggccaaggccgagatcaccagactgatcaaggaggagctgatcagactgcagaacagctaccagcccaccaacaagggcagatacaaggtgctgtag

SEQ ID NO: 7940 - DNA, 780 bp, Artificial Sequence
  Description of Artificial Sequence: Synthetic coding sequence
atgggcagagagagcagacactacagaaagagaagcgccagcagaggcagaagcggcagcagaagcagaagcagaagccccagcgacaagagaagcaagagaggcgacgacagaagaagcagaagcagagacagagacagaagaagagagagaagcagaagcagagacaagagaagaagcagaagcagagacagaaagagactgagaagaagcagaagcagagagagagacagaagcagagagagaagaagaagcagaagcagagacagaagaagaagcagaagcagaagcagaggcagaagaagcagaagcagcagccccggcaacaagagcaagaagaccgagaacagaagcagaagcaaggagaagaccgacggcggcgagagcagcaaggagaagaagaaggacaaggacgacaaggaggacgagaaggagaaggacgccggcaacttcgaccagaacaagctggaggaggagatgagaaagagaaaggagagagtggagaagtggagagaggagcagagaaagaaggccatggagaacatcggcgagctgaagaaggagatcgaggagatgaagcagggcaagaagtggagcctggaggacgacgacgacgacgaggacgaccccgccgaggccgagaaggagggcaacgagatggagggcgaggagctggaccccctggacgcctacatggaggaggtgaaggaggaggtgaagaagttcaacatgagaagcgtgaaggccgtgagcaagaagaagaagaagaagaagaagtag

SEQ ID NO: 7941 - DNA, 1221 bp, Artificial Sequence
  Description of Artificial Sequence: Synthetic coding sequence
atggccgcccccgaggagcacgacagccccaccgaggccagccagcccatcgtggaggaggaggagaccaagaccttcaaggacctgggcgtgaccgacgtgctgtgcgaggcctgcgaccagctgggctggaccaagcccaccaagatccagatcgaggccatccccctggccctgcagggcagagacatcatcggcctggccgagaccggcagcggcaagaccggcgccttcgccctgcccatcctgaacgccctgctggagaccccccagagactgttcgccctggtgctgacccccaccagagagctggccttccagatcagcgagcagttcgaggccctgggcagcagcatcggcgtgcagagcgccgtgatcgtgggcggcatcgacagcatgagccagagcctggccctggccaagaagccccacatcatcatcgccacccccggcagactgatcgaccacctggagaacaccaagggcttcaacctgagagccctgaagtacctggtgatggacgaggccgacagaatcctgaacatggacttcgagaccgaggtggacaagatcctgaaggtgatccccagagacagaaagaccttcctgttcagcgccaccatgaccaagaaggtgcagaagctgcagagagccgccctgaagaaccccgtgaagtgcgccgtgagcagcaagtaccagaccgtggagaagctgcagcagtactacatcttcatccccagcaagttcaagagcaagagactgggcagcctgaacaagttcaaggccaaggccagaagcatcctgctggccaccgacgtggccagcagaggcctggacatcccccacgtggacgtggtggtgaacttcgacatccccacccacagcaaggactacatccacagagtgggcagaaccgccagagccggcagaagcggcaaggccatcaccttcgtgacccagtacgacgtggagctgttccagagaatcgagcacctgatcggcaagaagctgcccggcttccccacccaggacgacgaggtgatgatgctgaccgagagagtggccgaggcccagagattcgccagaatggagctgagagagcacggcgagaagaagaagagaagcagagaggacgccggcgacaacgacgacaccgagggcgccatcggcgtgagaaacaaggtggccggcggcaagatgaagaagagaaagggcagatag

SEQ ID NO: 7942 - DNA, 1368 bp, Artificial Sequence
  Description of Artificial Sequence: Synthetic coding sequence
atggccgcccccgaggagcacgacagccccaccgaggccagccagcccatcgtggaggaggaggagaccaagaccttcaaggacctgggcgtgaccgacgtgctgtgcgaggcctgcgaccagctgggctggaccaagcccaccaagatccagatcgaggccatccccctggccctgcagggcagagacatcatcggcctggccgagaccggcagcggcaagaccggcgccttcgccctgcccatcctgaacgccctgctggagaccccccagagactgttcgccctggtgctgacccccaccagagagctggccttccagatcagcgagcagttcgaggccctgggcagcagcatcggcgtgcagagcgccgtgatcgtgggcggcatcgacagcatgagccagagcctggccctggccaagaagccccacatcatcatcgccacccccggcagactgatcgaccacctggagaacaccaagggcttcaacctgagagccctgaagtacctggtgatggacgaggccgacagaatcctgaacatggacttcgagaccgaggtggacaagatcctgaaggtgatccccagagacagaaagaccttcctgttcagcgccaccatgaccaagaaggtgcagaagctgcagagagccgccctgaagaaccccgtgaagtgcgccgtgagcagcaagtaccagaccgtggagaagctgcagcagtactacatcttcatccccagcaagttcaaggacacctacctggtgtacatcctgaacgagctggccggcaacagcttcatgatcttctgcagcacctgcaacaacacccagagaaccgccctgctgctgagaaacctgggcttcaccgccatccccctgcacggccagatgagccagagcaagagactgggcagcctgaacaagttcaaggccaaggccagaagcatcctgctggccaccgacgtggccagcagaggcctggacatcccccacgtggacgtggtggtgaacttcgacatccccacccacagcaaggactacatccacagagtgggcagaaccgccagagccggcagaagcggcaaggccatcaccttcgtgacccagtacgacgtggagctgttccagagaatcgagcacctgatcggcaagaagctgcccggcttccccacccaggacgacgaggtgatgatgctgaccgagagagtggccgaggcccagagattcgccagaatggagctgagagagcacggcgagaagaagaagagaagcagagaggacgccggcgacaacgacgacaccgagggcgccatcggcgtgagaaacaaggtggccggcggcaagatgaagaagagaaagggcagatag

SEQ ID NO: 7943 - DNA, 2214 bp, Artificial Sequence
  Description of Artificial Sequence: Synthetic coding sequence
atgcccggcaagctgctgtggggcgacatcatggagctggaggcccccctggaggagagcgagagccagaagaaggagagacagaagagcgacagaagaaagagcagacaccactacgacagcgacgagaagagcgagaccagagagaacggcgtgaccgacgacctggacgcccccaaggccaagaagagcaagatgaaggagaagctgaacggcgacaccgaggagggcttcaacagactgagcgacgagttcagcaagagccacaagagcagaagaaaggacctgcccaacggcgacatcgacgagtacgagaagaagagcaagagagtgagcagcctggacaccagcacccacaagagcagcgacaacaagctggaggagaccctgaccagagagcagaaggagggcgccttcagcaacttccccatcagcgaggagaccatcaagctgctgaagggcagaggcgtgacctacctgttccccatccaggtgaagaccttcggccccgtgtacgagggcaaggacctgatcgcccaggccagaaccggcaccggcaagaccttcagcttcgccatccccctgatcgagagactgcagagaaaccaggagaccatcaagaagagcagaagccccaaggtgctggtgctggcccccaccagagagctggccaaccaggtggccaaggacttcaaggacatcaccagaaagctgagcgtggcctgcttctacggcggcaccagctaccagagccagatcaaccacatcagaaacggcatcgacatcctggtgggcacccccggcagaatcaaggaccacctgcagagcggcagactggacctgagcaagctgagacacgtggtgctggacgaggtggaccagatgctggacctgggcttcgccgagcaggtggaggacatcatccacgagagctacaagaccgacagcgaggacaacccccagaccctgctgttcagcgccacctgcccccagtgggtgtacaaggtggccaagaagtacatgaagagcagatacgagcaggtggacctggtgggcaagatgacccagaaggccgccaccaccgtggagcacctggccatccagtgccactggagccagagacccgccgtgatcggcgacgtgctgcaggtgtacagcggcagcgagggcagagccatcatcttctgcgagaccaagaagaacgtgaccgagatggccatgaacccccacatcaagcagaacgcccagtgcctgcacggcgacatcgcccagagccagagagagatcaccctgaagggcttcagagagggcagcttcaaggtgctggtggccaccaacgtggccgccagaggcctggacatccccgaggtggacctggtgatccagagcagccccccccaggacgtggagagctacatccacagaagcggcagaaccggcagagccggcagaaccggcatctgcatctgcttctaccagcccagagagagaggccagctgagatacgtggagcagaaggccggcatcaccttcaagagagtgggcgtgcccagcaccatggacctggtgaagagcaagagcatggacgccatcagaagcctggccagcgtgagctacgccgccgtggacttcttcagacccagcgcccagagactgatcgaggagaagggcgccgtggacgccctggccgccgccctggcccacatcagcggcgccagcagcttcgagcccagaagcctgatcaccagcgacaagggcttcgtgaccatgaccctggagagcctggaggagatccaggacgtgagctgcgcctggaaggagctgaacagaaagctgagcagcaacgccgtgagccagatcaccagaatgtgcctgctgaagggcaacatgggcgtgtgcttcgacgtgcccaccaccgagagcgagagactgcaggccgagtggcacgacagcgactggatcctgagcgtgcccgccaagctgcccgagatcgaggagtactacgacggcaacaccagcagcaacagcagacagagaagcggctggagcagcggcagaagcggcagaagcggcagaagcggcggcagaagcggcggcagaagcggcagacagagcagacagggcagcagaagcggcagcagacaggacggcagaagaagaagcggcaacagaaacagaagcagaagcggcggccacaagagaagcttcgactag

SEQ ID NO: 7944 - DNA, 2136 bp, Artificial Sequence
  Description of Artificial Sequence: Synthetic coding sequence
atgcccggcaagctgctgtggggcgacatcatggagctggaggcccccctggaggagagcgagagccagaagaaggagagacagaagagcgacagaagaaagagcagacaccactacgacagcgacgagaagagcgagaccagagagaacggcgtgaccgacgacctggacgcccccaaggccaagaagagcaagatgaaggagaagctgaacggcgacaccgaggagggcttcaacagactgagcgacgagttcagcaagagccacaagagcagaagaaaggacctgcccaacggcgacatcgacgagtacgagaagaagagcaagagagtgagcagcctggacaccagcacccacaagagcagcgacaacaagctggaggagaccctgaccagagagcagaaggagggcgccttcagcaacttccccatcagcgaggagaccatcaagctgctgaagggcagaggcgtgacctacctgttccccatccaggtgaagaccttcggccccgtgtacgagggcaaggacctgatcgcccaggccagaaccggcaccggcaagaccttcagcttcgccatccccctgatcgagagactgcagagaaaccaggagaccatcaagaagagcagaagccccaaggtgctggtgctggcccccaccagagagctggccaaccaggtggccaaggacttcaaggacatcaccagaaagctgagcgtggcctgcttctacggcggcaccagctaccagagccagatcaaccacatcagaaacggcatcgacatcctggtgggcacccccggcagaatcaaggaccacctgcagagcggcagactggacctgagcaagctgagacacgtggtgctggacgaggtggaccagatgctggacctgggcttcgccgagcaggtggaggacatcatccacgagagctacaagaccgacagcgaggacaacccccagaccctgctgttcagcgccacctgcccccagtgggtgtacaaggtggccaagaagtacatgaagagcagatacgagcaggtggacctggtgggcaagatgacccagaaggccgccaccaccgtggagcacctggccatccagtgccactggagccagagacccgccgtgatcggcgacgtgctgcaggtgtacagcggcagcgagggcagagccatcatcttctgcgagaccaagaagaacgtgaccgagatggccatgaacccccacatcaagcagaacgcccagtgcctgcacggcgacatcgcccagagccagagagagatcaccctgaagggcttcagagagggcagcttcaaggtgctggtggccaccaacgtggccgccagaggcctggacatccccgaggtggacctggtgatccagagcagccccccccaggacgtggagagctacatccacagaagcggcagaaccggcagagccggcagaaccggcatctgcatctgcttctaccagcccagagagagaggccagctgagatacgtggagcagaaggccggcatcaccttcaagagagtgggcgtgcccagcaccatggacctggtgaagagcaagagcatggacgccatcagaagcctggccagcgtgagctacgccgccgtggacttcttcagacccagcgcccagagactgatcgaggagaagggcgccgtggacgccctggccgccgccctggcccacatcagcggcgccagcagcttcgagcccagaagcctgatcaccagcgacaagggcttcgtgaccatgaccctggagagcctggaggagatccaggacgtgagctgcgcctggaaggagctgaacagaaagctgagcagcaacgccgtgagccagatcaccagaatgtgcctgctgaagggcaacatgggcgtgtgcttcgacgtgcccaccaccgagagcgagagactgcaggccgagtggcacgacagcgactggatcctgagcgtgcccgccaagctgcccgagatcgaggagtactacgacggcaacaccagcagcaacagcagacagagcagacagggcagcagaagcggcagcagacaggacggcagaagaagaagcggcaacagaaacagaagcagaagcggcggccacaagagaagcttcgactag

SEQ ID NO: 7945 - DNA, 2001 bp, Artificial Sequence
  Description of Artificial Sequence: Synthetic coding sequence
atggccctgttctacgtggccagataccccggccccgacgccgccgccgccgccggccccgagggcgccgaggccggcgcccacggcagagccagagccctgctggagagactgcagagcagagccagagagagacagcagcagagagagcccgcccagaccgaggccgccgccagcaccgagcccgccaccagaagaagaagaagacccagaagaagaagaagagtgaacgacgccgagcccggcagccccgaggccccccagggcaagagaagaaaggccgacggcgaggacgccggcgccgagagcaacgaggaggcccccggcgagcccagcgccggcagcagcgaggaggcccccggcgagcccagcgccggcagcagcgaggaggcccccggcgagagaagcaccagcgccagcgccgaggccgcccccgacggccccgccctggaggaggccgccggccccctggtgcccggcctggtgctgggcggcttcggcaagagaaaggcccccaaggtgcagcccttcctgcccagatggctggccgagcccaactgcgtgagaagaaacgtgaccgaggacctggtgcccatcgaggacatccccgacgtgcaccccgacctgcagaagcagctgagagcccacggcatcagcagctacttccccgtgcaggccgccgtgatccccgccctgctggagagcgccgcctgcggcttcctggtgggcagaggcggctacagacccagcgacctgtgcgtgagcgcccccaccggcagcggcaagaccctggccttcgtgatccccgtggtgcaggccctgctgagcagagtggtgtgccacatcagagccctggtggtgctgcccaccaaggagctggcccagcaggtgagcaaggtgttcaacatctacaccgacgccacccccctgagagtgagcctggtgaccggccagaagagcctggccaaggagcaggagagcctggtgcagaagaccgccgacggctacagatgcctggccgacatcgtggtggccacccccggcagactggtggaccacatcgaccagacccccggcttcagcctgcagcagctgagattcctgatcatcgacgaggccgacagaatgatcgacagcatgcaccagagctggctgcccagagtggtggccgccgccttccagagcgaggaccccgccgacccctgcgccctgctgcagagaagacaggcccaggccgtgaccgccgccagcacctgctgcccccagatgcccctgcagaagctgctgttcagcgccaccctgacccagaaccccgagaagctgcagcagctgggcctgcaccagcccagactgttcagcaccggcctggcccacagaggcctggaggacaccgacggcgacggcgacagcggcaagtacgccttccccgtgggcctgacccaccactacgtgccctgcagcctgagcagcaagcccctggtggtgctgcacctggtgctggagatgggcttcagcagagtgctgtgcttcaccaacagcagagagaacagccacagactgttcctgctggtgcaggccttcggcggcgtggacgtggccgagttcagcagcagatacggccccggccagagaagaatgatcctgaagcagttcgagcagggcaagatccagctgctgatcagcaccgacgccaccgccagaggcatcgacgtgcagggcgtggagctggtggtgaactacgacgccccccagtacctgagaacctacgtgcacagagtgggcagaaccgccagagccggcaagaccggccaggccttcaccctgctgctgaaggtgcaggagagaagattcctgagaatgctgaccgaggccggcgcccccgagctgcagagacacgagctgagcagcaagctgctgcagcccctggtgcccagatacgaggaggccctgagccagctggaggagagcgtgaaggaggagagaaagcagagagccgcctag

SEQ ID NO: 7946 - DNA, 1896 bp, Artificial Sequence
  Description of Artificial Sequence: Synthetic coding sequence
atgagccactgggcccccgagtggaagagagccgaggccaaccccagagacctgggcgccagctgggacgtgagaggcagcagaggcagcggctggagcggccccttcggccaccagggccccagagccgccggcagcagagagccccccctgtgcttcaagatcaagaacaacatggtgggcgtggtgatcggctacagcggcagcaagatcaaggacctgcagcacagcaccaacaccaagatccagatcatcaacggcgagagcgaggccaaggtgagaatcttcggcaacagagagatgaaggccaaggccaaggccgccatcgagaccctgatcagaaagcaggagagctacaacagcgagagcagcgtggacaacgccgccagccagacccccatcggcagaaacctgggcagaaacgacatcgtgggcgaggccgagcccctgagcaactgggacagaatcagagccgccgtggtggagtgcgagaagagaaagtgggccgacctgccccccgtgaagaagaacttctacatcgagagcaaggccaccagctgcatgagcgagatgcaggtgatcaactggagaaaggagaacttcaacatcacctgcgacgacctgaagagcggcgagaagagactgatccccaagcccacctgcagattcaaggacgccttccagcagtaccccgacctgctgaagagcatcatcagagtgggcatcgtgaagcccacccccatccagagccaggcctggcccatcatcctgcagggcatcgacctgatcgtggtggcccagaccggcaccggcaagaccctgagctacctgatgcccggcttcatccacctggacagccagcccatcagcagagagcagagaaacggccccggcatgctggtgctgacccccaccagagagctggccctgcacgtggaggccgagtgcagcaagtacagctacaagggcctgaagagcatctgcatctacggcggcagaaacagaaacggccagatcgaggacatcagcaagggcgtggacatcatcatcgccacccccggcagactgaacgacctgcagatgaacaacagcgtgaacctgagaagcatcacctacctggtgatcgacgaggccgacaagatgctggacatggagttcgagccccagatcagaaagatcctgctggacgtgagacccgacagacagaccgtgatgaccagcgccacctggcccgacaccgtgagacagctggccctgagctacctgaaggaccccatgatcgtgtacgtgggcaacctgaacctggtggccgtgaacaccgtgaagcagaacatcatcgtgaccaccgagaaggagaagagagccctgacccaggagttcgtggagaacatgagccccaacgacaaggtgatcatgttcgtgagccagaagcacatcgccgacgacctgagcagcgacttcaacatccagggcatcagcgccgagagcctgcacggcaacagcgagcagagcgaccaggagagagccgtggaggacttcaagagcggcaacatcaagatcctgatcaccaccgacatcgtgagcagaggcctggacctgaacgacgtgacccacgtgtacaactacgacttccccagaaacatcgacgtgtacgtgcacagagtgggctacatcggcagaaccggcaagaccggcaccagcgtgaccctgatcacccagagagacagcaagatggccggcgagctgatcaagatcctggacagagccaaccagagcgtgcccgaggacctggtggtgatggccgagcagtacaagctgaaccagcagaagagacacagagagaccagaagcagaaagcccggccagagaagaaaggagttctacttcctgagctag

SEQ ID NO: 7947 - DNA, 1644 bp, Artificial Sequence
  Description of Artificial Sequence: Synthetic coding sequence
atggaggacagcgaggccctgggcttcgagcacatgggcctggaccccagactgctgcaggccgtgaccgacctgggctggagcagacccaccctgatccaggagaaggccatccccctggccctggagggcaaggacctgctggccagagccagaaccggcagcggcaagaccgccgcctacgccatccccatgctgcagctgctgctgcacagaaaggccaccggccccgtggtggagcaggccgtgagaggcctggtgctggtgcccaccaaggagctggccagacaggcccagagcatgatccagcagctggccacctactgcgccagagacgtgagagtggccaacgtgagcgccgccgaggacagcgtgagccagagagccgtgctgatggagaagcccgacgtggtggtgggcacccccagcagaatcctgagccacctgcagcaggacagcctgaagctgagagacagcctggagctgctggtggtggacgaggccgacctgctgttcagcttcggcttcgaggaggagctgaagagcctgctgtgccacctgcccagaatctaccaggccttcctgatgagcgccaccttcaacgaggacgtgcaggccctgaaggagctgatcctgcacaaccccgtgaccctgaagctgcaggagagccagctgcccggccccgaccagctgcagcagttccaggtggtgtgcgagaccgaggaggacaagttcctgctgctgtacgccctgctgaagctgagcctgatcagaggcaagagcctgctgttcgtgaacaccctggagagaagctacagactgagactgttcctggagcagttcagcatccccacctgcgtgctgaacggcgagctgcccctgagaagcagatgccacatcatcagccagttcaaccagggcttctacgactgcgtgatcgccaccgacgccgaggtgctgggcgcccccgtgaagggcaagagaagaggcagaggccccaagggcgacaaggccagcgaccccgaggccggcgtggccagaggcatcgacttccaccacgtgagcgccgtgctgaacttcgacctgccccccacccccgaggcctacatccacagagccggcagaaccgccagagccaacaaccccggcatcgtgctgaccttcgtgctgcccaccgagcagttccacctgggcaagatcgaggagctgctgagcggcgagaacagaggccccatcctgctgccctaccagttcagaatggaggagatcgagggcttcagatacagatgcagagacgccatgagaagcgtgaccaagcaggccatcagagaggccagactgaaggagatcaaggaggagctgctgcacagcgagaagctgaagacctacttcgaggacaaccccagagacctgcagctgctgagacacgacctgcccctgcaccccgccgtggtgaagccccacctgggccacgtgcccgactacctggtgccccccgccctgagaggcctggtgagaccccacaagaagagaaagaagctgagcagcagctgcagaaaggccaagagagccaagagccagaaccccctgagaagcttcaagcacaagggcaagaagttcagacccaccgccaagcccagctag

SEQ ID NO: 7948 - DNA, 2112 bp, Artificial Sequence
  Description of Artificial Sequence: Synthetic coding sequence
atggccgcccccgtgggccccgtgaagttctggagacccggcaccgagggccccggcgtgagcatcagcgaggagagacagagcctggccgagaacagcggcaccaccgtggtgtacaacccctacgccgccctgagcatcgagcagcagagacagaagctgcccgtgttcaagctgagaaaccacatcctgtacctgatcgagaactaccagaccgtggtgatcgtgggcgagaccggctgcggcaagagcacccagatcccccagtacctggccgaggccggctggaccgccgagggcagagtggtgggcgtgacccagcccagaagagtggccgccgtgaccgtggccggcagagtggccgaggagagaggcgccgtgctgggccacgaggtgggctactgcatcagattcgacgactgcaccgaccagctggccaccagaatcaagttcctgaccgacggcatgctggtgagagagatgatggtggaccccctgctgaccaagtacagcgtgatcatgctggacgaggcccacgagagaaccctgtacaccgacatcgccatcggcctgctgaagaagatccagaagaagagaggcgacctgagactgatcgtggccagcgccaccctggacgccgacaagttcagagacttcttcaaccagaacgagaccagcgaccccgccagagacacctgcgtgatcctgaccgtggagggcagaaccttccccgtggacatcttctacctgcagagccccgtgcccgactacatcaagagcaccgtggagaccgtggtgaagatccaccagaccgagggcgacggcgacgtgctggccttcctgaccggccaggaggaggtggagaccgtggtgagcatgctgatcgagcaggccagagccctggccagaaccggcatgaagagacacctgagagtgctgcccatgtacgccggcctgcccagcttcgagcagatgaaggtgttcgagagagtgagcagaagcgtgagaaaggtgatcgtggccaccaacgtggccgagaccagcatcaccatcagcggcatcgtgtacgtgatcgactgcggcttcgtgaagctgagagcctacaaccccagaaccgccatcgagtgcctggtggtggtgcccgtgagccaggccagcgccaaccagagagccggcagaggcggcagaagcagaagcggcaagtgctacagactgtacaccgaggaggccttcgacaagctgccccagagcaccgtgcccgagatgcagagaagcaacctggcccccgtgatcctgcagctgaaggccctgggcatcgacaacgtgctgagattccacttcatgagccccccccccgcccagagcatggtgcaggccctggagctgctgtacgccctgggcggcctggacaaggactgcagactgaccgagcccctgggcatgagaatcgccgagttccccctgaaccccatgttcgccaagatgctgctggagagcggcaacttcggctgcagccaggagatcctgagcatcgccgccatgatgcagatccagaacatcttcgtggtgccccccaaccagaagagccacgccatcagagtgcacagaaagttcgccgtggaggagggcgaccacctgaccatgctgaacatctacgaggccttcatcaagcacaacaaggacagcaagtggtgccaggagcacttcctgaactacaagggcctggtgagagccgccaccgtgagagagcagctgaagaagctgctggtgaagttccaggtgcccagaaagagcagcgagggcgaccccgacctggtgctgagatgcatcgtgagcggcttcttcgccaacgccgccagattccacagcaccggcgcctacagaaccatcagagacgaccacgagctgcacatccaccccgccagcgtgctgtacgccgagaagccccccagatgggtgatctacaacgaggtgatccagaccagcaagtactacatgagagacgtgaccgccatcgagagcgcctggctgctggagctggccccccacttctaccagcagggcacccacctgagcctgaaggccaagagagccaaggtgcaggacccctag

SEQ ID NO: 7949 - DNA, 552 bp, Artificial Sequence
  Description of Artificial Sequence: Synthetic coding sequence
atgctgctggagagcggcaacttcggctgcagccaggagatcctgagcatcgccgccatgatgcagatccagaacatcttcgtggtgccccccaaccagaagagccacgcccacaacaaggacagcaagtggtgccaggagcacttcctgaactacaagggcctggtgagagccgccaccgtgagagagcagctgaagaagctgctggtgaagttccaggtgcccagaaagagcagcgagggcgaccccgacctggtgctgagatgcatcgtgagcggcttcttcgccaacgccgccagattccacagcaccggcgcctacagaaccatcagagacgaccacgagctgcacatccaccccgccagcgtgctgtacgccgagaagccccccagatgggtgatctacaacgaggtgatccagaccagcaagtactacatgagagacgtgaccgccatcgagagcgcctggctgctggagctggccccccacttctaccagcagggcacccacctgagcctgaaggccaagagagccaaggtgcaggacccctag

SEQ ID NO: 7950 - DNA, 2019 bp, Artificial Sequence
  Description of Artificial Sequence: Synthetic coding sequence
atggccgcccccgtgggccccgtgaagttctggagacccggcaccgagggccccggcgtgagcatcagcgaggagagacagagcctggccgagaacagcggcaccaccgtggtgtacaacccctacgccgccctgagcatcgagcagcagagacagaagctgcccgtgttcaagtacctggccgaggccggctggaccgccgagggcagagtggtgggcgtgacccagcccagaagagtggccgccgtgaccgtggccggcagagtggccgaggagagaggcgccgtgctgggccacgaggtgggctactgcatcagattcgacgactgcaccgaccagctggccaccagaatcaagttcctgaccgacggcatgctggtgagagagatgatggtggaccccctgctgaccaagtacagcgtgatcatgctggacgaggcccacgagagaaccctgtacaccgacatcgccatcggcctgctgaagaagatccagaagaagagaggcgacctgagactgatcgtggccagcgccaccctggacgccgacaagttcagagacttcttcaaccagaacgagaccagcgaccccgccagagacacctgcgtgatcctgaccgtggagggcagaaccttccccgtggacatcttctacctgcagagccccgtgcccgactacatcaagagcaccgtggagaccgtggtgaagatccaccagaccgagggcgacggcgacgtgctggccttcctgaccggccaggaggaggtggagaccgtggtgagcatgctgatcgagcaggccagagccctggccagaaccggcatgaagagacacctgagagtgctgcccatgtacgccggcctgcccagcttcgagcagatgaaggtgttcgagagagtgagcagaagcgtgagaaaggtgatcgtggccaccaacgtggccgagaccagcatcaccatcagcggcatcgtgtacgtgatcgactgcggcttcgtgaagctgagagcctacaaccccagaaccgccatcgagtgcctggtggtggtgcccgtgagccaggccagcgccaaccagagagccggcagaggcggcagaagcagaagcggcaagtgctacagactgtacaccgaggaggccttcgacaagctgccccagagcaccgtgcccgagatgcagagaagcaacctggcccccgtgatcctgcagctgaaggccctgggcatcgacaacgtgctgagattccacttcatgagccccccccccgcccagagcatggtgcaggccctggagctgctgtacgccctgggcggcctggacaaggactgcagactgaccgagcccctgggcatgagaatcgccgagttccccctgaaccccatgttcgccaagatgctgctggagagcggcaacttcggctgcagccaggagatcctgagcatcgccgccatgatgcagatccagaacatcttcgtggtgccccccaaccagaagagccacgccatcagagtgcacagaaagttcgccgtggaggagggcgaccacctgaccatgctgaacatctacgaggccttcatcaagcacaacaaggacagcaagtggtgccaggagcacttcctgaactacaagggcctggtgagagccgccaccgtgagagagcagctgaagaagctgctggtgaagttccaggtgcccagaaagagcagcgagggcgaccccgacctggtgctgagatgcatcgtgagcggcttcttcgccaacgccgccagattccacagcaccggcgcctacagaaccatcagagacgaccacgagctgcacatccaccccgccagcgtgctgtacgccgagaagccccccagatgggtgatctacaacgaggtgatccagaccagcaagtactacatgagagacgtgaccgccatcgagagcgcctggctgctggagctggccccccacttctaccagcagggcacccacctgagcctgaaggccaagagagccaaggtgcaggacccctag

SEQ ID NO: 7951 - DNA, 2154 bp, Artificial Sequence
  Description of Artificial Sequence: Synthetic coding sequence
atgaccagccagcccctgagactggccgaggagtacggccccagccccggcgagagcgagctggccgtgaaccccttcgacggcctgcccttcagcagcagatactacgagctgctgaagcagagacaggccctgcccatctgggccgccagattcaccttcctggagcagctggagagcaaccccaccggcgtggtgctggtgagcggcgagcccggcagcggcaagagcacccagatcccccagtggtgcgccgagttcgccctggccagaggcttccagaagggccaggtgaccgtgacccagccctaccccctggccgccagaagcctggccctgagagtggccgacgagatggacctgaccctgggccacgaggtgggctacagcatcccccaggaggactgcaccggccccaacaccctgctgagattctgctgggacagactgctgctgcaggaggtggccagcaccagaggcaccggcgcctggggcgtgctggtgctggacgaggcccaggagagaagcgtggccagcgacagcctgcagggcctgctgcaggacgccagactggagaagctgcccggcgacctgagagtggtggtggtgaccgaccccgccctggagcccaagctgagagccttctggggcaacccccccatcgtgcacatccccagagagcccggcgagagacccagccccatctactgggacaccatcccccccgacagagtggaggccgcctgccaggccgtgctggagctgtgcagaaaggagctgcccggcgacgtgctggtgttcctgcccagcgaggaggagatcagcctgtgctgcgagagcctgagcagagaggtggagagcctgctgctgcagggcctgccccccagagtgctgcccctgcaccccgactgcggcagagccgtgcaggccgtgtacgaggacatggacgccagaaaggtggtggtgacccactggctggccgacttcagcttcagcctgcccagcatccagcacgtgatcgacagcggcctggagctgagaagcgtgtacaaccccagaatcagagccgagttccaggtgctgagacccatcagcaagtgccaggccgaggccagaagactgagagccagaggcttcccccccggcagctgcctgtgcctgtaccccaagagcttcctggagctggaggccccccccctgccccagcccagagtgtgcgaggagaacctgagcagcctggtgctgctgctgaagagaagacagatcgccgagcccggcgagtgccacttcctggaccagcccgcccccgaggccctgatgcaggccctggaggacctggactacctggccgccctggacgacgacggcgacctgagcgacctgggcgtgatcctgagcgagttccccctggcccccgagctggccaaggccctgctggccagctgcgagttcgactgcgtggacgagatgctgaccctggccgccatgctgaccgccgcccccggcttcaccagaccccccctgagcgccgaggaggccgccctgagaagagccctggagcacaccgacggcgaccacagcagcctgatccaggtgtacgaggccttcatccagagcggcgccgacgaggcctggtgccaggccagaggcctgaactgggccgccctgtgccaggcccacaagctgagaggcgagctgctggagctgatgcagagaatcgagctgcccctgagcctgcccgccttcggcagcgagcagaacagaagagacctgcagaaggccctggtgagcggctacttcctgaaggtggccagagacaccgacggcaccggcaactacctgctgctgacccacaagcacgtggcccagctgagcagctactgctgctacagaagcagaagagcccccgccagaccccccccctgggtgctgtaccacaacttcaccatcagcaaggacaactgcctgagcatcgtgagcgagatccagccccagatgctggtggagctggcccccccctacttcctgagcaacctgccccccagcgagagcagagacctgctgaaccagctgagagagggcatggccgacagcaccgccggcagcaagagcagcagcgcccaggagttcagagacccctgcgtgctgcagtag

SEQ ID NO: 7952 - DNA, 2154 bp, Artificial Sequence; identical to SEQ ID NO: 7951
  Description of Artificial Sequence: Synthetic coding sequence

SEQ ID NO: 7953 - DNA, 981 bp, Artificial Sequence
  Description of Artificial Sequence: Synthetic coding sequence
atggccctgagcggcagcacccccgccccctgctgggaggaggacgagtgcctggactactacggcatgctgagcctgcacagaatgttcgaggtggtgggcggccagctgaccgagtgcgagctggagctgctggccttcctgctggacgaggcccccggcgccgccggcggcctggccagagccagaagcggcctggagctgctgctggagctggagagaagaggccagtgcgacgagagcaacctgagactgctgggccagctgctgagagtgctggccagacacgacctgctgccccacctggccagaaagagaagaagacccgtgagccccgagagatacagctacggcaccagcagcagcagcaagagaaccgagggcagctgcagaagaagaagacagagcagcagcagcgccaacagccagcagggccagtgggagaccggcagcccccccaccaagagacagagaagaagcagaggcagacccagcggcggcgccagaagaagaagaagaggcgcccccgccgccccccagcagcagagcgagcccgccagacccagcagcgagggcaaggtgacctgcgacatcagactgagagtgagagccgagtactgcgagcacggccccgccctggagcagggcgtggccagcagaagaccccaggccctggccagacagctggacgtgttcggccaggccaccgccgtgctgagaagcagagacctgggcagcgtggtgtgcgacatcaagttcagcgagctgagctacctggacgccttctggggcgactacctgagcggcgccctgctgcaggccctgagaggcgtgttcctgaccgaggccctgagagaggccgtgggcagagaggccgtgagactgctggtgagcgtggacgaggccgactacgaggccggcagaagaagactgctgctgatggaggaggagggcggcagaagacccaccgaggccagctag

SEQ ID NO: 7954 - DNA, 981 bp, Artificial Sequence; identical to SEQ ID NO: 7953
  Description of Artificial Sequence: Synthetic coding sequence

SEQ ID NO: 7955 - DNA, 1635 bp, Artificial Sequence
  Description of Artificial Sequence: Synthetic coding sequence
atgagagtggccgtggccggctgctgccacggcgagctggacaagatctacgagaccctggccctggccgagagaagaggccccggccccgtggacctgctgctgtgctgcggcgacttccaggccgtgagaaacgaggccgacctgagatgcatggccgtgccccccaagtacagacacatgcagaccttctacagatactacagcggcgagaagaaggcccccgtgctgaccctgttcatcggcggcaaccacgaggccagcaaccacctgcaggagctgccctacggcggctgggtggcccccaacatctactacctgggcctggccggcgtggtgaagtacagaggcgtgagaatcggcggcatcagcggcatcttcaagagccacgactacagaaagggccacttcgagtgccccccctacaacagcagcaccatcagaagcatctaccacgtgagaaacatcgaggtgtacaagctgaagcagctgaagcagcccatcgacatcttcctgagccacgactggcccagaagcatctaccactacggcaacaagaagcagctgctgaagaccaagagcttcttcagacaggaggtggagaacaacaccctgggcagccccgccgccagcgagctgctggagcacctgaagcccacctactggttcagcgcccacctgcacgtgaagttcgccgccctgatgcagcaccaggccaaggacaagggccagaccgccagagccaccaagttcctggccctggacaagtgcctgccccacagagacttcctgcagatcctggagatcgagcacgaccccagcgcccccgactacctggagtacgacatcgagtggctgaccatcctgagagccaccgacgacctgatcaacgtgaccggcagactgtggaacatgcccgagaacaacggcctgcacgccagatgggactacagcgccaccgaggagggcatgaaggaggtgctggagaagctgaaccacgacctgaaggtgccctgcaacttcagcgtgaccgccgcctgctacgaccccagcaagccccagacccagatgcagctgatccacagaatcaacccccagaccaccgagttctgcgcccagctgggcatcatcgacatcaacgtgagactgcagaagagcaaggaggagcaccacgtgtgcggcgagtacgaggagcaggacgacgtggagagcaacgacagcggcgaggaccagagcgagtacaacaccgacaccagcgccctgagcagcatcaaccccgacgagatcatgctggacgaggaggaggacgaggacagcatcgtgagcgcccacagcggcatgaacacccccagcgtggagcccagcgaccaggccagcgagttcagcgccagcttcagcgacgtgagaatcctgcccggcagcatgatcgtgagcagcgacgacaccgtggacagcaccatcgacagagagggcaagcccggcggcaccgtggagagcggcaacggcgaggacctgaccaaggtgcccctgaagagactgagcgacgagcacgagcccgagcagagaaagaagatcaagagaagaaaccaggccatctacgccgccgtggacgacgacgacgacgacgccgcctag

SEQ ID NO: 7956 - DNA, 933 bp, Artificial Sequence
  Description of Artificial Sequence: Synthetic coding sequence
atgcagcaccaggccaaggacaagggccagaccgccagagccaccaagttcctggccctggacaagtgcctgccccacagagacttcctgcagatcctggagatcgagcacgaccccagcgcccccgactacctggagtacgacatcgagtggctgaccatcctgagagccaccgacgacctgatcaacgtgaccggcagactgtggaacatgcccgagaacaacggcctgcacgccagatgggactacagcgccaccgaggagggcatgaaggaggtgctggagaagctgaaccacgacctgaaggtgccctgcaacttcagcgtgaccgccgcctgctacgaccccagcaagccccagacccagatgcagctgatccacagaatcaacccccagaccaccgagttctgcgcccagctgggcatcatcgacatcaacgtgagactgcagaagagcaaggaggagcaccacgtgtgcggcgagtacgaggagcaggacgacgtggagagcaacgacagcggcgaggaccagagcgagtacaacaccgacaccagcgccctgagcagcatcaaccccgacgagatcatgctggacgaggaggaggacgaggacagcatcgtgagcgcccacagcggcatgaacacccccagcgtggagcccagcgaccaggccagcgagttcagcgccagcttcagcgacgtgagaatcctgcccggcagcatgatcgtgagcagcgacgacaccgtggacagcaccatcgacagagagggcaagcccggcggcaccgtggagagcggcaacggcgaggacctgaccaaggtgcccctgaagagactgagcgacgagcacgagcccgagcagagaaagaagatcaagagaagaaaccaggccatctacgccgccgtggacgacgacgacgacgacgccgcctag

SEQ ID NO: 7957 - DNA, 1653 bp, Artificial Sequence
  Description of Artificial Sequence: Synthetic coding sequence
atggaccaccacgtgagcaccatcaagcccagaagaatccagaaccagaacgtgatccacagactggagagaagaagaatcagcagcggcaaggccggcacccactggcaccaggtgagagtgttccaccagaacgtgttccccaacttcaccgtggtgaacgtggagaagcccccctgcttcctgagaaagttcagccccgacggcagatacttcatcgccttcagcagcgaccagaccagcctggagatctacgagtaccagggctgccaggccgccgaggacctgctgcagggctacgagggcgagatcctgagcaacggcaacgaccagagaagcgtgaacatcagaggcagactgttcgagagattcttcgtgctgctgcacatcaccaacgtggccgccaacggcgagcacctgaacagagagtgcagcctgttcaccgacgactgcagatgcgtgatcgtgggcagcgccgcctacctgcccgacgagccccacccccccttcttcgaggtgtacagaaacagcgagagcgtgacccccaaccccagaagccccctggaggactacagcctgcacatcatcgacctgcacaccggcagactgtgcgacaccagaaccttcaagtgcgacaaggtggtgctgagccacaaccagggcctgtacctgtacaagaacatcctggccatcctgagcgtgcagcagcagaccatccacgtgttccaggtgacccccgagggcaccttcatcgacgtgagaaccatcggcagattctgctacgaggacgacctgctgaccgtgagcgccgtgttccccgaggtgcagagagacagccagaccggcatggccaaccccttcagagaccccttcatcaacagcctgaagcacagactgctggtgtacctgtggagaagagccgagcaggacggcagcgccatggccaagagaagattcttccagtacttcgaccagctgagacagctgagaatgtggaagatgcagctgctggacgagaaccacctgttcatcaagtacaccagcgaggacgtggtgaccctgagagtgaccgaccccagccaggccagcttcttcgtggtgtacaacatggtgaccaccgaggtgatcgccgtgttcgagaacaccagcgacgagctgctggagctgttcgagaacttctgcgacctgttcagaaacgccaccctgcacagcgaggtgcagttcccctgcagcgccagcagcaacaacttcgccagacagatccagagaagattcaaggacaccatcatcaacgccaagtacggcggccacaccgaggccgtgagaagactgctgggccagctgcccatcagcgcccagagctacagcggcagcccctacctggacctgagcctgttcagctacgacgacaagtgggtgagcgtgatggagagacccaagacctgcggcgaccaccccatcagattctacgccagagacagcggcctgctgaagttcgagatccaggccggcctgctgggcagacccatcaaccacaccgtgagaagactggtggccttcaccttccaccccttcgagcccttcgccatcagcgtgcagagaaccaacgccgagtacgtggtgaacttccacatgagacactgctgcacctag

SEQ ID NO: 7958 - DNA, 1686 bp, Artificial Sequence
  Description of Artificial Sequence: Synthetic coding sequence
atggtgggccagatcctgaagagagacgtgatcatggaccaccacgtgagcaccatcaagcccagaagaatccagaaccagaacgtgatccacagactggagagaagaagaatcagcagcggcaaggccggcacccactggcaccaggtgagagtgttccaccagaacgtgttccccaacttcaccgtggtgaacgtggagaagcccccctgcttcctgagaaagttcagccccgacggcagatacttcatcgccttcagcagcgaccagaccagcctggagatctacgagtaccagggctgccaggccgccgaggacctgctgcagggctacgagggcgagatcctgagcaacggcaacgaccagagaagcgtgaacatcagaggcagactgttcgagagattcttcgtgctgctgcacatcaccaacgtggccgccaacggcgagcacctgaacagagagtgcagcctgttcaccgacgactgcagatgcgtgatcgtgggcagcgccgcctacctgcccgacgagccccacccccccttcttcgaggtgtacagaaacagcgagagcgtgacccccaaccccagaagccccctggaggactacagcctgcacatcatcgacctgcacaccggcagactgtgcgacaccagaaccttcaagtgcgacaaggtggtgctgagccacaaccagggcctgtacctgtacaagaacatcctggccatcctgagcgtgcagcagcagaccatccacgtgttccaggtgacccccgagggcaccttcatcgacgtgagaaccatcggcagattctgctacgaggacgacctgctgaccgtgagcgccgtgttccccgaggtgcagagagacagccagaccggcatggccaaccccttcagagaccccttcatcaacagcctgaagcacagactgctggtgtacctgtggagaagagccgagcaggacggcagcgccatggccaagagaagattcttccagtacttcgaccagctgagacagctgagaatgtggaagatgcagctgctggacgagaaccacctgttcatcaagtacaccagcgaggacgtggtgaccctgagagtgaccgaccccagccaggccagcttcttcgtggtgtacaacatggtgaccaccgaggtgatcgccgtgttcgagaacaccagcgacgagctgctggagctgttcgagaacttctgcgacctgttcagaaacgccaccctgcacagcgaggtgcagttcccctgcagcgccagcagcaacaacttcgccagacagatccagagaagattcaaggacaccatcatcaacgccaagtacggcggccacaccgaggccgtgagaagactgctgggccagctgcccatcagcgcccagagctacagcggcagcccctacctggacctgagcctgttcagctacgacgacaagtgggtgagcgtgatggagagacccaagacctgcggcgaccaccccatcagattctacgccagagacagcggcctgctgaagttcgagatccaggccggcctgctgggcagacccatcaaccacaccgtgagaagactggtggccttcaccttccaccccttcgagcccttcgccatcagcgtgcagagaaccaacgccgagtacgtggtgaacttccacatgagacactgctgcacctag

SEQ ID NO: 7959 - DNA, 1686 bp, Artificial Sequence; identical to SEQ ID NO: 7958
  Description of Artificial Sequence: Synthetic coding sequence

SEQ ID NO: 7960 - DNA, 5592 bp, Artificial Sequence
  Description of Artificial Sequence: Synthetic coding sequence
atgatcgaggacaagggccccagagtggccgactacttcgtggtggccggcctgaccgacgtgagcaagcccctggaggaggagatccacttcaacgacgcctgccacaaggtggccaagcccaaggagcccatcaccgacgtgagcgtgatcatcaagagcctgggcgaggaggtgccccaggactacatctgcatcgacgtgacccccaccggcctgagcgccgacctgaacaacggcagcctggtgggcccccagatctacctgtgctacagaagaggcagagacaagccccccctgaccgacctgggcgtgctgtacgactggaaggagagactgaagcagggctgcgagatcatccagagcaccccctacggcagacccgccaacatcagcggcagcaccagcagccagagaatctacatcacctacagaagagccagcgagaacatgacccagaacaccctggccgtgaccgacatctgcatcatcatccccagcaagggcgagagccccccccacaccttctgcaaggtggacaagaacctgaacaacagcatgtggggcagcgccgtgtacctgtgctacaagaagagcgtggccaagaccaacaccgtgagctacaaggccggcctgatctgcagatacccccaggaggactacgagagcttcagcctgcccgagagcgtgcccctgttctgcctgcccatgggcgccaccatcgagtgctggcccagcaacagcaagtaccccctgcccgtgttcagcaccttcgtgctgaccggcgccagcgccgagaaggtgtacggcgccgccatccagttctacgagccctacagcgaggagaacctgaccgagaagcagagactgctgctgggcctgaccagcgccgacggcaagagcgacagcagcaagaccatccacaccaacaagtgcatctgcctgctgagccactggcccttcttcgacgccttcagaaagttcctgaccttcctgtacagatacagcatcagcggcccccacgtgctgcccatcgagaagcacatcagccacttcatgcacaaggtgcccttccccagcccccagagacccagaatcctggtgcagctgagcccccacgacaacctgatcctgagccagcccgtgagcagccccctgcccctgagcggcggcaagttcagcaccctgctgcagaacctgggccccgagaacgccgtgaccctgctggtgttcgccgtgaccgagcacaagatcctgatccacagcctgagacccagcgtgctgaccagcgtgaccgaggccctggtgagcatgatcttccccttccactggccctgcccctacgtgcccctgtgccccctggccctggccgacgtgctgagcgccccctgccccttcatcgtgggcatcgacagcagatacttcgacctgtacgaccccccccccgacgtgagctgcgtggacgtggacaccaacaccatcagccagatcggcgacaagaagaacgtggcctggaagatcctgcccaagaagccctgcaagaacctgatgaacaccctgaacaacctgcaccagcagctggccaagctgcagcagagacccagagacgacggcctgatggacctggccatcaacgactacgacttcaacagcggcaagagactgcacatgatcgacctggagatccaggaggccttcctgttcttcatggccagcatcctgaagggctacagaagctacctgagacccatcacccaggcccccagcgagaccgccaccgacgccgccagcctgttcgccctgcaggccttcctgagaagcagagacagaagccaccagaagttctacaacatgatgaccaagacccagatgttcatcagattcatcgaggagtgcagcttcgtgagcgacaaggacgccagcctggccttcttcgacgactgcgtggacaaggtggacatggacaagagcggcgaggtgagactgatcgagctggacgagagcttcaagagcgagcacaccgtgttcgtgaccccccccgagatcccccacctgcccaacggcgaggagccccccctgcagtacagctacaacggcttccccgtgctgagaaacaacctgttcgagagacccgagggcttcctgcaggccaagaagaacaagctgcccagcaagagcagcagccccaacagccccctgcccatgttcagaagaaccaagcaggagatcaagagcgcccacaagatcgccaagagatacagcagcatcccccagatgtggagcagatgcctgctgagacactgctacggcctgtggttcatctgcctgcccgcctacgtgaaggtgtgccacagcaaggtgagagccctgaagaccgcctacgacgtgctgaagaagatgcagagcaagaagatggacccccccgacgaggtgtgctacagaatcctgatgcagctgtgcggccagtacgaccagcccgtgctggccgtgagagtgctgttcgagatgcagaaggccggcatcgaccccaacgccatcacctacggctactacaacaaggccgtgctggagagcacctggcccagcagaagcagaagcggctacttcctgtggaccaaggtgagaaacgtggtgctgggcgtgacccagttcaagagagccctgaagaagcacgcccacctgagccagaccaccctgagcggcggccagagcgacctgggctacaacagcctgagcaaggacgaggtgagaagaggcgacaccagcaccgaggacatccaggaggagaaggacaagaagggcagcgactgcagcagcctgagcgagagcgagagcaccaagggcagcgccgactgcctgcccaagctgagctaccagaacagcagcagcatcgtgagactgaccggcaccagcaacaacagcgccggcaagatcagcggcgagagcatggagagcacccccgagctgctgctgatcagcagcctggaggacaccaacgagaccagaaacatccagagcagatgcttcagaaagagacacaagagcgacaacgagaccaacctgcagcagcaggtggtgtggggcaacagaaacagaaacctgagcggcggcgtgctgatgggcttcatgctgaacagaatcaaccaggaggccacccccggcgacatcgtggagaagctgggcgccgacgccaagatcctgagcaacgtgatcagcaagagcaccagacccaacaccctggacatcggcaagccccccctgagaagcaagagagacagcctggagaaggagagcagcgacgacgacacccccttcgacggcagcaactacctggccgacaaggtggacagccccgtgatcttcgacctggaggacctggacagcgagaccgacgtgagcaaggccggctgcgtggccacccagaaccccaagagaatccagagaatgaacagcagcttcagcgtgaagcccttcgagaagaccgacgtggccaccggcttcgaccccctgagcctgctggtggccgagaccgagcagcagcagaaggaggaggaggaggaggacgaggacgacagcaagagcatcagcacccccagcgccagaagagacctggccgaggagatcgtgatgtacatgaacaacatgagcagccccctgaccagcagaacccccagcatcgacctgcagagagcctgcgacgacaagctgaacaagaagagcccccccctggtgaaggcctgcagaagaagcagcctgccccccaacagccccaagcccgtgagactgaccaagagcaagagctacaccaagagcgaggagaagcccagagacagactgtggagcagccccgccttcagccccacctgccccttcagagaggagagccaggacaccctgacccacagcagccccagcttcaacctggacaccctgctggtgcccaagctggacgtgctgagaaacagcatgttcaccgccggcaagggcgtggccgagaaggccagcaagtggtacagcagattcaccatgtacaccaccagcagcaaggaccagagcagcgacagaaccagcctgagcagcgtgggcgcccaggacagcgagagcaccagcctgaccgacgaggacgtgtgccacgagctggagggccccatcagcagccaggagaccagcgccaccagcggcaccaagagaatcgacctgagcagaatcagcctggagagcagcgccagcctggagggcagcctgagcaagttcgccctgcccggcaagagcgaggtgaccagcagcttcaacgccagcaacaccaacatcttccagaactacgccatggaggtgctgatcagcagctgcagcagatgcagaacctgcgactgcctggtgcacgacgaggagatcatggccggctggaccgccgacgacagcaacctgaacaccacctgccccttctgcggcaacatcttcctgcccttcctgaacatcgagatcagagacctgagaagacccggcagatacttcctgaagagcagccccagcaccgagaacatgcacttccccagcagcatcagcagccagaccagacagagctgcatcagcaccagcgccagcggcctggacaccagcgccctgagcgtgcagggcaacttcgacctgaacagcaagagcaagctgcaggagaacttctgcaccagaagcatccagatccccgccaacagaagcaagaccgccatgagcaagtgccccatcttccccatggccagaagcatcagcaccagcggccccctggacaaggaggacaccggcagacagaagctgatcagcaccggcagcctgcccgccaccctgcagggcgccaccgacagcctgggcctggagtggcacctgcccagccccgaccccgtgaccgtgccctacctgagccccctggtggtgtggaaggagctggagagcctgctggagaacgagggcgaccacgccatcaccgtggccgacttcgtggaccaccaccccatcgtgttctggaacctggtgtggtacttcagaagactggacctgcccagcaacctgcccggcctgatcctgagcagcgagcactgcaacaagtacagcaagatccccagacactgcatgagcgaggacagcaagtacgtgctgatccagatgctgtgggacaacatgaagctgcaccaggaccccggccagcccctgtacatcctgtggaacgcccacacccagaagtaccccatggtgcacctgctgcagaagagcgacaacagcttcaaccaggagctgctgaagagcatggtgaagagcatcaagatgaacgacgtgtacggccccatgagccagatcctggagaccctgaacaagtgcccccacttcaagagacagagaagcctgtacagagagatcctgttcctgagcctggtggccctgggcagagagaacatcgacatcgacgccttcgacaaggagtacaagatggcctacgacagactgacccccagccaggtgaagagcacccacaactgcgacagaccccccagcaccggcgtgatggagtgcagaaagaccttcggcgagccctacctgtag

SEQ ID NO: 7961 - DNA, 5721 bp, Artificial Sequence
  Description of Artificial Sequence: Synthetic coding sequence
atgatcgaggacaagggccccagagtggccgactacttcgtggtggccggcctgaccgacgtgagcaagcccctggaggaggagatccacttcaacgacgcctgccacaaggtggccaagcccaaggagcccatcaccgacgtgagcgtgatcatcaagagcctgggcgaggaggtgccccaggactacatctgcatcgacgtgacccccaccggcctgagcgccgacctgaacaacggcagcctggtgggcccccagatctacctgtgctacagaagaggcagagacaagccccccctgaccgacctgggcgtgctgtacgactggaaggagagactgaagcagggctgcgagatcatccagagcaccccctacggcagacccgccaacatcagcggcagcaccagcagccagagaatctacatcacctacagaagagccagcgagaacatgacccagaacaccctggccgtgaccgacatctgcatcatcatccccagcaagggcgagagccccccccacaccttctgcaaggtggacaagaacctgaacaacagcatgtggggcagcgccgtgtacctgtgctacaagaagagcgtggccaagaccaacaccgtgagctacaaggccggcctgatctgcagatacccccaggaggactacgagagcttcagcctgcccgagagcgtgcccctgttctgcctgcccatgggcgccaccatcgagtgctggcccagcaacagcaagtaccccctgcccgtgttcagcaccttcgtgctgaccggcgccagcgccgagaaggtgtacggcgccgccatccagttctacgagccctacagcgaggagaacctgaccgagaagcagagactgctgctgggcctgaccagcgccgacggcaagagcgacagcagcaagaccatccacaccaacaagtgcatctgcctgctgagccactggcccttcttcgacgccttcagaaagttcctgaccttcctgtacagatacagcatcagcggcccccacgtgctgcccatcgagaagcacatcagccacttcatgcacaaggtgcccttccccagcccccagagacccagaatcctggtgcagctgagcccccacgacaacctgatcctgagccagcccgtgagcagccccctgcccctgagcggcggcaagttcagcaccctgctgcagaacctgggccccgagaacgccgtgaccctgctggtgttcgccgtgaccgagcacaagatcctgatccacagcctgagacccagcgtgctgaccagcgtgaccgaggccctggtgagcatgatcttccccttccactggccctgcccctacgtgcccctgtgccccctggccctggccgacgtgctgagcgccccctgccccttcatcgtgggcatcgacagcagatacttcgacctgtacgaccccccccccgacgtgagctgcgtggacgtggacaccaacaccatcagccagatcggcgacaagaagaacgtggcctggaagatcctgcccaagaagccctgcaagaacctgatgaacaccctgaacaacctgcaccagcagctggccaagctgcagcagagacccagagacgacggcctgatggacctggccatcaacgactacgacttcaacagcggcaagagactgcacatgatcgacctggagatccaggaggccttcctgttcttcatggccagcatcctgaagggctacagaagctacctgagacccatcacccaggcccccagcgagaccgccaccgacgccgccagcctgttcgccctgcaggccttcctgagaagcagagacagaagccaccagaagttctacaacatgatgaccaagacccagatgttcatcagattcatcgaggagtgcagcttcgtgagcgacaaggacgccagcctggccttcttcgacgactgcgtggacaaggtggacatggacaagagcggcgaggtgagactgatcgagctggacgagagcttcaagagcgagcacaccgtgttcgtgaccccccccgagatcccccacctgcccaacggcgaggagccccccctgcagtacagctacaacggcttccccgtgctgagaaacaacctgttcgagagacccgagggcttcctgcaggccaagaagaacaagctgcccagcaagagcagcagccccaacagccccctgcccatgttcagaagaaccaagcaggagatcaagagcgcccacaagatcgccaagagatacagcagcatcccccagatgtggagcagatgcctgctgagacactgctacggcctgtggttcatctgcctgcccgcctacgtgaaggtgtgccacagcaaggtgagagccctgaagaccgcctacgacgtgctgaagaagatgcagagcaagaagatggacccccccgacgaggtgtgctacagaatcctgatgcagctgtgcggccagtacgaccagcccgtgctggccgtgagagtgctgttcgagatgcagaaggccggcatcgaccccaacgccatcacctacggctactacaacaaggccgtgctggagagcacctggcccagcagaagcagaagcggctacttcctgtggaccaaggtgagaaacgtggtgctgggcgtgacccagttcaagagagccctgaagaagcacgcccacctgagccagaccaccctgagcgacggcagcgacctggacgccgtgagccacggcagcatggacagcggccacggcacccacaccgtggagcaggcccccttcaacaccggcctgatcaaggtgtacgccaccgacgacagaagcagcaccggcggccagagcgacctgggctacaacagcctgagcaaggacgaggtgagaagaggcgacaccagcaccgaggacatccaggaggagaaggacaagaagggcagcgactgcagcagcctgagcgagagcgagagcaccaagggcagcgccgactgcctgcccaagctgagctaccagaacagcagcagcatcgtgagactgaccggcaccagcaacaacagcgccggcaagatcagcggcgagagcatggagagcacccccgagctgctgctgatcagcagcctggaggacaccaacgagaccagaaacatccagagcagatgcttcagaaagagacacaagagcgacaacgagaccaacctgcagcagcaggtggtgtggggcaacagaaacagaaacctgagcggcggcgtgctgatgggcttcatgctgaacagaatcaaccaggaggccacccccggcgacatcgtggagaagctgggcgccgacgccaagatcctgagcaacgtgatcagcaagagcaccagacccaacaccctggacatcggcaagccccccctgagaagcaagagagacagcctggagaaggagagcagcgacgacgacacccccttcgacggcagcaactacctggccgacaaggtggacagccccgtgatcttcgacctggaggacctggacagcgagaccgacgtgagcaaggccggctgcgtggccacccagaaccccaagagaatccagagaatgaacagcagcttcagcgtgaagcccttcgagaagaccgacgtggccaccggcttcgaccccctgagcctgctggtggccgagaccgagcagcagcagaaggaggaggaggaggaggacgaggacgacagcaagagcatcagcacccccagcgccagaagagacctggccgaggagatcgtgatgtacatgaacaacatgagcagccccctgaccagcagaacccccagcatcgacctgcagagagcctgcgacgacaagctgaacaagaagagcccccccctggtgaaggcctgcagaagaagcagcctgccccccaacagccccaagcccgtgagactgaccaagagcaagagctacaccaagagcgaggagaagcccagagacagactgtggagcagccccgccttcagccccacctgccccttcagagaggagagccaggacaccctgacccacagcagccccagcttcaacctggacaccctgctggtgcccaagctggacgtgctgagaaacagcatgttcaccgccggcaagggcgtggccgagaaggccagcaagtggtacagcagattcaccatgtacaccaccagcagcaaggaccagagcagcgacagaaccagcctgagcagcgtgggcgcccaggacagcgagagcaccagcctgaccgacgaggacgtgtgccacgagctggagggccccatcagcagccaggagaccagcgccaccagcggcaccaagagaatcgacctgagcagaatcagcctggagagcagcgccagcctggagggcagcctgagcaagttcgccctgcccggcaagagcgaggtgaccagcagcttcaacgccagcaacaccaacatcttccagaactacgccatggaggtgctgatcagcagctgcagcagatgcagaacctgcgactgcctggtgcacgacgaggagatcatggccggctggaccgccgacgacagcaacctgaacaccacctgccccttctgcggcaacatcttcctgcccttcctgaacatcgagatcagagacctgagaagacccggcagatacttcctgaagagcagccccagcaccgagaacatgcacttccccagcagcatcagcagccagaccagacagagctgcatcagcaccagcgccagcggcctggacaccagcgccctgagcgtgcagggcaacttcgacctgaacagcaagagcaagctgcaggagaacttctgcaccagaagcatccagatccccgccaacagaagcaagaccgccatgagcaagtgccccatcttccccatggccagaagcatcagcaccagcggccccctggacaaggaggacaccggcagacagaagctgatcagcaccggcagcctgcccgccaccctgcagggcgccaccgacagcctgggcctggagtggcacctgcccagccccgaccccgtgaccgtgccctacctgagccccctggtggtgtggaaggagctggagagcctgctggagaacgagggcgaccacgccatcaccgtggccgacttcgtggaccaccaccccatcgtgttctggaacctggtgtggtacttcagaagactggacctgcccagcaacctgcccggcctgatcctgagcagcgagcactgcaacaagtacagcaagatccccagacactgcatgagcgaggacagcaagtacgtgctgatccagatgctgtgggacaacatgaagctgcaccaggaccccggccagcccctgtacatcctgtggaacgcccacacccagaagtaccccatggtgcacctgctgcagaagagcgacaacagcttcaaccaggagctgctgaagagcatggtgaagagcatcaagatgaacgacgtgtacggccccatgagccagatcctggagaccctgaacaagtgcccccacttcaagagacagagaagcctgtacagagagatcctgttcctgagcctggtggccctgggcagagagaacatcgacatcgacgccttcgacaaggagtacaagatggcctacgacagactgacccccagccaggtgaagagcacccacaactgcgacagaccccccagcaccggcgtgatggagtgcagaaagaccttcggcgagccctacctgtag

SEQ ID NO: 7962 - DNA, 102 bp, Artificial Sequence
  Description of Artificial Sequence: Synthetic coding sequence
atcatcaagtacctgctgctgtacagcttcctgtgcgtgctgatcaagtgccaggacagcttcaagatctactgcttcccctgctaccccttctacaactag

SEQ ID NO: 7963 - DNA, 990 bp, Artificial Sequence
  Description of Artificial Sequence: Synthetic coding sequence
atgggcgccaccggcgacgccgagcagcccagaggccccagcggcgccgagagaggcggcctggagctgggcgacgccggcgccgccggccagctggtgctgaccaacccctggaacatcatgatcaagcacagacaggtgcagagaagaggcagaagaagccagatgaccaccagcttcaccgaccccgccatcagcatggacctgctgagagccgtgctgcagcccagcatcaacgaggagatccagaccgtgttcaacaagtacatgaagttcttccagaaggccgccctgaacgtgagagacaacgtgggcgaggaggtggacgccgagcagctgatccaggaggcctgcagaagctgcctggagcaggccaagctgctgttcagcgacggcgagaaggtgatccccagactgacccacgagctgcccggcatcaagagaggcagacaggccgaggaggagtgcgcccacagaggcagccccctgcccaagaagagaaagggcagaccccccggccacatcctgagcagcgacagagccgccgccggcatggtgtggaagcccaagagctgcgagcccatcagaagagagggccccaagtgggaccccgccagactgaacgagagcaccaccttcgtgctgggcagcagagccaacaaggccctgggcatgggcggcaccagaggcagaatctacatcaagcacccccacctgttcaagtacgccgccgacccccaggacaagcactggctggccgagcagcaccacatgagagccaccggcggcaagatggcctacctgctgatcgaggaggacatcagagacctggccgccagcgacgactacagaggctgcctggacctgaagctggaggagctgaagagcttcgtgctgcccagctggatggtggagaagatgagaaagtacatggagaccctgagaaccgagaacgagcacagagccgtggaggcccccccccagacctag

SEQ ID NO: 7964 - DNA, 2271 bp, Artificial Sequence
  Description of Artificial Sequence: Synthetic coding sequence
atggtggtgaccagaagcgccagagccaaggccagcatccaggccgccagcgccgagagcagcggccagaagagcttcgccgccaacggcatccaggcccaccccgagagcagcaccggcagcgacgccagaaccaccgccgagagccagaccaccggcaagcagagcctgatccccagaacccccaaggccagaaagagaaagagcagaaccaccggcagcctgcccaagggcaccgagcccagcaccgacggcgagaccagcgaggccgagagcaactacagcgtgagcgagcaccacgacaccatcctgagagtgaccagaagaagacagatcctgatcgcctgcagccccgtgagcagcgtgagaaagaagcccaaggtgacccccaccaaggagagctacaccgaggagatcgtgagcgaggccgagagccacgtgagcggcatcagcagaatcgtgctgcccaccgagaagaccaccggcgccagaagaagcaaggccaagagcctgaccgaccccagccaggagagccacaccgaggccatcagcgacgccgagaccagcagcagcgacatcagcttcagcggcatcgccaccagaagaaccagaagcatgcagagaaagctgaaggcccagaccgagaagaaggacagcaagatcgtgcccggcaacgagaagcagatcgtgggcacccccgtgaacagcgaggacagcgacaccagacagaccagccacctgcaggccagaagcctgagcgagatcaacaagcccaacttctacaacaacgacttcgacgacgacttcagccacagaagcagcgagaacatcctgaccgtgcacgagcaggccaacgtggagagcctgaaggagaccaagcagaactgcaaggacctggacgaggacgccaacggcatcaccgacgagggcaaggagatcaacgagaagagcagccagctgaagaacctgagcgagctgcaggacaccagcctgcagcagctggtgagccagagacacagcaccccccagaacaagaacgccgtgagcgtgcacagcaacctgaacagcgaggccgtgatgaagagcctgacccagaccttcgccaccgtggaggtgggcagatggaacaacaacaagaagagccccatcaaggccagcgacctgaccaagttcggcgactgcggcggcagcgacgacgaggaggagagcaccgtgatcagcgtgagcgaggacatgaacagcgagggcaacgtggacttcgagtgcgacaccaagctgtacaccagcgcccccaacaccagccagggcaaggacaacagcgtgctgctggtgctgagcagcgacgagagccagcagagcgagaacagcgagaacgaggaggacaccctgtgcttcgtggagaacagcggccagagagagagcctgagcggcgacaccggcagcctgagctgcgacaacgccctgttcgtgatcgacaccacccccggcatgagcgccgacaagaacttctacctggaggaggaggacaaggccagcgaggtggccatcgaggaggagaaggaggaggaggaggacgagaagagcgaggaggacagcagcgaccacgacgagaacgaggacgagttcagcgacgaggaggacttcctgaacagcaccaaggccaagctgctgaagctgaccagcagcagcatcgaccccggcctgagcatcaagcagctgggcggcctgtacatcaacttcaacgccgacaagctgcagagcaacaagagaaccctgacccagatcaaggagaagaagaagaacgagctgctgcagaaggccgtgatcacccccgacttcgagaagaaccactgcgtgcccccctacagcgagagcaagtaccagctgcagaagaagagaagaaaggagagacagaagaccgccggcgacggctggttcggcatgaaggcccccgagatgaccaacgagctgaagaacgacctgaaggccctgaagatgagagccagcatggaccccaagagattctacaagaagaacgacagagacggcttccccaagtacttccagatcggcaccatcgtggacaaccccgccgacttctaccacagcagaatccccaagaagcagagaaagagaaccatcgtggaggagctgctggccgacagcgagttcagaagatacaacagaagaaagtacagcgagatcatggccgagaaggccgccaacgccgccggcaagaagttcagaaagaagaagaagttcagaaactag

SEQ ID NO: 7965 - DNA, 1020 bp, Artificial Sequence
  Description of Artificial Sequence: Synthetic coding sequence
atgctgcccagcgccgtggccgcccacgccggcgcctactgggacgtggtggccagcagcgccctgctgaacctgcccgccgcccccggcttcggcaacctgggcaagagcttcctgatcgagaacctgctgagagtgggcggcgcccccacccccagactgcagccccccgccccccacgaccccgccaccgccctggccaccgccggcgcccagctgagacccctgcccgccagccccgtgcccctgaagctgtgccccgccgccgagcaggtgagccccgccggcgccccctacggcaccagatgggccttccaggtgctgagccccagcgccgacagcgccagactgcccggcagagcccccggcgacagagactgcaccttccagcccagcgcccccgcccccagcaagcccttcctgctgagcaccccccccttctacagcgcctgctgcggcggcagctgcagaagacccgccagcagcaccgccttccccagagaggagagcatgctgcccctgctgacccaggacagcaacagcaaggccagaagaggcatcctgagaagagccgtgttcagcgaggaccagagaaaggccctggagaagatgttccagaagcagaagtacatcagcaagaccgacagaaagaagctggccatcaacctgggcctgaaggagagccaggtgaagatctggttccagaacagaagaatgaagtggagaaacagcaaggagaaggaggtgctgagcaacagatgcatccaggaggtgggcctgcaggaggaccccctgagcagaagcgccctgggcttccccagcccctgccccagcatctgggacgtgccccagcagcacagcagccccagatggagagagaacagccccgagcccagcgagagactgatccaggagagcagcggcgcccccccccccgaggccaacagcctgcagggcgccctgtacctgtgcagcgaggaggaggccggcagcaagggcgtgctgaccggcgccgtgtag

SEQ ID NO: 7966 - DNA, 1134 bp, Artificial Sequence
  Description of Artificial Sequence: Synthetic coding sequence
atgcagcactacggcgtgaacggctacagcctgcacgccatgaacagcctgagcgccatgtacaacctgcaccagcaggccgcccagcaggcccagcacgcccccgactacagacccagcgtgcacgccctgaccctggccgagagactggccgacatcatcctggaggccagatacggcagccagcacagaaagcagagaagaagcagaaccgccttcaccgcccagcagctggaggccctggagaagaccttccagaagacccactaccccgacgtggtgatgagagagagactggccatgtgcaccaacctgcccgaggccagagtgcaggtgtggttcaagaacagaagagccaagttcagaaagaagcagagaagcctgcagaaggagcagctgcagaagcagaaggaggccgagggcagccacggcgagggcaaggccgaggcccccacccccgacacccagctggacaccgagcagccccccagactgcccggcagcgacccccccgccgagctgcacctgagcctgagcgagcagagcgccagcgagagcgcccccgaggaccagcccgacagagaggaggaccccagagccggcgccgaggaccccaaggccgagaagagccccggcgccgacagcaagggcctgggctgcaagagaggcagccccaaggccgacagccccggcagcctgaccatcacccccgtggcccccggcggcggcctgctgggccccagccacagctacagcagcagccccctgagcctgttcagactgcaggagcagttcagacagcacatggccgccaccaacaacctggtgcactacagcagcttcgaggtgggcggccccgcccccgccgccgccgccgccgccgccgccgtgccctacctgggcgtgaacatggcccccctgggcagcctgcactgccagagctactaccagagcctgagcgccgccgccgccgcccaccagggcgtgtggggcagccccctgctgcccgccccccccgccggcctggcccccgccagcgccaccctgaacagcaagaccaccagcatcgagaacctgagactgagagccaagcagcacgccgccagcctgggcctggacaccctgcccaactag

SEQ ID NO: 7967 - DNA, 1149 bp, Artificial Sequence
  Description of Artificial Sequence: Synthetic coding sequence
atgcagcactacggcgtgaacggctacagcctgcacgccatgaacagcctgagcgccatgtacaacctgcaccagcaggccgcccagcaggcccagcacgcccccgactacagacccagcgtgcacgccctgaccctggccgagagactggccggctgcaccttccaggacatcatcctggaggccagatacggcagccagcacagaaagcagagaagaagcagaaccgccttcaccgcccagcagctggaggccctggagaagaccttccagaagacccactaccccgacgtggtgatgagagagagactggccatgtgcaccaacctgcccgaggccagagtgcaggtgtggttcaagaacagaagagccaagttcagaaagaagcagagaagcctgcagaaggagcagctgcagaagcagaaggaggccgagggcagccacggcgagggcaaggccgaggcccccacccccgacacccagctggacaccgagcagccccccagactgcccggcagcgacccccccgccgagctgcacctgagcctgagcgagcagagcgccagcgagagcgcccccgaggaccagcccgacagagaggaggaccccagagccggcgccgaggaccccaaggccgagaagagccccggcgccgacagcaagggcctgggctgcaagagaggcagccccaaggccgacagccccggcagcctgaccatcacccccgtggcccccggcggcggcctgctgggccccagccacagctacagcagcagccccctgagcctgttcagactgcaggagcagttcagacagcacatggccgccaccaacaacctggtgcactacagcagcttcgaggtgggcggccccgcccccgccgccgccgccgccgccgccgccgtgccctacctgggcgtgaacatggcccccctgggcagcctgcactgccagagctactaccagagcctgagcgccgccgccgccgcccaccagggcgtgtggggcagccccctgctgcccgccccccccgccggcctggcccccgccagcgccaccctgaacagcaagaccaccagcatcgagaacctgagactgagagccaagcagcacgccgccagcctgggcctggacaccctgcccaactag

SEQ ID NO: 7968 - DNA, 1431 bp, Artificial Sequence
  Description of Artificial Sequence: Synthetic coding sequence
atggagacccccggcgccagcgccagcagcctgctgctgcccgccgccagcagaccccccagaaagagagaggccggcgaggccggcgccgccaccagcaagcagagagtgctggacgaggaggagtacatcgagggcctgcagaccgtgatccagagagacttcttccccgacgtggagaagctgcaggcccagaaggagtacctggaggccgaggagaacggcgacctggagagaatgagacagatcgccatcaagttcggcagcgccctgggcaagatgagcagagagcccccccccccctacgtgacccccgccaccttcgagacccccgaggtgcacgccggcaccggcgtggtgggcaacaagcccagacccagaggcagaggcctggaggacggcgaggccggcgaggaggaggagaaggagcccctgcccagcctggacgtgttcctgagcagatacaccagcgaggacaacgccagcttccaggagatcatggaggtggccaaggagagaagcagagccagacacgcctggctgtaccaggccgaggaggagttcgagaagagacagaaggacaacctggagctgcccagcgccgagcaccaggccatcgagagcagccaggccagcgtggagacctggaagtacaaggccaagaacagcctgatgtactaccccgagggcgtgcccgacgaggagcagctgttcaagaagcccagacaggtggtgcacaagaacaccagattcctgagagaccccttcagccaggccctgagcagatgccagctgcagcaggccgccgccctgaacgcccagcacaagcagggcaaggtgggccccgacggcaaggagctgatcccccaggagagccccagagtgggcggcttcggcttcgtggccacccccagccccgcccccggcgtgaacgagagccccatgatgacctggggcgaggtggagaacacccccctgagagtggagggcagcgagaccccctacgtggacagaacccccggccccgccttcaagatcctggagcccggcagaagagagagactgggcctgaagatggccaacgaggccgccgccaagaacagagccaagaagcaggaggccctgagaagagtgaccgagaacctggccagcctgacccccaagggcctgagccccgccatgagccccgccctgcagagactggtgagcagaaccgccagcaagtacaccgacagagccctgagagccagctacacccccagccccgccagaagcacccacctgaagacccccgccagcggcctgcagacccccaccagcacccccgcccccggcagcgccaccagaacccccctgacccaggaccccgccagcatcaccgacaacctgctgcagctgcccgccagaagaaaggccagcgacttcttctag

SEQ ID NO: 7969 - DNA, 747 bp, Artificial Sequence
  Description of Artificial Sequence: Synthetic coding sequence
tgatgcagcacctggagcttcctggcccccctgccccagcagttccacctgaagatcctgttcctgcccctgacccccctgagactgctgctgctgagcgcccaggtgctgatcgtggtgcccttcagagaggccgccctgagagtggtgcagctgttcatcagcctgctggagggcgacagcaagaagaagatcatcgtgagcaacaagaagagattccagggcgagtacggcagcgaccccgaggagagaccccccaacctgaagagacccgaggactacgaggccgtgttcgtgggcaacatcgacgaccacttcagaatcggcgtggccatcctgcagagaagcatcagactgtacgcccccttctacagcagcgacatcctgatcgccagccccctgggcctgagaaccatcatcggcggcgagggcgagaagaagagagacttcgacttcctgagcagcatcgagctgctgatcatcgaccaggccgacatctacctgatgcagaactgggagcacgtgctgcacctgatgaaccacatgaacctgctgcccctggacagccacggcgtggacttcagcagagtgagaatgtggagcctgaacaactggagcaagtactacagacagaccctgctgttcggcgccctgcaggacgcccagatcaacagcgtgttcaacaagtactgcgtgaacatgcagggccaggtgggcagcagactggtgagcagcgtgagcagctag

SEQ ID NO: 7970 - DNA, 2271 bp, Artificial Sequence
  Description of Artificial Sequence: Synthetic coding sequence
atgggcaagagaggcagcagaagccagagccagctgctgaacaccctgaccaagaagcagaagaagcacctgagagacttcggcgaggagcaccccttctacgacagagtgagcagaaaggaggccaagccccagatctgccagctgagcgagagcagcgacagcagcgacagcgagagcgacagcgagagcgagccccagcaggtgagcggctaccacagactgctggccaccctgaagaacgtgagcgaggaggaggaggaggacgaggaggaggaggaggaggaggacagcatcgtggacgacgccgagatgaacgacgaggacggcggcagcgacgtgagcgtggaggaggagatggccgccgagagcaccgagagccccgagaacgtggccctgagcgccgaccccgagggcaaggaggacggcgaggagccccccggcaccagccagaccagccccgaggagttcaccgacgccaagcacgagagcctgttcagcctggagaccaacttcctggaggaggagagcggcgacaacagcagcctgaaggccagccaggaccccttcctgcagcacgtgaacaaggagctgaaggagaaggccatccaggccgtggccaccaaccccaagaccacccacgagctgaagtggcccatcctgggccagctgttcttcagcagcaagttccagaagctggagaccttcaagccccccaaggacatcgacctgaagagcctgcacctgcagaagcccctggagagcacctggaccaagaccaacagccagttcctgagcggcccccagaagagcagcagccccttcacccccctgcagaaggagctgttcctgatcatgaacagctacagagacctgttctaccccgagagaaccgccctgaagaacggcgaggagatcagacacgtgtactgcctgcacgtgatcaaccacatcctgaaggccaacgcccaggtgctgggcaacaacagcagaagaagaagccagaagttcggcgtgggcgacgacgacgacttcagagaccagggcctgaccagacccaaggtgctgatcgtggtgcccttcagagaggccgccctgagagtggtgcagctgttcatcagcctgctggagggcgacagcaagaagaagatcatcgtgagcaacaagaagagattccagggcgagtacggcagcgaccccgaggagagaccccccaacctgaagagacccgaggactacgaggccgtgttcgtgggcaacatcgacgaccacttcagaatcggcgtggccatcctgcagagaagcatcagactgtacgcccccttctacagcagcgacatcctgatcgccagccccctgggcctgagaaccatcatcggcggcgagggcgagaagaagagagacttcgacttcctgagcagcatcgagctgctgatcatcgaccaggccgacatctacctgatgcagaactgggagcacgtgctgcacctgatgaaccacatgaacctgctgcccctggacagccacggcgtggacttcagcagagtgagaatgtggagcctgaacaactggagcaagtactacagacagaccctgctgttcggcgccctgcaggacgcccagatcaacagcgtgttcaacaagtactgcgtgaacatgcagggccaggtggccgtgagaaacgtgcccatgaccggcagcatcagccacgtgctggtgcagctgccccacgtgttccagagaatggaggccgagaacctggccagcgtgatcgacgccagattcaacttcttcgtgaacaagatcctgccccagtacagagacgccgtgatgagccacaccctgatctacatccccagctacttcgacttcgtgagactgagaaactacttcaagaaggaggagctgaacttcacccacatctgcgagtacacccagaagagcggcgtgagcagagccagacacttcttcctgcagggcgagaagcagttcctgctgttcaccgagagattccacttctacaagagatacaccatcaagggcatcagaaacctgatcttctacgagctgcccacctacccccacttctacagcgagatctgcaacatgctgagagccaccaacagaggcgaggaggccacctggacctgcaccgtgctgtacagcaagtacgacgcccagagactggccgccgtggtgggcgtggagagagccgcccagatgctgcagagcaacaagaacgtgcacctgttcatcaccggcgagaagtag

SEQ ID NO: 7971 - DNA, 942 bp, Artificial Sequence
  Description of Artificial Sequence: Synthetic coding sequence
atgcccaaggtgaagagcggcgccatcggcagaagaagaggcagacaggagcagagaagagagctgaagagcgccggcggcctgatgttcaacaccggcatcggccagcacatcctgaagaaccccctgatcatcaacagcatcatcgacaaggccgccctgagacccaccgacgtggtgctggaggtgggccccggcaccggcaacatgaccgtgaagctgctggagaaggccaagaaggtggtggcctgcgagctggaccccagactggtggccgagctgcacaagagagtgcagggcacccccgtggccagcaagctgcaggtgctggtgggcgacgtgctgaagaccgacctgcccttcttcgacacctgcgtggccaacctgccctaccagatcagcagccccttcgtgttcaagctgctgctgcacagacccttcttcagatgcgccatcctgatgttccagagagagttcgccctgagactggtggccaagcccggcgacaagctgtactgcagactgagcatcaacacccagctgctggccagagtggaccacctgatgaaggtgggcaagaacaacttcagacccccccccaaggtggagagcagcgtggtgagaatcgagcccaagaacccccccccccccatcaacttccaggagtgggacggcctggtgagaatcaccttcgtgagaaagaacaagaccctgagcgccgccttcaagagcagcgccgtgcagcagctgctggagaagaactacagaatccactgcagcgtgcacaacatcatcatccccgaggacttcagcatcgccgacaagatccagcagatcctgaccagcaccggcttcagcgacaagagagccagaagcatggacatcgacgacttcatcagactgctgcacggcttcaacgccgagggcatccacttcagctag

SEQ ID NO: 7972 - DNA, 4719 bp, Artificial Sequence
  Description of Artificial Sequence: Synthetic coding sequence
atggccgacagaggctgccccctggaggccgcccccctgcccgccgaggtgagagagagcctggccgagctggagctggagctgagcgagggcgacatcacccagaagggctacgagaagaagagagccaagctgctggccagatacatccccctgatccagggcatcgaccccagcctgcaggccgagaacagaatccccggccccagccagaccaccgccgccgcccccaagcagcagaagagcagacccaccgccagcagagacgagagattcagaagcgacgtgcacaccgaggccgtgcaggccgccctggccaagtacaaggagagaaagatgcccatgcccagcaagagaagaagcgtgctggtgcacagcagcgtggagacctacaccccccccgacaccagcagcgccagcgaggacgagggcagcctgagaagacccggcagactgaccagcacccccctgcagagccacagcagcgtggagccctggctggacagagtgatccagggcagcagcaccagcagcagcgccagcagcaccagcagccaccccggcggcagacccaccaccgcccccagcgccgccgccacccccggcgccgccgccaccaccgccctggccggcctggaggcccacacccacatcgccgacctgcacagcgccccccccgacgtgaccaccggcctggtggagcacagctacttcgagagaccccaggtggccagcgtgagaagcgtgcccagaggctgcagcggcagcatgctggagaccgccgacggcgtgcccgtgaacagcagagtgagcagcaagatccagcagctgctgaacaccctgaagagacccaagagaccccccctgaaggagttcttcgtggacgacttcgaggagctgctggaggtgcagcagcccgaccccaaccagcccaagcccgagggcagcgagaccagcgtgctgagaggcgagcccctgaccgccggcgtgcccagaccccccagcctgctggccaccctgcagagatggggcaccacccagcccaagagcccctgcctgaccgccctggacaccaccggcaaggccgtgtacaccctgacctacggcaagctgtggagcagaagcctgaagctggcctacaccctgctgaacaagctgaccagcaagaacgagcccctgctgaagcccggcgacagagtggccctggtgttccccaacagcgaccccgtgatgttcatggtggccttctacggctgcctgctggccgagctggtgcccgtgcccatcgaggtgcccctgaccagaaaggacgccggcagccagcaggtgggcttcctgctgggcagctgcggcgtgttcctggccctgaccaccgacgcctgccagaagggcctgcccaaggcccagaccggcgaggtggccgccttcaagggctggccccccctgagctggctggtgatcgacggcaagcacctggccaagccccccaaggactggcaccccctggcccaggacaccggcaccggcaccgcctacatcgagtacaagaccagcaaggagggcagcaccgtgggcgtgaccgtgagccacgccagcctgctggcccagtgcagagccctgacccaggcctgcggctacagcgaggccgagaccctgaccaacgtgctggacttcaagagagacgccggcctgtggcacggcgtgctgaccagcgtgatgaacagaatgcacgtggtgagcgtgccctacgccctgatgaaggccaaccccctgagctggatccagaaggtgtgcttctacaaggccagagccgccctggtgaagagcagagacatgcactggagcctgctggcccagagaggccagagagacgtgagcctgagcagcctgagaatgctgatcgtggccgacggcgccaacccctggagcatcagcagctgcgacgccttcctgaacgtgttccagagcagaggcctgagacccgaggtgatctgcccctgcgccagcagccccgaggccctgaccgtggccatcagaagaccccccgacctgggcggccccccccccagaaaggccgtgctgagcatgaacggcctgagctacggcgtgatcagagtggacaccgaggagaagctgagcgtgctgaccgtgcaggacgtgggccaggtgatgcccggcgccaacgtgtgcgtggtgaagctggagggcaccccctacctgtgcaagaccgacgaggtgggcgagatctgcgtgagcagcagcgccaccggcaccgcctactacggcctgctgggcatcaccaagaacgtgttcgaggccgtgcccgtgaccaccggcggcgcccccatcttcgacagacccttcaccagaaccggcctgctgggcttcatcggccccgacaacctggtgttcatcgtgggcaagctggacggcctgatggtgaccggcgtgagaagacacaacgccgacgacgtggtggccaccgccctggccgtggagcccatgaagttcgtgtacagaggcagaatcgccgtgttcagcgtgaccgtgctgcacgacgacagaatcgtgctggtggccgagcagagacccgacgccagcgaggaggacagcttccagtggatgagcagagtgctgcaggccatcgacagcatccaccaggtgggcgtgtactgcctggccctggtgcccgccaacaccctgcccaaggcccccctgggcggcatccacatcagcgagaccaagcagagattcctggagggcaccctgcacccctgcaacgtgctgatgtgcccccacacctgcgtgaccaacctgcccaagcccagacagaagcagcccgaggtgggccccgccagcatgatcgtgggcaacctggtggccggcaagagaatcgcccaggccagcggcagagagctggcccacctggaggacagcgaccaggccagaaagttcctgttcctggccgacgtgctgcagtggagagcccacaccacccccgaccaccccctgttcctgctgctgaacgccaagggcaccgtgaccagcaccgccacctgcgtgcagctgcacaagagagccgagagagtggccgccgccctgatggagaagggcagactgagcgtgggcgaccacgtggccctggtgtacccccccggcgtggacctgatcgccgccttctacggctgcctgtactgcggctgcgtgcccgtgaccgtgagacccccccacccccagaacctgggcaccaccctgcccaccgtgaagatgatcgtggaggtgagcaagagcgcctgcgtgctgaccacccaggccgtgaccagactgctgagaagcaaggaggccgccgccgccgtggacatcagaacctggcccaccatcctggacaccgacgacatccccaagaagaagatcgccagcgtgttcagaccccccagccccgacgtgctggcctacctggacttcagcgtgagcaccaccggcatcctggccggcgtgaagatgagccacgccgccaccagcgccctgtgcagaagcatcaagctgcagtgcgagctgtaccccagcagacagatcgccatctgcctggacccctactgcggcctgggcttcgccctgtggtgcctgtgcagcgtgtacagcggccaccagagcgtgctggtgccccccctggagctggagagcaacgtgagcctgtggctgagcgccgtgagccagtacaaggccagagtgaccttctgcagctacagcgtgatggagatgtgcaccaagggcctgggcgcccagaccggcgtgctgagaatgaagggcgtgaacctgagctgcgtgagaacctgcatggtggtggccgaggagagacccagaatcgccctgacccagagcttcagcaagctgttcaaggacctgggcctgcccgccagagccgtgagcaccaccttcggctgcagagtgaacgtggccatctgcctgcagggcaccgccggccccgaccccaccaccgtgtacgtggacatgagagccctgagacacgacagagtgagactggtggagagaggcagcccccacagcctgcccctgatggagagcggcaagatcctgcccggcgtgaaggtgatcatcgcccacaccgagaccaagggccccctgggcgacagccacctgggcgagatctgggtgagcagcccccacaacgccaccggctactacaccgtgtacggcgaggaggccctgcacgccgaccacttcagcgccagactgagcttcggcgacacccagaccatctgggccagaaccggctacctgggcttcctgagaagaaccgagctgaccgacgccagcggcggcagacacgacgccctgtacgtggtgggcagcctggacgagaccctggagctgagaggcatgagataccaccccatcgacatcgagaccagcgtgatcagagcccacagaagcatcgccgagtgcgccgtgttcacctggaccaacctgctggtggtggtggtggagctggacggcctggagcaggacgccctggacctggtggccctggtgaccaacgtggtgctggaggagcactacctggtggtgggcgtggtggtgatcgtggaccccggcgtgatccccatcaacagcagaggcgagaagcagagaatgcacctgagagacggcttcctggccgaccagctggaccccatctacgtggcctacaacatgtag

SEQ ID NO: 7973 - DNA, 2394 bp, Artificial Sequence
  Description of Artificial Sequence: Synthetic coding sequence
atggccgacagaggctgccccctggaggccgcccccctgcccgccgaggtgagagagagcctggccgagctggagctggagctgagcgagggcgacatcacccagaagggctacgagaagaagagagccaagctgctggccagatacatccccctgatccagggcatcgaccccagcctgcaggccgagaacagaatccccggccccagccagaccaccgccgccgcccccaagcagcagaagagcagacccaccgccagcagagacgagagattcagaagcgacgtgcacaccgaggccgtgcaggccgccctggccaagtacaaggagagaaagatgcccatgcccagcaagagaagaagcgtgctggtgcacagcagcgtggagacctacaccccccccgacaccagcagcgccagcgaggacgagggcagcctgagaagacccggcagactgaccagcacccccctgcagagccacagcagcgtggagccctggctggacagagtgatccagggcagcagcaccagcagcagcgccagcagcaccagcagccaccccggcggcagacccaccaccgcccccagcgccgccgccacccccggcgccgccgccaccaccgccctggccggcctggaggcccacacccacatcggcgtgcccgtgaacagcagagtgagcagcaagatccagcagctgctgaacaccctgaagagacccaagagaccccccctgaaggagttcttcgtggacgacttcgaggagctgctggaggtgcagcagcccgaccccaaccagcccaagcccgagggcagcgagaccagcgtgctgagaggcgagcccctgaccgccggcgtgcccagaccccccagcctgctggccaccctgcagagatggggcaccacccagcccaagagcccctgcctgaccgccctggacaccaccggcaaggccgtgtacaccctgacctacggcaagctgtggagcagaagcctgaagctggcctacaccctgctgaacaagctgaccagcaagaacgagcccctgctgaagcccggcgacagagtggccctggtgttccccaacagcgaccccgtgatgttcatggtggccttctacggctgcctgctggccgagctggtgcccgtgcccatcgaggtgcccctgaccagaaaggacgccggcagccagcaggtgggcttcctgctgggcagctgcggcgtgttcctggccctgaccaccgacgcctgccagaagggcctgcccaaggcccagaccggcgaggtggccgccttcaagggctggccccccctgagctggctggtgatcgacggcaagcacctggccaagccccccaaggactggcaccccctggcccaggacaccggcaccggcaccgcctacatcgagtacaagaccagcaaggagggcagcaccgtgggcgtgaccgtgagccacgccagcctgctggcccagtgcagagccctgacccaggcctgcggctacagcgaggccgagaccctgaccaacgtgctggacttcaagagagacgccggcctgtggcacggcgtgctgaccagcgtgatgaacagaatgcacgtggtgagcgtgccctacgccctgatgaaggccaaccccctgagctggatccagaaggtgtgcttctacaaggccagagccgccctggtgaagagcagagacatgcactggagcctgctggcccagagaggccagagagacgtgagcctgagcagcctgagaatgctgatcgtggccgacggcgccaacccctggagcatcagcagctgcgacgccttcctgaacgtgttccagagcagaggcctgagacccgaggtgatctgcccctgcgccagcagccccgaggccctgaccgtggccatcagaagaccccccgacctgggcggccccccccccagaaaggccgtgctgagcatgaacggcctgagctacggcgtgatcagagtggacaccgaggagaagctgagcgtgctgaccgtgcaggacgtgggccaggtgatgcccggcgccaacgtgtgcgtggtgaagctggagggcaccccctacctgtgcaagaccgacgaggtgggcgagatctgcgtgagcagcagcgccaccggcaccgcctactacggcctgctgggcatcaccaagaacgtgttcgaggccgtgcccgtgaccaccggcggcgcccccatcttcgacagacccttcaccagaaccggcctgctgggcttcatcggccccgacaacctggtgttcatcgtgggcaagctggacggcctgatggtgaccggcgtgagaagacacaacgccgacgacgtggtggccaccgccctggccgtggagcccatgaagttcgtgtacagaggctag

SEQ ID NO: 7974 - DNA, 4704 bp, Artificial Sequence
  Description of Artificial Sequence: Synthetic coding sequence
atggccgacagaggctgccccctggaggccgcccccctgcccgccgaggtgagagagagcctggccgagctggagctggagctgagcgagggcgacatcacccagaagggctacgagaagaagagagccaagctgctggccagatacatccccctgatccagggcatcgaccccagcctgcaggccgagaacagaatccccggccccagccagaccaccgccgccgcccccaagcagcagaagagcagacccaccgccagcagagacgagagattcagaagcgacgtgcacaccgaggccgtgcaggccgccctggccaagtacaaggagagaaagatgcccatgcccagcaagagaagaagcgtgctggtgcacagcagcgtggagacctacaccccccccgacaccagcagcgccagcgaggacgagggcagcctgagaagacccggcagactgaccagcacccccctgcagagccacagcagcgtggagccctggctggacagagtgatccagggcagcagcaccagcagcagcgccagcagcaccagcagccaccccggcggcagacccaccaccgcccccagcgccgccgccacccccggcgccgccgccaccaccgccctggccggcctggaggcccacacccacatcgacctgcacagcgccccccccgacgtgaccaccggcctggtggagcacagctacttcgagagaccccaggtggccagcgtgagaagcgtgcccagaggctgcagcggcagcatgctggagaccgccgacggcgtgcccgtgaacagcagagtgagcagcaagatccagcagctgctgaacaccctgaagagacccaagagaccccccctgaaggagttcttcgtggacgacttcgaggagctgctggaggaccccaaccagcccaagcccgagggcagcgagaccagcgtgctgagaggcgagcccctgaccgccggcgtgcccagaccccccagcctgctggccaccctgcagagatggggcaccacccagcccaagagcccctgcctgaccgccctggacaccaccggcaaggccgtgtacaccctgacctacggcaagctgtggagcagaagcctgaagctggcctacaccctgctgaacaagctgaccagcaagaacgagcccctgctgaagcccggcgacagagtggccctggtgttccccaacagcgaccccgtgatgttcatggtggccttctacggctgcctgctggccgagctggtgcccgtgcccatcgaggtgcccctgaccagaaaggacgccggcagccagcaggtgggcttcctgctgggcagctgcggcgtgttcctggccctgaccaccgacgcctgccagaagggcctgcccaaggcccagaccggcgaggtggccgccttcaagggctggccccccctgagctggctggtgatcgacggcaagcacctggccaagccccccaaggactggcaccccctggcccaggacaccggcaccggcaccgcctacatcgagtacaagaccagcaaggagggcagcaccgtgggcgtgaccgtgagccacgccagcctgctggcccagtgcagagccctgacccaggcctgcggctacagcgaggccgagaccctgaccaacgtgctggacttcaagagagacgccggcctgtggcacggcgtgctgaccagcgtgatgaacagaatgcacgtggtgagcgtgccctacgccctgatgaaggccaaccccctgagctggatccagaaggtgtgcttctacaaggccagagccgccctggtgaagagcagagacatgcactggagcctgctggcccagagaggccagagagacgtgagcctgagcagcctgagaatgctgatcgtggccgacggcgccaacccctggagcatcagcagctgcgacgccttcctgaacgtgttccagagcagaggcctgagacccgaggtgatctgcccctgcgccagcagccccgaggccctgaccgtggccatcagaagaccccccgacctgggcggccccccccccagaaaggccgtgctgagcatgaacggcctgagctacggcgtgatcagagtggacaccgaggagaagctgagcgtgctgaccgtgcaggacgtgggccaggtgatgcccggcgccaacgtgtgcgtggtgaagctggagggcaccccctacctgtgcaagaccgacgaggtgggcgagatctgcgtgagcagcagcgccaccggcaccgcctactacggcctgctgggcatcaccaagaacgtgttcgaggccgtgcccgtgaccaccggcggcgcccccatcttcgacagacccttcaccagaaccggcctgctgggcttcatcggccccgacaacctggtgttcatcgtgggcaagctggacggcctgatggtgaccggcgtgagaagacacaacgccgacgacgtggtggccaccgccctggccgtggagcccatgaagttcgtgtacagaggcagaatcgccgtgttcagcgtgaccgtgctgcacgacgacagaatcgtgctggtggccgagcagagacccgacgccagcgaggaggacagcttccagtggatgagcagagtgctgcaggccatcgacagcatccaccaggtgggcgtgtactgcctggccctggtgcccgccaacaccctgcccaaggcccccctgggcggcatccacatcagcgagaccaagcagagattcctggagggcaccctgcacccctgcaacgtgctgatgtgcccccacacctgcgtgaccaacctgcccaagcccagacagaagcagcccgaggtgggccccgccagcatgatcgtgggcaacctggtggccggcaagagaatcgcccaggccagcggcagagagctggcccacctggaggacagcgaccaggccagaaagttcctgttcctggccgacgtgctgcagtggagagcccacaccacccccgaccaccccctgttcctgctgctgaacgccaagggcaccgtgaccagcaccgccacctgcgtgcagctgcacaagagagccgagagagtggccgccgccctgatggagaagggcagactgagcgtgggcgaccacgtggccctggtgtacccccccggcgtggacctgatcgccgccttctacggctgcctgtactgcggctgcgtgcccgtgaccgtgagacccccccacccccagaacctgggcaccaccctgcccaccgtgaagatgatcgtggaggtgagcaagagcgcctgcgtgctgaccacccaggccgtgaccagactgctgagaagcaaggaggccgccgccgccgtggacatcagaacctggcccaccatcctggacaccgacgacatccccaagaagaagatcgccagcgtgttcagaccccccagccccgacgtgctggcctacctggacttcagcgtgagcaccaccggcatcctggccggcgtgaagatgagccacgccgccaccagcgccctgtgcagaagcatcaagctgcagtgcgagctgtaccccagcagacagatcgccatctgcctggacccctactgcggcctgggcttcgccctgtggtgcctgtgcagcgtgtacagcggccaccagagcgtgctggtgccccccctggagctggagagcaacgtgagcctgtggctgagcgccgtgagccagtacaaggccagagtgaccttctgcagctacagcgtgatggagatgtgcaccaagggcctgggcgcccagaccggcgtgctgagaatgaagggcgtgaacctgagctgcgtgagaacctgcatggtggtggccgaggagagacccagaatcgccctgacccagagcttcagcaagctgttcaaggacctgggcctgcccgccagagccgtgagcaccaccttcggctgcagagtgaacgtggccatctgcctgcagggcaccgccggccccgaccccaccaccgtgtacgtggacatgagagccctgagacacgacagagtgagactggtggagagaggcagcccccacagcctgcccctgatggagagcggcaagatcctgcccggcgtgaaggtgatcatcgcccacaccgagaccaagggccccctgggcgacagccacctgggcgagatctgggtgagcagcccccacaacgccaccggctactacaccgtgtacggcgaggaggccctgcacgccgaccacttcagcgccagactgagcttcggcgacacccagaccatctgggccagaaccggctacctgggcttcctgagaagaaccgagctgaccgacgccagcggcggcagacacgacgccctgtacgtggtgggcagcctggacgagaccctggagctgagaggcatgagataccaccccatcgacatcgagaccagcgtgatcagagcccacagaagcatcgccgagtgcgccgtgttcacctggaccaacctgctggtggtggtggtggagctggacggcctggagcaggacgccctggacctggtggccctggtgaccaacgtggtgctggaggagcactacctggtggtgggcgtggtggtgatcgtggaccccggcgtgatccccatcaacagcagaggcgagaagcagagaatgcacctgagagacggcttcctggccgaccagctggaccccatctacgtggcctacaacatgtag

SEQ ID NO: 7975 - DNA, 4716 bp, Artificial Sequence
  Description of Artificial Sequence: Synthetic coding sequence
atggccgacagaggctgccccctggaggccgcccccctgcccgccgaggtgagagagagcctggccgagctggagctggagctgagcgagggcgacatcacccagaagggctacgagaagaagagagccaagctgctggccagatacatccccctgatccagggcatcgaccccagcctgcaggccgagaacagaatccccggccccagccagaccaccgccgccgcccccaagcagcagaagagcagacccaccgccagcagagacgagagattcagaagcgacgtgcacaccgaggccgtgcaggccgccctggccaagtacaaggagagaaagatgcccatgcccagcaagagaagaagcgtgctggtgcacagcagcgtggagacctacaccccccccgacaccagcagcgccagcgaggacgagggcagcctgagaagacccggcagactgaccagcacccccctgcagagccacagcagcgtggagccctggctggacagagtgatccagggcagcagcaccagcagcagcgccagcagcaccagcagccaccccggcggcagacccaccaccgcccccagcgccgccgccacccccggcgccgccgccaccaccgccctggccggcctggaggcccacacccacatcgacctgcacagcgccccccccgacgtgaccaccggcctggtggagcacagctacttcgagagaccccaggtggccagcgtgagaagcgtgcccagaggctgcagcggcagcatgctggagaccgccgacggcgtgcccgtgaacagcagagtgagcagcaagatccagcagctgctgaacaccctgaagagacccaagagaccccccctgaaggagttcttcgtggacgacttcgaggagctgctggaggtgcagcagcccgaccccaaccagcccaagcccgagggcagcgagaccagcgtgctgagaggcgagcccctgaccgccggcgtgcccagaccccccagcctgctggccaccctgcagagatggggcaccacccagcccaagagcccctgcctgaccgccctggacaccaccggcaaggccgtgtacaccctgacctacggcaagctgtggagcagaagcctgaagctggcctacaccctgctgaacaagctgaccagcaagaacgagcccctgctgaagcccggcgacagagtggccctggtgttccccaacagcgaccccgtgatgttcatggtggccttctacggctgcctgctggccgagctggtgcccgtgcccatcgaggtgcccctgaccagaaaggacgccggcagccagcaggtgggcttcctgctgggcagctgcggcgtgttcctggccctgaccaccgacgcctgccagaagggcctgcccaaggcccagaccggcgaggtggccgccttcaagggctggccccccctgagctggctggtgatcgacggcaagcacctggccaagccccccaaggactggcaccccctggcccaggacaccggcaccggcaccgcctacatcgagtacaagaccagcaaggagggcagcaccgtgggcgtgaccgtgagccacgccagcctgctggcccagtgcagagccctgacccaggcctgcggctacagcgaggccgagaccctgaccaacgtgctggacttcaagagagacgccggcctgtggcacggcgtgctgaccagcgtgatgaacagaatgcacgtggtgagcgtgccctacgccctgatgaaggccaaccccctgagctggatccagaaggtgtgcttctacaaggccagagccgccctggtgaagagcagagacatgcactggagcctgctggcccagagaggccagagagacgtgagcctgagcagcctgagaatgctgatcgtggccgacggcgccaacccctggagcatcagcagctgcgacgccttcctgaacgtgttccagagcagaggcctgagacccgaggtgatctgcccctgcgccagcagccccgaggccctgaccgtggccatcagaagaccccccgacctgggcggccccccccccagaaaggccgtgctgagcatgaacggcctgagctacggcgtgatcagagtggacaccgaggagaagctgagcgtgctgaccgtgcaggacgtgggccaggtgatgcccggcgccaacgtgtgcgtggtgaagctggagggcaccccctacctgtgcaagaccgacgaggtgggcgagatctgcgtgagcagcagcgccaccggcaccgcctactacggcctgctgggcatcaccaagaacgtgttcgaggccgtgcccgtgaccaccggcggcgcccccatcttcgacagacccttcaccagaaccggcctgctgggcttcatcggccccgacaacctggtgttcatcgtgggcaagctggacggcctgatggtgaccggcgtgagaagacacaacgccgacgacgtggtggccaccgccctggccgtggagcccatgaagttcgtgtacagaggcagaatcgccgtgttcagcgtgaccgtgctgcacgacgacagaatcgtgctggtggccgagcagagacccgacgccagcgaggaggacagcttccagtggatgagcagagtgctgcaggccatcgacagcatccaccaggtgggcgtgtactgcctggccctggtgcccgccaacaccctgcccaaggcccccctgggcggcatccacatcagcgagaccaagcagagattcctggagggcaccctgcacccctgcaacgtgctgatgtgcccccacacctgcgtgaccaacctgcccaagcccagacagaagcagcccgaggtgggccccgccagcatgatcgtgggcaacctggtggccggcaagagaatcgcccaggccagcggcagagagctggcccacctggaggacagcgaccaggccagaaagttcctgttcctggccgacgtgctgcagtggagagcccacaccacccccgaccaccccctgttcctgctgctgaacgccaagggcaccgtgaccagcaccgccacctgcgtgcagctgcacaagagagccgagagagtggccgccgccctgatggagaagggcagactgagcgtgggcgaccacgtggccctggtgtacccccccggcgtggacctgatcgccgccttctacggctgcctgtactgcggctgcgtgcccgtgaccgtgagacccccccacccccagaacctgggcaccaccctgcccaccgtgaagatgatcgtggaggtgagcaagagcgcctgcgtgctgaccacccaggccgtgaccagactgctgagaagcaaggaggccgccgccgccgtggacatcagaacctggcccaccatcctggacaccgacgacatccccaagaagaagatcgccagcgtgttcagaccccccagccccgacgtgctggcctacctggacttcagcgtgagcaccaccggcatcctggccggcgtgaagatgagccacgccgccaccagcgccctgtgcagaagcatcaagctgcagtgcgagctgtaccccagcagacagatcgccatctgcctggacccctactgcggcctgggcttcgccctgtggtgcctgtgcagcgtgtacagcggccaccagagcgtgctggtgccccccctggagctggagagcaacgtgagcctgtggctgagcgccgtgagccagtacaaggccagagtgaccttctgcagctacagcgtgatggagatgtgcaccaagggcctgggcgcccagaccggcgtgctgagaatgaagggcgtgaacctgagctgcgtgagaacctgcatggtggtggccgaggagagacccagaatcgccctgacccagagcttcagcaagctgttcaaggacctgggcctgcccgccagagccgtgagcaccaccttcggctgcagagtgaacgtggccatctgcctgcagggcaccgccggccccgaccccaccaccgtgtacgtggacatgagagccctgagacacgacagagtgagactggtggagagaggcagcccccacagcctgcccctgatggagagcggcaagatcctgcccggcgtgaaggtgatcatcgcccacaccgagaccaagggccccctgggcgacagccacctgggcgagatctgggtgagcagcccccacaacgccaccggctactacaccgtgtacggcgaggaggccctgcacgccgaccacttcagcgccagactgagcttcggcgacacccagaccatctgggccagaaccggctacctgggcttcctgagaagaaccgagctgaccgacgccagcggcggcagacacgacgccctgtacgtggtgggcagcctggacgagaccctggagctgagaggcatgagataccaccccatcgacatcgagaccagcgtgatcagagcccacagaagcatcgccgagtgcgccgtgttcacctggaccaacctgctggtggtggtggtggagctggacggcctggagcaggacgccctggacctggtggccctggtgaccaacgtggtgctggaggagcactacctggtggtgggcgtggtggtgatcgtggaccccggcgtgatccccatcaacagcagaggcgagaagcagagaatgcacctgagagacggcttcctggccgaccagctggaccccatctacgtggcctacaacatgtag

SEQ ID NO: 7976 - DNA, 3333 bp, Artificial Sequence
  Description of Artificial Sequence: Synthetic coding sequence
atggccgacagaggctgccccctggaggccgcccccctgcccgccgaggtgagagagagcctggccgagctggagctggagctgagcgaggacgtgcacaccgaggccgtgcaggccgccctggccaagtacaaggagagaaagatgcccatgcccagcaagagaagaagcgtgctggtgcacagcagcgtggagacctacaccccccccgacaccagcagcgccagcgaggacgagggcagcctgagaagacccggcagactgaccagcacccccctgcagagccacagcagcgtggagccctggctggacagagtgatccagggcagcagcaccagcagcagcgccagcagcaccagcagccaccccggcggcagacccaccaccgcccccagcgccgccgccacccccggcgccgccgccaccaccgccctggccggcctggaggcccacacccacatcgacctgcacagcgccccccccgacgtgaccaccggcctggtggagcacagctacttcgagagaccccaggtggccagcgtgagaagcgtgcccagaggctgcagcggcagcatgctggagaccgccgacggcgtgcccgtgaacagcagagtgagcagcaagatccagcagctgctgaacaccctgaagagacccaagagaccccccctgaaggagttcttcgtggacgacttcgaggagctgctggaggtgcagcagcccgaccccaaccagcccaagcccgagggcagcgagaccagcgtgctgagaggcgagcccctgaccgccggcgtgcccagaccccccagcctgctggccaccctgcagagatggggcaccacccagcccaagagcccctgcctgaccgccctggacaccaccggcaaggccgtgtacaccctgacctacggcaagctgtggagcagaagcctgaagctggcctacaccctgctgaacaagctgaccagcaagaacgagcccctgctgaagcccggcgacagagtggccctggtgttccccaacagcgaccccgtgatgttcatggtggccttctacggctgcctgctggccgagctggtgcccgtgcccatcgaggtgcccctgaccagaaaggacgccggcagccagcaggtgggcttcctgctgggcagctgcggcgtgttcctggccctgaccaccgacgcctgccagaagggcctgcccaaggcccagaccggcgaggtggccgccttcaagggctggccccccctgagctggctggtgatcgacggcaagcacctggccaagccccccaaggactggcaccccctggcccaggacaccggcaccggcaccgcctacatcgagtacaagaccagcaaggagggcagcaccgtgggcgtgaccgtgagccacgccagcctgctggcccagtgcagagccctgacccaggcctgcggctacagcgaggccgagaccctgaccaacgtgctggacttcaagagagacgccggcctgtggcacggcgtgctgaccagcgtgatgaacagaatgcacgtggtgagcgtgccctacgccctgatgaaggccaaccccctgagctggatccagaaggtgtgcttctacaaggccagagccgccctggtgaagagcagagacatgcactggagcctgctggcccagagaggccagagagacgtgagcctgagcagcctgagaatgctgatcgtggccgacggcgccaacccctggagcatcagcagctgcgacgccttcctgaacgtgttccagagcagaggcctgagacccgaggtgatctgcccctgcgccagcagccccgaggccctgaccgtggccatcagaagaccccccgacctgggcggccccccccccagaaaggccgtgctgagcatgaacggcctgagctacggcgtgatcagagtggacaccgaggagaagctgagcgtgctgaccgtgcaggacgtgggccaggtgatgcccggcgccaacgtgtgcgtggtgaagctggagggcaccccctacctgtgcaagaccgacgaggtgggcgagatctgcgtgagcagcagcgccaccggcaccgcctactacggcctgctgggcatcaccaagaacgtgttcgaggccgtgcccgtgaccaccggcggcgcccccatcttcgacagacccttcaccagaaccggcctgctgggcttcatcggccccgacaacctggtgttcatcgtgggcaagctggacggcctgatggtgaccggcgtgagaagacacaacgccgacgacgtggtggccaccgccctggccgtggagcccatgaagttcgtgtacagaggcagaatcgccgtgttcagcgtgaccgtgctgcacgacgacagaatcgtgctggtggccgagcagagacccgacgccagcgaggaggacagcttccagtggatgagcagagtgctgcaggccatcgacagcatccaccaggtgggcgtgtactgcctggccctggtgcccgccaacaccctgcccaaggcccccctgggcggcatccacatcagcgagaccaagcagagattcctggagggcaccctgcacccctgcaacgtgctgatgtgcccccacacctgcgtgaccaacctgcccaagcccagacagaagcagcccgaggtgggccccgccagcatgatcgtgggcaacctggtggccggcaagagaatcgcccaggccagcggcagagagctggcccacctggaggacagcgaccaggccagaaagttcctgttcctggccgacgtgctgcagtggagagcccacaccacccccgaccaccccctgttcctgctgctgaacgccaagggcaccgtgaccagcaccgccacctgcgtgcagctgcacaagagagccgagagagtggccgccgccctgatggagaagggcagactgagcgtgggcgaccacgtggccctggtgtacccccccggcgtggacctgatcgccgccttctacggctgcctgtactgcggctgcgtgcccgtgaccgtgagacccccccacccccagaacctgggcaccaccctgcccaccgtgaagatgatcgtggaggtgagcaagagcgcctgcgtgctgaccacccaggccgtgaccagactgctgagaagcaaggaggccgccgccgccgtggacatcagaacctggcccaccatcctggacaccgacgacatccccaagaagaagatcgccagcgtgttcagaccccccagccccgacgtgctggcctacctggacttcagcgtgagcaccaccggcatcctggccggcgtgaaggccggcagaggcggcagcagactgtag

SEQ ID NO: 7977 - DNA, 2526 bp, Artificial Sequence
  Description of Artificial Sequence: Synthetic coding sequence
atggccgacagaggctgccccctggaggccgcccccctgcccgccgaggtgagagagagcctggccgagctggagctggagctgagcgagggcgacatcacccagaagggctacgagaagaagagagccaagctgctggccagatacatccccctgatccagggcatcgaccccagcctgcaggccgagaacagaatccccggccccagccagaccaccgccgccgcccccaagcagcagaagagcagacccaccgccagcagagacgagagattcagaagcgacgtgcacaccgaggccgtgcaggccgccctggccaagtacaaggagagaaagatgcccatgcccagcaagagaagaagcgtgctggtgcacagcagcgtggagacctacaccccccccgacaccagcagcgccagcgaggacgagggcagcctgagaagacccggcagactgaccagcacccccctgcagagccacagcagcgtggagccctggctggacagagtgatccagggcagcagcaccagcagcagcgccagcagcaccagcagccaccccggcggcagacccaccaccgcccccagcgccgccgccacccccggcgccgccgccaccaccgccctggccggcctggaggcccacacccacatcgacctgcacagcgccccccccgacgtgaccaccggcctggtggagcacagctacttcgagagaccccaggtggccagcgtgagaagcgtgcccagaggctgcagcggcagcatgctggagaccgccgacggcgtgcccgtgaacagcagagtgagcagcaagatccagcagctgctgaacaccctgaagagacccaagagaccccccctgaaggagttcttcgtggacgacttcgaggagctgctggaggtgcagcagcccgaccccaaccagcccaagcccgagggcagcgagaccagcgtgctgagaggcgagcccctgaccgccggcgtgcccagaccccccagcctgctggccaccctgcagagatggggcaccacccagcccaagagcccctgcctgaccgccctggacaccaccggcaaggccgtgtacaccctgacctacggcaagctgtggagcagaagcctgaagctggcctacaccctgctgaacaagctgaccagcaagaacgagcccctgctgaagcccggcgacagagtggccctggtgttccccaacagcgaccccgtgatgttcatggtggccttctacggctgcctgctggccgagctggtgcccgtgcccatcgaggtgcccctgaccagaaaggacgccggcagccagcaggtgggcttcctgctgggcagctgcggcgtgttcctggccctgaccaccgacgcctgccagaagggcctgcccaaggcccagaccggcgaggtggccgccttcaagggctggccccccctgagctggctggtgatcgacggcaagcacctggccaagccccccaaggactggcaccccctggcccaggacaccggcaccggcaccgcctacatcgagtacaagaccagcaaggagggcagcaccgtgggcgtgaccgtgagccacgccagcctgctggcccagtgcagagccctgacccaggcctgcggctacagcgaggccgagaccctgaccaacgtgctggacttcaagagagacgccggcctgtggcacggcgtgctgaccagcgtgatgaacagaatgcacgtggtgagcgtgccctacgccctgatgaaggccaaccccctgagctggatccagaaggtgtgcttctacaaggccagagccgccctggtgaagagcagagacatgcactggagcctgctggcccagagaggccagagagacgtgagcctgagcagcctgagaatgctgatcgtggccgacggcgccaacccctggagcatcagcagctgcgacgccttcctgaacgtgttccagagcagaggcctgagacccgaggtgatctgcccctgcgccagcagccccgaggccctgaccgtggccatcagaagaccccccgacctgggcggccccccccccagaaaggccgtgctgagcatgaacggcctgagctacggcgtgatcagagtggacaccgaggagaagctgagcgtgctgaccgtgcaggacgtgggccaggtgatgcccggcgccaacgtgtgcgtggtgaagctggagggcaccccctacctgtgcaagaccgacgaggtgggcgagatctgcgtgagcagcagcgccaccggcaccgcctactacggcctgctgggcatcaccaagaacgtgttcgaggccgtgcccgtgaccaccggcggcgcccccatcttcgacagacccttcaccagaaccggcctgctgggcttcatcggccccgacaacctggtgttcatcgtgggcaagctggacggcctgatggtgaccggcgtgagaagacacaacgccgacgacgtggtggccaccgccctggccgtggagcccatgaagttcgtgtacagaggcagatag

SEQ ID NO: 7978 - DNA, 2670 bp, Artificial Sequence
  Description of Artificial Sequence: Synthetic coding sequence
atggccgacagaggctgccccctggaggccgcccccctgcccgccgaggtgagagagagcctggccgagctggagctggagctgagcgagggcgacatcacccagaagggctacgagaagaagagagccaagctgctggccagatacatccccctgatccagggcatcgaccccagcctgcaggccgagaacagaatccccggccccagccagaccaccgccgccgcccccaagcagcagaagagcagacccaccgccagcagagacgagagattcagaagcgacgtgcacaccgaggccgtgcaggccgccctggccaagtacaaggagagaaagatgcccatgcccagcaagagaagaagcgtgctggtgcacagcagcgtggagacctacaccccccccgacaccagcagcgccagcgaggacgagggcagcctgagaagacccggcagactgaccagcacccccctgcagagccacagcagcgtggagccctggctggacagagtgatccagggcagcagcaccagcagcagcgccagcagcaccagcagccaccccggcggcagacccaccaccgcccccagcgccgccgccacccccggcgccgccgccaccaccgccctggccggcctggaggcccacacccacatcgacctgcacagcgccccccccgacgtgaccaccggcctggtggagcacagctacttcgagagaccccaggtggccagcgtgagaagcgtgcccagaggctgcagcggcagcatgctggagaccgccgacggcgtgcccgtgaacagcagagtgagcagcaagatccagcagctgctgaacaccctgaagagacccaagagaccccccctgaaggagttcttcgtggacgacttcgaggagctgctggaggtgcagcagcccgaccccaaccagcccaagcccgagggcagcgagaccagcgtgctgagaggcgagcccctgaccgccggcgtgcccagaccccccagcctgctggccaccctgcagagatggggcaccacccagcccaagagcccctgcctgaccgccctggacaccaccggcaaggccgtgtacaccctgacctacggcaagctgtggagcagaagcctgaagctggcctacaccctgctgaacaagctgaccagcaagaacgagcccctgctgaagcccggcgacagagtggccctggtgttccccaacagcgaccccgtgatgttcatggtggccttctacggctgcctgctggccgagctggtgcccgtgcccatcgaggtgcccctgaccagaaaggacgccggcagccagcaggtgggcttcctgctgggcagctgcggcgtgttcctggccctgaccaccgacgcctgccagaagggcctgcccaaggcccagaccggcgaggtggccgccttcaagggctggccccccctgagctggctggtgatcgacggcaagcacctggccaagccccccaaggactggcaccccctggcccaggacaccggcaccggcaccgcctacatcgagtacaagaccagcaaggagggcagcaccgtgggcgtgaccgtgagccacgccagcctgctggcccagtgcagagccctgacccaggcctgcggctacagcgaggccgagaccctgaccaacgtgctggacttcaagagagacgccggcctgtggcacggcgtgctgaccagcgtgatgaacagaatgcacgtggtgagcgtgccctacgccctgatgaaggccaaccccctgagctggatccagaaggtgtgcttctacaaggccagagccgccctggtgaagagcagagacatgcactggagcctgctggcccagagaggccagagagacgtgagcctgagcagcctgagaatgctgatcgtggccgacggcgccaacccctggagcatcagcagctgcgacgccttcctgaacgtgttccagagcagaggcctgagacccgaggtgatctgcccctgcgccagcagccccgaggccctgaccgtggccatcagaagaccccccgacctgggcggccccccccccagaaaggccgtgctgagcatgaacggcctgagctacggcgtgatcagagtggacaccgaggagaagctgagcgtgctgaccgtgcaggacgtgggccaggtgatgcccggcgccaacgtgtgcgtggtgaagctggagggcaccccctacctgtgcaagaccgacgaggtgggcgagatctgcgtgagcagcagcgccaccggcaccgcctactacggcctgctgggcatcaccaagaacgtgttcgaggccgtgcccgtgaccaccggcggcgcccccatcttcgacagacccttcaccagaaccggcctgctgggcttcatcggccccgacaacctggtgttcatcgtgggcaagctggacggcctgatggtgaccggcgtgagaagacacaacgccgacgacgtggtggccaccgccctggccgtggagcccatgaagttcgtgtacagaggcagaatcgccgtgttcagcgtgaccgtgctgcacgacgacagaatcgtgctggtggccgagcagagacccgacgccagcgaggaggacagcttccagtggatgagcagagtgctgcaggtgggcgcccccgccagacccatggtgagatag

SEQ ID NO: 7979 - DNA, 2397 bp, Artificial Sequence
  Description of Artificial Sequence: Synthetic coding sequence
atggccgacagaggctgccccctggaggccgcccccctgcccgccgaggtgagagagagcctggccgagctggagctggagctgagcgagggcgacatcacccagaagggctacgagaagaagagagccaagctgctggccagatacatccccctgatccagggcatcgaccccagcctgcaggccgagaacagaatccccggccccagccagaccaccgccgccgcccccaagcagcagaagagcagacccaccgccagcagagacgagagattcagaagcgacgtgcacaccgaggccgtgcaggccgccctggccaagtacaaggagagaaagatgcccatgcccagcaagagaagaagcgtgctggtgcacagcagcgtggagacctacaccccccccgacaccagcagcgccagcgaggacgagggcagcctgagaagacccggcagactgaccagcacccccctgcagagccacagcagcgtggagccctggctggacagagtgatccagggcagcagcaccagcagcagcgccagcagcaccagcagccaccccggcggcagacccaccaccgcccccagcgccgccgccacccccggcgccgccgccaccaccgccctggccggcctggaggcccacacccacatcggcgtgcccgtgaacagcagagtgagcagcaagatccagcagctgctgaacaccctgaagagacccaagagaccccccctgaaggagttcttcgtggacgacttcgaggagctgctggaggtgcagcagcccgaccccaaccagcccaagcccgagggcagcgagaccagcgtgctgagaggcgagcccctgaccgccggcgtgcccagaccccccagcctgctggccaccctgcagagatggggcaccacccagcccaagagcccctgcctgaccgccctggacaccaccggcaaggccgtgtacaccctgacctacggcaagctgtggagcagaagcctgaagctggcctacaccctgctgaacaagctgaccagcaagaacgagcccctgctgaagcccggcgacagagtggccctggtgttccccaacagcgaccccgtgatgttcatggtggccttctacggctgcctgctggccgagctggtgcccgtgcccatcgaggtgcccctgaccagaaaggacgccggcagccagcaggtgggcttcctgctgggcagctgcggcgtgttcctggccctgaccaccgacgcctgccagaagggcctgcccaaggcccagaccggcgaggtggccgccttcaagggctggccccccctgagctggctggtgatcgacggcaagcacctggccaagccccccaaggactggcaccccctggcccaggacaccggcaccggcaccgcctacatcgagtacaagaccagcaaggagggcagcaccgtgggcgtgaccgtgagccacgccagcctgctggcccagtgcagagccctgacccaggcctgcggctacagcgaggccgagaccctgaccaacgtgctggacttcaagagagacgccggcctgtggcacggcgtgctgaccagcgtgatgaacagaatgcacgtggtgagcgtgccctacgccctgatgaaggccaaccccctgagctggatccagaaggtgtgcttctacaaggccagagccgccctggtgaagagcagagacatgcactggagcctgctggcccagagaggccagagagacgtgagcctgagcagcctgagaatgctgatcgtggccgacggcgccaacccctggagcatcagcagctgcgacgccttcctgaacgtgttccagagcagaggcctgagacccgaggtgatctgcccctgcgccagcagccccgaggccctgaccgtggccatcagaagaccccccgacctgggcggccccccccccagaaaggccgtgctgagcatgaacggcctgagctacggcgtgatcagagtggacaccgaggagaagctgagcgtgctgaccgtgcaggacgtgggccaggtgatgcccggcgccaacgtgtgcgtggtgaagctggagggcaccccctacctgtgcaagaccgacgaggtgggcgagatctgcgtgagcagcagcgccaccggcaccgcctactacggcctgctgggcatcaccaagaacgtgttcgaggccgtgcccgtgaccaccggcggcgcccccatcttcgacagacccttcaccagaaccggcctgctgggcttcatcggccccgacaacctggtgttcatcgtgggcaagctggacggcctgatggtgaccggcgtgagaagacacaacgccgacgacgtggtggccaccgccctggccgtggagcccatgaagttcgtgtacagaggcagatag

SEQ ID NO: 7980 - DNA, 1515 bp, Artificial Sequence
  Description of Artificial Sequence: Synthetic coding sequence
atggagagaagccagtgcggcagcagagacagaggcgtgagcggcagaccccacctggcccccggcctggtggtggccgccccccccccccccagccccgccctgcccgtgcccagcggcatgcaggtgccccccgccttcctgagaccccccagcctgttcctgagagccgccgccgccgccgccgccgccgccgccgccaccagcggcagcggcggctgcccccccgcccccggcctggagagcggcgtgggcgccgtgggctgcggctaccccagaacccccaagtgcgccagatgcagaaaccacggcgtggtgagcgccctgaagggccacaagagattctgcagatggagagactgcgcctgcgccaagtgcaccctgatcgccgagagacagagagtgatggccgcccaggtggccctgagaagacagcaggcccaggaggagagcgaggccagaggcctgcagagactgctgtgcagcggcctgagctggccccccggcggcagagccagcggcggcggcggcagagccgagaacccccagagcaccggcggccccgccgccggcgccgccctgggcctgggcgccctgagacaggccagcggcagcgccacccccgccttcgaggtgttccagcaggactaccccgaggagaagcaggagcagaaggagagcaagtgcgagagctgccagaacggccaggaggagctgatcagcaagagccaccagctgtacctgggcagcagcagcagaagcaacggcgtgatcggcaagcagagcatcggcagcagcatcagcgagtacagcaacaagcccgacagcatcctgagcccccaccccggcgagcagagcggcggcgaggagagccccagaagcctgagcagcagcgacctggagagcggcaacgagagcgagtgggtgaaggacctgaccgccaccaaggccagcctgcccaccgtgagcagcagacccagagaccccctggacatcctgaccaagatcttccccaactacagaagaagcagactggagggcatcctgagattctgcaagggcgacgtggtgcaggccatcgagcaggtgctgaacggcaaggagcacaagcccgacaacagaaacctggccaacagcgaggagctggagaacaccgccttccagagagccagcagcttcagcctggccggcatcggcttcggcaccctgggcaacaagagcgccttcagccccctgcagaccaccagcgccagctacggcggcgacagcagcctgtacggcgtgaaccccagagtgggcatcagccccctgagactggcctacagcagcgccggcagaggcctgagcggcttcatgagcccctacctgacccccggcctggtgcccaccctgcccttcagacccgccctggactacgccttcagcggcatgatcagagacagcagctacctgagcagcaaggacagcatcacctgcggcagactgtacttcagacccaaccaggacaacccctag

SEQ ID NO: 7981 - DNA, 1629 bp, Artificial Sequence
  Description of Artificial Sequence: Synthetic coding sequence
atggagctgagaagcgagctgcccagcgtgcccggcgccgccaccgccgccgccgccaccgccaccggcccccccgtggccagcgtggccagcgtggccgccgccgccgccgccgccgccagcctgcccgtgagcgtggccggcggcctgctgagaggcccccccctgctgctgagagccgccgagaagtaccccagaacccccaagtgcgccagatgcagaaaccacggcgtggtgagcgccctgaagggccacaagagatactgcagatggaaggactgcctgtgcgccaagtgcaccctgatcgccgagagacagagagtgatggccgcccaggtggccctgagaagacagcaggcccaggaggagaacgaggccagagagctgcagctgctgtacggcaccgccgagggcctggccctggccgccgccaacggcatcatcccccccagacccgcctacgaggtgttcggcagcgtgtgcgccgccgacggcggcggccccggcgccggcgcccccgccggcaccggcggcggcgccgccggcgccggcggcagcgaggccaagctgcagaagttcgacctgttccccaagaccctgctgcaggccggcagacccggcagccccctgcccccccccgtgaagcccctgagccccgacggcgccgacagcggccccggcaccagcagccccgaggtgagacccggcagcggcagcgagaacggcgacggcgagagcttcagcggcagccccctggccagagccagcaaggaggccggcggcagctgccccggcagcgccggccccggcggcggcggcgaggaggacagccccggcagcgccagccccctgggcagcgagagcggcagcgaggccgacaaggaggagggcgaggccgcccccgcccccggcctgggcggcggcagcggccccagacagagaacccccctggacatcctgaccagagtgttccccggccacagaagaggcgtgctggagctggtgctgcagggctgcggcggcgacgtggtgcaggccatcgagcaggtgctgaaccaccacagaggcggcctggccgccggcctgggccccgccgccccccccgacaaggccgccgtgggcgccgccgccgccgccgacgacgcctggcccagcagagtggacgccgccgccgccgccgccgccgccgccggcggccccggcctgcccgcccccctgcaggccggccccgccgcccccccccaccacagacccctgctggccggcgccatggcccccggcgccctgggcagcctgagcagcagaagcgccttcagccccctgcagcccaacgccagccacttcggcgccgacgccggcgcctaccccctgggcgcccccctgggcctgagccccctgagactggcctacagcgccgccgccgcccacagcagaggcctggccttcatggccccctacagcaccgccggcctggtgcccaccctgggcttcagaccccccatggactacgccttcagcgacctgatgagagacagaagcgccgccgccgccgccgccgtgcacaaggagcccacctacggcggcggcctgtacggccccatggtgaacggcgcccccgagaagcagtag

SEQ ID NO: 7982 - DNA, 1629 bp, Artificial Sequence; identical to SEQ ID NO: 7981
  Description of Artificial Sequence: Synthetic coding sequence

SEQ ID NO: 7983 - DNA, 1029 bp, Artificial Sequence
  Description of Artificial Sequence: Synthetic coding sequence
atggccgacaagatggtgagaacccccaagtgcagcagatgcagaaaccacggcttcctggtgcccgtgaagggccacgccggcaagtgcagatggaagcagtgcctgtgcgagaagtgctacctgatcagcgagagacagaagatcatggccgcccagaaggtgctgaagacccaggccgccgaggaggagcaggaggccgccctgtgcgcccagggccccaagcaggccagcggcgccgccgccgccgcccccgcccccgtgcccgtgcccgccgccagcctgagacccctgagccccggcacccccagcggcgacgccgaccccggccccgagggcagagccgccgcctgcttcttcgagcagccccccagaggcagaaaccccggccccagagccctgcagcccgtgctgggcggcagaagccacgtggagcccagcgagagagccgccgtggccatgcccagcctggccggcccccccttcggcgccgaggccgccggcagcggctaccccggccccctggacctgagaagacccatgagaaccgtgcccggccccctgttcaccgacttcgtgagacccctgaacatcaaccccgacagagccctgggccccgagtaccccggcggcagcagcatgcacccctactgccccttccccctgggctacctggacgccccccccggcgtgcccctgcagcagggcttcagacacgtgagcagaagccagtaccagggcggcggcctggtgagcgagcccggcggcgacttccagcccagctactacctgccccccccccccccccccctgccccccctgccccccctgcccccccagccccagttcctgccccccggctacctgagcgccctgcacttcctgcccccccccccccccccccccccccccagcagcttcagcctgaccgtgctgttcgacaccgacaaggagaacaccgacgaccaggacgccgaggtgctgagcggcgagcccagccagcccagcagccaggagcagagcgactag

SEQ ID NO: 7984 - DNA, 432 bp, Artificial Sequence
  Description of Artificial Sequence: Synthetic coding sequence
atgcccagcctggccggcccccccttcggcgccgaggccgccggcagcggctaccccggccccctggacctgagaagacccatgagaaccgtgcccggccccctgttcaccgacttcgtgagacccctgaacatcaaccccgacagagccctgggccccgagtaccccggcggcagcagcatgcacccctactgccccttccccctgggctacctggacgccccccccggcgtgcccctgcagcagggcttcagacacgtgagcagaagccagtaccagggcggcggcctggtgagcgagcccggcggcgacttccagcccagctactacctgccccccccccccccccccctgccccccctgccccccctgcccccccccgccaccgccaccaccaccagcatcatcttcctgaccgacagacccgtgtag

SEQ ID NO: 7985 - DNA, 1104 bp, Artificial Sequence
  Description of Artificial Sequence: Synthetic coding sequence
atggagcccagcgacatgcccgccggctaccactgccccctggacagcgccccctgggacgagaccagagacccccagagcaccgagctgatccccagaagagccatcagcagaagccccacctgcgccagatgcagaaaccacggcgtgaccgcccacctgaagggccacaagagactgtgcctgttccaggcctgcgagtgccacaagtgcgtgctgatcctggagagaagaagagtgatggccgcccaggtggccctgagaagacagcaggaggcccagctgaagaagcacctgatgagaagaggcgaggccagccccaaggcccccaaccacttcagaaagggcaccacccagccccaggtgcccagcggcaaggagaacatcgccccccagccccagaccccccacggcgccgtgctgctggcccccaccccccccggcaagaacagctgcggccccctgctgctgagccacccccccgaggccagccccctgagctggacccccgtgccccccggcccctgggtgcccggccactggctgccccccggcttcagcatgcccccccccgtggtgtgcagactgctgtaccaggagcccgccgtgagcctgccccccttccccggcttcgaccccggcaccagcctgcagctgcccacccacggccccttcaccacctgccccggcagccaccccgtgctgaccgcccccctgagcggcgagccccagggcccccccagccagcccagaacccacagcaccctgatcctgcagccctgcggcacccccgaccccctgcagctgcagccccaggccagcggcgccagctgcctggccagaaccagcggccccagcgagtggcagctgcagcaggaggccgccgaggccctggtgggcctgaaggacagcagccaggcccccagagtgacccccagcgtgccccccaaccccgcctggatcagcctgctgcacccctgcggcccccccgcccccgccggcggcagaggcttccagcccgtgggcccctgcctgagacccagccccgcccccagcgtggccctgcacatcggcagactgggcagcatcagcctgctgagctag

SEQ ID NO: 7986 - DNA, 1404 bp, Artificial Sequence
  Description of Artificial Sequence: Synthetic coding sequence
atggccaccggcgccgacgtgagagacatcctggagctgggcggccccgagggcgacgccgccagcggcaccatcagcaagaaggacatcatcaaccccgacaagaagaagagcaagaagagcagcgagaccctgaccttcaagagacccgagggcatgcacagagaggtgtacgccctgctgtacagcgacaagaaggacgccccccccctgctgcccagcgacaccggccagggctacagaaccgtgaaggccaagctgggcagcaagaaggtgagaccctggaagtggatgcccttcaccaaccccgccagaaaggacggcgccatgttcttccactggagaagagccgccgaggagggcaaggactaccccttcgccagattcaacaagaccgtgcaggtgcccgtgtacagcgagcaggagtaccagctgtacctgcacgacgacgcctggaccaaggccgagaccgaccacctgttcgacctgagcagaagattcgacctgagattcgtggtgatccacgacagatacgaccaccagcagttcaagaagagaagcgtggaggacctgaaggagagatactaccacatctgcgccaagctggccaacgtgagagccgtgcccggcaccgacctgaagatccccgtgttcgacgccggccacgagagaagaagaaaggagcagctggagagactgtacaacagaacccccgagcaggtggccgaggaggagtacctgctgcaggagctgagaaagatcgaggccagaaagaaggagagagagaagagaagccaggacctgcagaagctgatcaccgccgccgacaccaccgccgagcagagaagaaccgagagaaaggcccccaagaagaagctgccccagaagaaggaggccgagaagcccgccgtgcccgagaccgccggcatcaagttccccgacttcaagagcgccggcgtgaccctgagaagccagagaatgaagctgcccagcagcgtgggccagaagaagatcaaggccctggagcagatgctgctggagctgggcgtggagctgagccccacccccaccgaggagctggtgcacatgttcaacgagctgagaagcgacctggtgctgctgtacgagctgaagcaggcctgcgccaactgcgagtacgagctgcagatgctgagacacagacacgaggccctggccagagccggcgtgctgggcggccccgccacccccgccagcggccccggccccgccagcgccgagcccgccgtgaccgagcccggcctgggccccgaccccaaggacaccatcatcgacgtggtgggcgcccccctgacccccaacagcagaaagagaagagagagcgccagcagcagcagcagcgtgaagaaggccaagaagccctag

SEQ ID NO: 7987 - DNA, 1404 bp, Artificial Sequence; identical to SEQ ID NO: 7986
  Description of Artificial Sequence: Synthetic coding sequence

SEQ ID NO: 7988 - DNA, 858 bp, Artificial Sequence
  Description of Artificial Sequence: Synthetic coding sequence
atggccaccggcgccgacgtgagagacatcctggagctgggcggccccgagggcgacgccgccagcggcaccatcagcaagaaggacatcatcaaccccgacaagaagaagagcaagaagagcagcgagaccctgaccttcaagagacccgagggcatgcacagagaggtgtacgccctgctgtacagcgacaagaacaagggcagctgcctgctgagcagaatgcaggaggacctgaagagcttcgcccccggccacgacttcctggccatcggcgacgccccccccctgctgcccagcgacaccggccagggctacagaaccgtgaaggccaagctgggcagcaagaaggtgagaccctggaagtggatgcccttcaccaaccccgccagaaaggacggcgccatgttcttccactggagaagagccgccgaggagggcaaggactaccccttcgccagattcaacaagaccgtgcaggtgcccgtgtacagcgagcaggagtaccagctgtacctgcacgacgacgcctggaccaaggccgagaccgaccacctgttcgacctgagcagaagattcgacctgagattcgtggtgatccacgacagatacgaccaccagcagttcaagaagagaagcgtggaggacctgaaggagagatactaccacatctgcgccaagctggccaacgtgagagccgtgcccggcaccgacctgaagatccccgtgttcgacgccggccacgagagaagaagaaaggagcagctggagagactgtacaacagaacccccgagcaggtggccgaggaggagtacctgctgcaggagctgagaaagatcgaggccagaaagaagtag

SEQ ID NO: 7989 - DNA, 1404 bp, Artificial Sequence; identical to SEQ ID NO: 7986
  Description of Artificial Sequence: Synthetic coding sequence

SEQ ID NO: 7990 - DNA, 399 bp, Artificial Sequence
  Description of Artificial Sequence: Synthetic coding sequence
atcatcaaccccgacaagaagaagagcaagaagagcagcgagaccctgaccttcaagagacccgagggcatgcacagagaggtgtacgccctgctgtacagcgacaagaaggacgccccccccctgctgcccagcgacaccggccagggctacagaaccgtgaaggccaagctgggcagcaagaaggtgagaccctggaagtggatgcccttcaccaaccccgccagaaaggacggcgccatgttcttccactggagaagagccgccgaggagggcaaggactaccccttcgccagattcaacaaggagtaccagctgtacctgcacgacgacgcctggaccaaggccgagaccgaccacctgttcgacctgagcagaagattcgacctgagattctag

SEQ ID NO: 7991 - DNA, 456 bp, Artificial Sequence
  Description of Artificial Sequence: Synthetic coding sequence
atggccaccggcgccgacgtgagagacatcctggagctgggcggccccgagggcgacgccgccagcggcaccatcagcaagaaggacatcatcaaccccgacaagaagaagagcaagaagagcagcgagaccctgaccttcaagagacccgagggcatgcacagagaggtgtacgccctgctgtacagcgacaagaacaagggcagctgcctgctgagcagaatgcaggaggacctgaagagcttcgcccccggccacgacttcctggccatcggcgacgccccccccctgctgcccagcgacaccggccagggctacagaaccgtgaaggccaagctgggcagcaagaaggtgagaccctggaagtggatgcccttcaccaaccccgccagaaaggacggcgccatgttcttccactggagaagagccgccgaggagggcaaggactacccctag

SEQ ID NO: 7992 - DNA, 858 bp, Artificial Sequence; identical to SEQ ID NO: 7988
  Description of Artificial Sequence: Synthetic coding sequence

SEQ ID NO: 7993 - DNA, 714 bp, Artificial Sequence
  Description of Artificial Sequence: Synthetic coding sequence
atggccaccggcgccgacgtgagagacatcctggagctgggcggccccgagggcgacgccgccagcggcaccatcagcaagaaggacatcatcaaccccgacaagaagaagagcaagaagagcagcgagaccctgaccttcaagagacccgagggcatgcacagagaggtgtacgccctgctgtacagcgacaagaaggacgccccccccctgctgcccagcgacaccggccagggctacagaaccgtgaaggccaagctgggcagcaagaaggtgagaccctggaagtggatgcccttcaccaaccccgccagaaaggacggcgccatgttcttccactggagaagagccgccgaggagggcaaggactaccccttcgccagattcaacaagaccgtgcaggtgcccgtgtacagcgagcaggagtaccagctgtacctgcacgacgacgcctggaccaaggccgagaccgaccacctgttcgacctgagcagaagattcgacctgagattcgtggtgatccacgacagatacgaccaccagcagttcaagaagagaagcgtggaggacctgaaggagagatactaccacatctgcgccaagctggccaacgtgagagccgtgcccggcaccgacctgaagatccccgtgttcgacgccggccacgagagaagaagaaaggagcagctggagagactgtacaacagaacctag

SEQ ID NO: 7994 - DNA, 909 bp, Artificial Sequence
  Description of Artificial Sequence: Synthetic coding sequence
atggccaccggcgccgacgtgagagacatcctggagctgggcggccccgagggcgacgccgccagcggcaccatcagcaagaaggacatcatcaaccccgacaagaagaagagcaagaagagcagcgagaccctgaccttcaagagacccgagggcatgcacagagaggtgtacgccctgctgtacagcgacaagaaggacgccccccccctgctgcccagcgacaccggccagggctacagaaccgtgaaggccaagctgggcagcaagaaggtgagaccctggaagtggatgcccttcaccaaccccgccagaaaggacggcgccatgttcttccactggagaagagccgccgaggagggcaaggactaccccttcgccagattcaacaagaccgtgcaggtgcccgtgtacagcgagcaggagtaccagctgtacctgcacgacgacgcctggaccaaggccgagaccgaccacctgttcgacctgagcagaagattcgacctgagattcgtggtgatccacgacagatacgaccaccagcagttcaagaagagaagcgtggaggacctgaaggagagatactaccacatctgcgccaagctggccaacgtgagagccgtgcccggcaccgacctgaagatccccgtgttcgacgccggccacgagagaagaagaaaggagcagctggagagactgtacaacagaacccccgagcaggtggccgaggaggagtacctgctgcaggagctgagaaagatcgaggccagaaagaaggagagagagaagagaagccaggacctgcagaagctgatcaccgccgccgacaccaccgccgagcagagaagaaccgagagaaaggcccccaagaagaagctgccccagaagaaggaggccgagaagccctag

SEQ ID NO: 7995 - DNA, 762 bp, Artificial Sequence
  Description of Artificial Sequence: Synthetic coding sequence
atggccgccagcggcgagagcggcaccagcggcggcggcggcagcaccgaggaggccttcatgaccttctacagcgaggtgaagcagatcgagaagagagacagcgtgctgaccagcaagaaccagatcgagagactgaccagacccggcagcagctacttcaacctgaaccccttcgaggtgctgcagatcgaccccgaggtgaccgacgaggagatcaagaagagattcagacagctgagcatcctggtgcaccccgacaagaaccaggacgacgccgacagagcccagaaggccttcgaggccgtggacaaggcctacaagctgctgctggaccaggagcagaagaagagagccctggacgtgatccaggccggcaaggagtacgtggagcacaccgtgaaggagagaaagaagcagctgaagaaggagggcaagcccaccatcgtggaggaggacgaccccgagctgttcaagcaggccgtgtacaagcagaccatgaagctgttcgccgagctggagatcaagagaaaggagagagaggccaaggagatgcacgagagaaagagacagagagaggaggagatcgaggcccaggagaaggccaagagagagagagagtggcagaagaacttcgaggagagcagagacggcagagtggacagctggagaaacttccaggccaacaccaagggcaagaaggagaagaagaacagaaccttcctgagaccccccaaggtgaagatggagcagagagagtag

SEQ ID NO: 7996 - DNA, 1458 bp, Artificial Sequence
  Description of Artificial Sequence: Synthetic coding sequence
atgaagggctggagcctgcccgcctgcggccccctgcagggcagactggccggctggctggccgtgagagccggcctgctggccgcccccgccgccgtgcacagccccgccgaggtgcacggcagcccccccgccagcctgtgccccagacccagcgtgaagttcagacccggcctgaccgccatggccctgcccacccccagcgacagcaccctgcccgccgaggccagaggcagaggcagaagaagaagactggtgtggacccccagccagagcgaggccctgagagcctgcttcgagagaaacccctaccccggcatcgccaccagagagagactggcccaggccatcggcatccccgagcccagagtgcagatctggttccagaacgagagaagcagacagctgagacagcacagaagagagagcagaccctggcccggcagaagaggcccccccgagggcagaagaaagagaaccgccgtgaccggcagccagaccgccctgctgctgagagccttcgagaaggacagattccccggcatcgccgccagagaggagctggccagagagaccggcctgcccgagagcagaatccagatctggttccagaacagaagagccagacaccccggccagggcggcagagcccccgcccaggccggcggcctgtgcagcgccgcccccggcggcggccaccccgcccccagctgggtggccttcgcccacaccggcgcctggggcaccggcctgcccgccccccacgtgccctgcgcccccggcgccctgccccagggcgccttcgtgagccaggccgccagagccgcccccgccctgcagcccagccaggccgcccccgccgagggcgtgagccagcccgcccccgccagaggcgacttcgcctacgccgcccccgccccccccgacggcgccctgagccacccccaggcccccagatggcccccccaccccggcaagagcagagaggacagagacccccagagagacggcctgcccggcccctgcgccgtggcccagcccggccccgcccaggccggcccccagggccagggcgtgctggccccccccaccagccagggcagcccctggtggggctggggcagaggcccccaggtggccggcgccgcctgggagccccaggccggcgccgccccccccccccagcccgccccccccgacgccagcgccagcgccagacagggccagatgcagggcatccccgcccccagccaggccctgcaggagcccgccccctggagcgccctgccctgcggcctgctgctggacgagctgctggccagccccgagttcctgcagcaggcccagcccctgctggagaccgaggcccccggcgagctggaggccagcgaggaggccgccagcctggaggcccccctgagcgaggaggagtacagagccctgctggaggagctgtag

SEQ ID NO: 7997 - DNA, 1275 bp, Artificial Sequence
  Description of Artificial Sequence: Synthetic coding sequence
atggccctgcccacccccagcgacagcaccctgcccgccgaggccagaggcagaggcagaagaagaagactggtgtggacccccagccagagcgaggccctgagagcctgcttcgagagaaacccctaccccggcatcgccaccagagagagactggcccaggccatcggcatccccgagcccagagtgcagatctggttccagaacgagagaagcagacagctgagacagcacagaagagagagcagaccctggcccggcagaagaggcccccccgagggcagaagaaagagaaccgccgtgaccggcagccagaccgccctgctgctgagagccttcgagaaggacagattccccggcatcgccgccagagaggagctggccagagagaccggcctgcccgagagcagaatccagatctggttccagaacagaagagccagacaccccggccagggcggcagagcccccgcccaggccggcggcctgtgcagcgccgcccccggcggcggccaccccgcccccagctgggtggccttcgcccacaccggcgcctggggcaccggcctgcccgccccccacgtgccctgcgcccccggcgccctgccccagggcgccttcgtgagccaggccgccagagccgcccccgccctgcagcccagccaggccgcccccgccgagggcgtgagccagcccgcccccgccagaggcgacttcgcctacgccgcccccgccccccccgacggcgccctgagccacccccaggcccccagatggcccccccaccccggcaagagcagagaggacagagacccccagagagacggcctgcccggcccctgcgccgtggcccagcccggccccgcccaggccggcccccagggccagggcgtgctggccccccccaccagccagggcagcccctggtggggctggggcagaggcccccaggtggccggcgccgcctgggagccccaggccggcgccgccccccccccccagcccgccccccccgacgccagcgccagcgccagacagggccagatgcagggcatccccgcccccagccaggccctgcaggagcccgccccctggagcgccctgccctgcggcctgctgctggacgagctgctggccagccccgagttcctgcagcaggcccagcccctgctggagaccgaggcccccggcgagctggaggccagcgaggaggccgccagcctggaggcccccctgagcgaggaggagtacagagccctgctggaggagctgtag

SEQ ID NO: 7998 - DNA, 1458 bp, Artificial Sequence; identical to SEQ ID NO: 7996
  Description of Artificial Sequence: Synthetic coding sequence

SEQ ID NO: 7999 - DNA, 1275 bp, Artificial Sequence; identical to SEQ ID NO: 7997
  Description of Artificial Sequence: Synthetic coding sequence

SEQ ID NO: 8000 - DNA, 1452 bp, Artificial Sequence
  Description of Artificial Sequence: Synthetic coding sequence
atgaagggctggagcctgcccgcctgcggccccctgcagggcagactggccggctggctggccgtgagagccggcctgctggccgcccccgccgccgtgcacagccccgccgaggtgcacggcagcccccccgccagcctgtgccccagacccagcgtgaagttcagacccggcctgaccgccatggccctgcccacccccagcgacagcaccctgcccgccgaggccagaggcagaggcagaagaagaagactggtgtggacccccagccagagcgaggccctgagagcctgcttcgagagaaacccctaccccggcatcgccaccagagagagactggcccaggccatcggcatccccgagcccagagtgcagatctggttccagaacgagagaagcagacagctgagacagcacagaagagagagcagaccctggcccggcagaagaggcccccccgagggcagaagaaagagaaccgccgtgaccggcagccagaccgccctgctgctgagagccttcgagaaggacagattccccggcatcgccgccagagaggagctggccagagagaccggcctgcccgagagcagaatccagatctggttccagaacagaagagccagacaccccggccagggcggcagagcccccgcccaggccggcggcctgtgcagcgccgcccccggcggcggccaccccgcccccagctgggtggccttcgcccacaccggcgcctggggcaccggcctgcccgccccccacgtgccctgcgcccccggcgccctgccccagggcgccttcgtgagccaggccgccagagccgcccccgccctgcagcccagccaggccgcccccgccgagggcgtgagccagcccgcccccgccagaggcgacttcgcctacgccgcccccgccccccccgacggcgccctgagccacccccaggcccccagatggcccccccaccccggcaagagcagagaggacagagacccccagagagacggcctgcccggcccctgcgccgtggcccagcccggccccgcccaggccggcccccagggccagggcgtgctggccccccccaccagccagggcagcccctggtggggctggggcagaggcccccaggtggccggcgccgcctgggagccccaggccggcgaggccccccccccccagcccgccccccccgacgccagcgccagacagggccagatgcagggcatccccgcccccagccaggccctgcaggagcccgccccctggagcgccctgccctgcggcctgctgctggacgagctgctggccagccccgagttcctgcagcaggcccagcccctgctggagaccgaggcccccggcgagctggaggccagcgaggaggccgccagcctggaggcccccctgagcgaggaggagtacagagccctgctggaggagctgtag

SEQ ID NO: 8001 - DNA, 1269 bp, Artificial Sequence
  Description of Artificial Sequence: Synthetic coding sequence
atggccctgcccacccccagcgacagcaccctgcccgccgaggccagaggcagaggcagaagaagaagactggtgtggacccccagccagagcgaggccctgagagcctgcttcgagagaaacccctaccccggcatcgccaccagagagagactggcccaggccatcggcatccccgagcccagagtgcagatctggttccagaacgagagaagcagacagctgagacagcacagaagagagagcagaccctggcccggcagaagaggcccccccgagggcagaagaaagagaaccgccgtgaccggcagccagaccgccctgctgctgagagccttcgagaaggacagattccccggcatcgccgccagagaggagctggccagagagaccggcctgcccgagagcagaatccagatctggttccagaacagaagagccagacaccccggccagggcggcagagcccccgcccaggccggcggcctgtgcagcgccgcccccggcggcggccaccccgcccccagctgggtggccttcgcccacaccggcgcctggggcaccggcctgcccgccccccacgtgccctgcgcccccggcgccctgccccagggcgccttcgtgagccaggccgccagagccgcccccgccctgcagcccagccaggccgcccccgccgagggcgtgagccagcccgcccccgccagaggcgacttcgcctacgccgcccccgccccccccgacggcgccctgagccacccccaggcccccagatggcccccccaccccggcaagagcagagaggacagagacccccagagagacggcctgcccggcccctgcgccgtggcccagcccggccccgcccaggccggcccccagggccagggcgtgctggccccccccaccagccagggcagcccctggtggggctggggcagaggcccccaggtggccggcgccgcctgggagccccaggccggcgaggccccccccccccagcccgccccccccgacgccagcgccagacagggccagatgcagggcatccccgcccccagccaggccctgcaggagcccgccccctggagcgccctgccctgcggcctgctgctggacgagctgctggccagccccgagttcctgcagcaggcccagcccctgctggagaccgaggcccccggcgagctggaggccagcgaggaggccgccagcctggaggcccccctgagcgaggaggagtacagagccctgctggaggagctgtag

SEQ ID NO: 8002 - DNA, 1458 bp, Artificial Sequence; identical to SEQ ID NO: 7996
  Description of Artificial Sequence: Synthetic coding sequence

SEQ ID NO: 8003 - DNA, 1275 bp, Artificial Sequence; identical to SEQ ID NO: 7997
  Description of Artificial Sequence: Synthetic coding sequence

SEQ ID NO: 8004 - DNA, 1275 bp, Artificial Sequence; identical to SEQ ID NO: 7997
  Description of Artificial Sequence: Synthetic coding sequence

SEQ ID NO: 8005 - DNA, 1458 bp, Artificial Sequence; identical to SEQ ID NO: 7996
  Description of Artificial Sequence: Synthetic coding sequence

SEQ ID NO: 8006 - DNA, 1458 bp, Artificial Sequence; identical to SEQ ID NO: 7996
  Description of Artificial Sequence: Synthetic coding sequence

SEQ ID NO: 8007 - DNA, 1275 bp, Artificial Sequence; identical to SEQ ID NO: 7997
  Description of Artificial Sequence: Synthetic coding sequence

SEQ ID NO: 8008 - DNA, 1275 bp, Artificial Sequence; identical to SEQ ID NO: 7997
  Description of Artificial Sequence: Synthetic coding sequence

SEQ ID NO: 8009 - DNA, 1419 bp, Artificial Sequence
  Description of Artificial Sequence: Synthetic coding sequence
atgaacggctacggcagcccctacctgtacatgggcggccccgtgagccagccccccagagcccccctgcagagaacccccaagtgcgccagatgcagaaaccacggcgtgctgagctggctgaagggccacaagagatactgcagattcaaggactgcacctgcgagaagtgcatcctgatcatcgagagacagagagtgatggccgcccaggtggccctgagaagacagcaggccaacgagagcctggagagcctgatccccgacagcctgagagccctgcccggcccccccccccccggcgacgccgtggccgccccccagcccccccccgccagccagcccagccagccccagccccccagacccgccgccgagctggccgccgccgccgccctgagatggaccgccgagccccagcccggcgccctgcaggcccagctggccaagcccgacctgaccgaggagagactgggcgacggcaagagcgccgacaacaccgaggtgttcagcgacaaggacaccgaccagagaagcagccccgacgtggccaagagcaagggctgcttcacccccgagagccccgagatcgtgagcgtggaggagggcggctacgccgtgcagaagaacggcggcaaccccgagagcagacccgacagccccaagtgccacgccgagcagaaccacctgctgatcgagggccccagcggcaccgtgagcctgcccttcagcctgaaggccaacagaccccccctggaggtgctgaagaagatcttccccaaccagaagcccaccgtgctggagctgatcctgaagggctgcggcggcgacctggtgagcgccgtggaggtgctgctgagcagcagaagcagcgtgaccggcgccgagagaaccagcgccgagcccgagagcctggccctgcccagcaacggccacatcttcgagcacaccctgagcagctaccccatcagcagcagcaagtggagcgtgggcagcgccttcagagtgcccgacaccctgagattcagcgccgacagcagcaacgtggtgcccagccccctggccggccccctgcagccccccttcccccagccccccagataccccctgatgctgagaaacaccctggccagaagccagagcagccccttcctgcccaacgacgtgaccctgtggaacaccatgaccctgcagcagcagtaccagctgagaagccagtacgtgagccccttccccagcaacagcaccagcgtgttcagaagcagccccgtgctgcccgccagagccaccgaggaccccagaatcagcatccccgacgacggctgccccttcgtgagcaagcagagcatctacaccgaggacgactacgacgagagaagcgacagcagcgacagcagaaccctgaacaccagcagctag

SEQ ID NO: 8010 - DNA, 339 bp, Artificial Sequence
  Description of Artificial Sequence: Synthetic coding sequence
atgcacaccagaaagagactgacccagctgttctgcttccccgacctgaccgaggagagactgggcgacggcaagagcgccgacaacaccgaggtgttcagcgacaaggacaccgaccagagaagcagccccgacgtggccaagagcaagggctgcttcacccccgagagccccgagatcgtgagcgtggaggagggcggctacgccgtgcagaagaacggcggcaaccccgagagcagacccgacagccccaagtgccacgccgagcagaaccacctgctgatcgagggccccagcggcaccgtgagcctgcccttcagcctgaaggccaacagatag

SEQ ID NO: 8011 - DNA, 1701 bp, Artificial Sequence
  Description of Artificial Sequence: Synthetic coding sequence
atggccctgagcgtgcccggctacagccccggcttcagaaagccccccgaggtggtgagactgagaagaaagagagccagaagcagaggcgccgccgccagcccccccagagagctgaccgagcccgccgccagaagagccgccctggtggccggcctgcccctgagacccttccccgccgccggcggcagaggcggcggcagcggcggcggccccgccgccgccagaagaaaccccttcgccagactggacaacagacccagagtggccgccgagccccccgacggccccgccagagagcagcccgaggcccccgtgcccttcctggacagcaaccaggagaacgacctgctgtgggaggagaagttccccgagagaaccaccgtgaccgagctgccccagaccagccacgtgagcttcagcgagcccgacatccccagcagcaagagcaccgagctgcccgtggactggagcatcaagaccagactgctgttcaccagcagccagcccttcacctgggccgaccacctgaaggcccaggaggaggcccagggcctggtgcagcactgcagagccaccgaggtgaccctgcccaagagcatccaggaccccaagctgagcagcgagctgagatgcaccttccagcagagcctgatctactggctgcaccccgccctgagctggctgcccctgttccccagaatcggcgccgacagaaagatggccggcaagaccagcccctggagcaacgacgccaccctgcagcacgtgctgatgagcgactggagcgtgagcttcaccagcctgtacaacctgctgaagaccaagctgtgcccctacttctacgtgtgcacctaccagttcaccgtgctgttcagagccgccggcctggccggcagcgacctgatcaccgccctgatcagccccaccaccagaggcctgagagaggccatgagaaacgagggcatcgagttcagcctgcccctgatcaaggagagcggccacaagaaggagaccgccagcggcaccagcctgggctacggcgaggagcaggccatcagcgacgaggacgaggaggagagcttcagctggctggaggagatgggcgtgcaggacaagatcaagaagcccgacatcctgagcatcaagctgagaaaggagaagcacgaggtgcagatggaccacagacccgagagcgtggtgctggtgaagggcatcaacaccttcaccctgctgaacttcctgatcaacagcaagagcctggtggccaccagcggcccccaggccggcctgccccccaccctgctgagccccgtggccttcagaggcgccaccatgcagatgctgaaggccagaagcgtgaacgtgaagacccaggccctgagcggctacagagaccagttcagcctggagatcaccggccccatcatgccccacagcctgcacagcctgaccatgctgctgaagagcagccagagcggcagcttcagcgccgtgctgtacccccacgagcccaccgccgtgttcaacatctgcctgcagatggacaaggtgctggacatggaggtggtgcacaaggagctgaccaactgcggcctgcaccccaacaccctggagcagctgagccagatccccctgctgggcaagagcagcctgagaaacgtggtgctgagagactacatctacaactggagaagctag

SEQ ID NO: 8012 - DNA, 618 bp, Artificial Sequence
  Description of Artificial Sequence: Synthetic coding sequence
atgcccagcaagaagaagaagtacaacgccagattcccccccgccagaatcaagaagatcatgcagaccgacgaggagatcggcaaggtggccgccgccgtgcccgtgatcatcagcagagccctggagctgttcctggagagcctgctgaagaaggcctgccaggtgacccagagcagaaacgccaagaccatgaccaccagccacctgaagcagtgcatcgagctggagcagcagttcgacttcctgaaggacctggtggccagcgtgcccgacatgcagggcgacggcgaggacaaccacatggacggcgacaagggcgccagaagaggcagaaagcccggcagcggcggcagaaagaacggcggcatgggcaccaagagcaaggacaagaagctgagcggcaccgacagcgagcaggaggacgagagcgaggacaccgacaccgacggcgaggaggagaccagccagccccccccccaggccagccaccccagcgcccacttccagagcccccccacccccttcctgcccttcgccagcaccctgcccctgccccccgccccccccggccccagcgcccccgacgaggaggacgaggaggactacgacagctag

SEQ ID NO: 8013 - DNA, 750 bp, Artificial Sequence
  Description of Artificial Sequence: Synthetic coding sequence
atgaaccccagccccagcaagatcagaatcaacctggaggacaacgtgcagtacgtgagcatgagaaaggccctgaaggtgaagagacccagattcgacgtgagcctggtgtacctgaccagaaagttcatggacctggtgagaagcgcccccggcggcatcctggacctgaacaaggtggccaccaagctgggcgtgagaaagagaagagtgtacgacatcaccaacgtgctggacggcatcgacctggtggagaagaagagcaagaaccacatcagatggatcggcagcgacctgagcaacttcggcgccgtgccccagcagaagaagctgcaggaggagctgagcgacctgagcgccatggaggacgccctggacgagctgatcaaggactgcgcccagcagctgttcgagctgaccgacgacaaggagaacgagagactggcctacgtgacctaccaggacatccacagcatccaggccttccacgagcagatcgtgatcgccgtgaaggcccccgccgagaccagactggacgtgcccgcccccagagaggacagcatcaccgtgcacatcagaagcaccaacggccccatcgacgtgtacctgtgcgaggtggagcagggccagaccagcaacaagagaagcgagggcgtgggcaccagcagcagcgagagcacccaccccgagggccccgaggaggaggagaacccccagcagagcgaggagctgctggaggtgagcaactag

SEQ ID NO: 8014 - DNA, 402 bp, Artificial Sequence
  Description of Artificial Sequence: Synthetic coding sequence
atgagccagcagagacccgccagaaagctgcccagcctgctgctggaccccaccgaggagaccgtgagaagaagatgcagagaccccatcaacgtggagggcctgctgcccagcaagatcagaatcaacctggaggacaacgtgcagtacgtgagcatgagaaaggccctgaaggtgaagagacccagattcgacgtgagcctggtgtacctgaccagaaagttcatggacctggtgagaagcgcccccggcggcatcctggacctgaacaaggtggccaccaagctgggcgtgagaaagagaagagtgtacgacatcaccaacgtgctggacggcatcgacctggtggagaagaagagcaagaaccacatcagatggatgaccctgagccagtgcacctag

SEQ ID NO: 8015 - DNA, 846 bp, Artificial Sequence
  Description of Artificial Sequence: Synthetic coding sequence
atgagccagcagagacccgccagaaagctgcccagcctgctgctggaccccaccgaggagaccgtgagaagaagatgcagagaccccatcaacgtggagggcctgctgcccagcaagatcagaatcaacctggaggacaacgtgcagtacgtgagcatgagaaaggccctgaaggtgaagagacccagattcgacgtgagcctggtgtacctgaccagaaagttcatggacctggtgagaagcgcccccggcggcatcctggacctgaacaaggtggccaccaagctgggcgtgagaaagagaagagtgtacgacatcaccaacgtgctggacggcatcgacctggtggagaagaagagcaagaaccacatcagatggatcggcagcgacctgagcaacttcggcgccgtgccccagcagaagaagctgcaggaggagctgagcgacctgagcgccatggaggacgccctggacgagctgatcaaggactgcgcccagcagctgttcgagctgaccgacgacaaggagaacgagagactggcctacgtgacctaccaggacatccacagcatccaggccttccacgagcagatcgtgatcgccgtgaaggcccccgccgagaccagactggacgtgcccgcccccagagaggacagcatcaccgtgcacatcagaagcaccaacggccccatcgacgtgtacctgtgcgaggtggagcagggccagaccagcaacaagagaagcgagggcgtgggcaccagcagcagcgagagcacccaccccgagggccccgaggaggaggagaacccccagcagagcgaggagctgctggaggtgagcaactag

SEQ ID NO: 8016 - DNA, 621 bp, Artificial Sequence
  Description of Artificial Sequence: Synthetic coding sequence
atggacctggtgagaagcgcccccggcggcatcctggacctgaacaaggtggccaccaagctgggcgtgagaaagagaagagtgtacgacatcaccaacgtgctggacggcatcgacctggtggagaagaagagcaagaaccacatcagatggatcggcagcgacctgagcaacttcggcgccgtgccccagcagaagaagctgcaggaggagctgagcgacctgagcgccatggaggacgccctggacgagctgatcaaggactgcgcccagcagctgttcgagctgaccgacgacaaggagaacgagagactggcctacgtgacctaccaggacatccacagcatccaggccttccacgagcagatcgtgatcgccgtgaaggcccccgccgagaccagactggacgtgcccgcccccagagaggacagcatcaccgtgcacatcagaagcaccaacggccccatcgacgtgtacctgtgcgaggtggagcagggccagaccagcaacaagagaagcgagggcgtgggcaccagcagcagcgagagcacccaccccgagggccccgaggaggaggagaacccccagcagagcgaggagctgctggaggtgagcaactag

SEQ ID NO: 8017 - DNA, 621 bp, Artificial Sequence; identical to SEQ ID NO: 8016
  Description of Artificial Sequence: Synthetic coding sequence

SEQ ID NO: 8018 - DNA, 1860 bp, Artificial Sequence
  Description of Artificial Sequence: Synthetic coding sequence
atggccgccgtggtgcagcagaacgacctggtgttcgagttcgccagcaacgtgatggaggacgagagacagctgggcgaccccgccatcttccccgccgtgatcgtggagcacgtgcccggcgccgacatcctgaacagctacgccggcctggcctgcgtggaggagcccaacgacatgatcaccgagagcagcctggacgtggccgaggaggagatcatcgacgacgacgacgacgacatcaccctgaccgtggaggccagctgccacgacggcgacgagaccatcgagaccatcgaggccgccgaggccctgctgaacatggacagccccggccccatgctggacgagaagagaatcaacaacaacatcttcagcagccccgaggacgacatggtggtggcccccgtgacccacgtgagcgtgaccctggacggcatccccgaggtgatggagacccagcaggtgcaggagaagtacgccgacagccccggcgccagcagccccgagcagcccaagagaaagaagggcagaaagaccaagccccccagacccgacagccccgccaccacccccaacatcagcgtgaagaagaagaacaaggacggcaagggcaacaccatctacctgtgggagttcctgctggccctgctgcaggacaaggccacctgccccaagtacatcaagtggacccagagagagaagggcatcttcaagctggtggacagcaaggccgtgagcagactgtggggcaagcacaagaacaagcccgacatgaactacgagaccatgggcagagccctgagatactactaccagagaggcatcctggccaaggtggagggccagagactggtgtaccagttcaaggagatgcccaaggacctgatctacatcaacgacgaggaccccagcagcagcatcgagagcagcgaccccagcctgagcagcagcgccaccagcaacagaaaccagaccagcagaagcagagtgagcagcagccccggcgtgaagggcggcgccaccaccgtgctgaagcccggcaacagcaaggccgccaagcccaaggaccccgtggaggtggcccagcccagcgaggtgctgagaaccgtgcagcccacccagagcccctaccccacccagctgttcagaaccgtgcacgtggtgcagcccgtgcaggccgtgcccgagggcgaggccgccagaaccagcaccatgcaggacgagaccctgaacagcagcgtgcagagcatcagaaccatccaggcccccacccaggtgcccgtggtggtgagccccagaaaccagcagctgcacaccgtgaccctgcagaccgtgcccctgaccaccgtgatcgccagcaccgaccccagcgccggcaccggcagccagaagttcatcctgcaggccatccccagcagccagcccatgaccgtgctgaaggagaacgtgatgctgcagagccagaaggccggcagcccccccagcatcgtgctgggccccgcccaggtgcagcaggtgctgaccagcaacgtgcagaccatctgcaacggcaccgtgagcgtggccagcagccccagcttcagcgccaccgcccccgtggtgaccttcagccccagaagcagccagctggtggcccacccccccggcaccgtgatcaccagcgtgatcaagacccaggagaccaagaccctgacccaggaggtggagaagaaggagagcgaggaccacctgaaggagaacaccgagaagaccgagcagcagccccagccctacgtgatggtggtgagcagcagcaacggcttcaccagccaggtggccatgaagcagaacgagctgctggagcccaacagcttctag

SEQ ID NO: 8019 - DNA, 1086 bp, Artificial Sequence
  Description of Artificial Sequence: Synthetic coding sequence
atgaactacgagaccatgggcagagccctgagatactactaccagagaggcatcctggccaaggtggagggccagagactggtgtaccagttcaaggagatgcccaaggacctgatctacatcaacgacgaggaccccagcagcagcatcgagagcagcgaccccagcctgagcagcagcgccaccagcaacagaaaccagaccagcagaagcagagtgagcagcagccccggcgtgaagggcggcgccaccaccgtgctgaagcccggcaacagcaaggccgccaagcccaaggaccccgtggaggtggcccagcccagcgaggtgctgagaaccgtgcagcccacccagagcccctaccccacccagctgttcagaaccgtgcacgtggtgcagcccgtgcaggccgtgcccgagggcgaggccgccagaaccagcaccatgcaggacgagaccctgaacagcagcgtgcagagcatcagaaccatccaggcccccacccaggtgcccgtggtggtgagccccagaaaccagcagctgcacaccgtgaccctgcagaccgtgcccctgaccaccgtgatcgccagcaccgaccccagcgccggcaccggcagccagaagttcatcctgcaggccatccccagcagccagcccatgaccgtgctgaaggagaacgtgatgctgcagagccagaaggccggcagcccccccagcatcgtgctgggccccgcccaggtgcagcaggtgctgaccagcaacgtgcagaccatctgcaacggcaccgtgagcgtggccagcagccccagcttcagcgccaccgcccccgtggtgaccttcagccccagaagcagccagctggtggcccacccccccggcaccgtgatcaccagcgtgatcaagacccaggagaccaagaccctgacccaggaggtggagaagaaggagagcgaggaccacctgaaggagaacaccgagaagaccgagcagcagccccagccctacgtgatggtggtgagcagcagcaacggcttcaccagccaggtggccatgaagcagaacgagctgctggagcccaacagcttctag

SEQ ID NO: 8020 - DNA, 75 bp, Artificial Sequence
  Description of Artificial Sequence: Synthetic coding sequence
atggccgccgtggtgcagcagaacgacctggtgttcgagttcgccagcaacgtgatggaggacgagagacagtag

SEQ ID NO: 8021 - DNA, 1788 bp, Artificial Sequence
  Description of Artificial Sequence: Synthetic coding sequence
atggccgccgtggtgcagcagaacgacctggtgttcgagttcgccagcaacgtgatggaggacgagagacagctgggcgaccccgccatcttccccgccgtgatcgtggagcacgtgcccggcgccgacatcctgaacagctacgccggcctggcctgcgtggaggagcccaacgacatgatcaccgagagcagcctggacgtggccgaggaggagatcatcgacgacgacgacgacgacatcaccctgaccgtggaggccagctgccacgacggcgacgagaccatcgagaccatcgaggccgccgaggccctgctgaacatggacagccccggccccatgctggacgagaagagaatcaacggcatccccgaggtgatggagacccagcaggtgcaggagaagtacgccgacagccccggcgccagcagccccgagcagcccaagagaaagaagggcagaaagaccaagccccccagacccgacagccccgccaccacccccaacatcagcgtgaagaagaagaacaaggacggcaagggcaacaccatctacctgtgggagttcctgctggccctgctgcaggacaaggccacctgccccaagtacatcaagtggacccagagagagaagggcatcttcaagctggtggacagcaaggccgtgagcagactgtggggcaagcacaagaacaagcccgacatgaactacgagaccatgggcagagccctgagatactactaccagagaggcatcctggccaaggtggagggccagagactggtgtaccagttcaaggagatgcccaaggacctgatctacatcaacgacgaggaccccagcagcagcatcgagagcagcgaccccagcctgagcagcagcgccaccagcaacagaaaccagaccagcagaagcagagtgagcagcagccccggcgtgaagggcggcgccaccaccgtgctgaagcccggcaacagcaaggccgccaagcccaaggaccccgtggaggtggcccagcccagcgaggtgctgagaaccgtgcagcccacccagagcccctaccccacccagctgttcagaaccgtgcacgtggtgcagcccgtgcaggccgtgcccgagggcgaggccgccagaaccagcaccatgcaggacgagaccctgaacagcagcgtgcagagcatcagaaccatccaggcccccacccaggtgcccgtggtggtgagccccagaaaccagcagctgcacaccgtgaccctgcagaccgtgcccctgaccaccgtgatcgccagcaccgaccccagcgccggcaccggcagccagaagttcatcctgcaggccatccccagcagccagcccatgaccgtgctgaaggagaacgtgatgctgcagagccagaaggccggcagcccccccagcatcgtgctgggccccgcccaggtgcagcaggtgctgaccagcaacgtgcagaccatctgcaacggcaccgtgagcgtggccagcagccccagcttcagcgccaccgcccccgtggtgaccttcagccccagaagcagccagctggtggcccacccccccggcaccgtgatcaccagcgtgatcaagacccaggagaccaagaccctgacccaggaggtggagaagaaggagagcgaggaccacctgaaggagaacaccgagaagaccgagcagcagccccagccctacgtgatggtggtgagcagcagcaacggcttcaccagccaggtggccatgaagcagaacgagctgctggagcccaacagcttctag

SEQ ID NO: 8022 - DNA, 1776 bp, Artificial Sequence
  Description of Artificial Sequence: Synthetic coding sequence
atgttcggcatccaggagagcatccagagaagcggcagcagcatgaaggaggagcccctgggcagcggcatgaacgccgtgagaacctggatgcagggcgccggcgtgctggacgccaacaccgccgcccagagcggcgtgggcctggccagagcccacttcgagaagcagccccccagcaacctgagaaagagcaacttcttccacttcgtgctggccctgtacgacagacagggccagcccgtggagatcgagagaaccgccttcgtgggcttcgtggagaaggagaaggaggccaacagcgagaagaccaacaacggcatccactacagactgcagctgctgtacagcaacggcatcagaaccgagcaggacttctacgtgagactgatcgacagcatgaccaagcaggccatcgtgtacgagggccaggacaagaaccccgagatgtgcagagtgctgctgacccacgagatcatgtgcagcagatgctgcgacaagaagagctgcggcaacagaaacgagacccccagcgaccccgtgatcatcgacagattcttcctgaagttcttcctgaagtgcaaccagaactgcctgaagaacgccggcaaccccagagacatgagaagattccaggtggtggtgagcaccaccgtgaacgtggacggccacgtgctggccgtgagcgacaacatgttcgtgcacaacaacagcaagcacggcagaagagccagaagactggaccccagcgagggcacccccagctacctggagcacgccaccccctgcatcaaggccatcagccccagcgagggctggaccaccggcggcgccaccgtgatcatcatcggcgacaacttcttcgacggcctgcaggtgatcttcggcaccatgctggtgtggagcgagctgatcaccccccacgccatcagagtgcagaccccccccagacacatccccggcgtggtggaggtgaccctgagctacaagagcaagcagttctgcaagggcacccccggcagattcatctacaccgccctgaacgagcccaccatcgactacggcttccagagactgcagaaggtgatccccagacaccccggcgaccccgagagactgcccaaggaggtgatcctgaagagagccgccgacctggtggaggccctgtacggcatgccccacaacaaccaggagatcatcctgaagagagccgccgacatcgccgaggccctgtacagcgtgcccagaaaccacaaccagctgcccgccctggccaacaccagcgtgcacgccggcatgatgggcgtgaacagcttcagcggccagctggccgtgaacgtgagcgaggccagccaggccaccaaccagggcttcaccagaaacagcagcagcgtgagcccccacggctacgtgcccagcaccaccccccagcagaccaactacaacagcgtgaccaccagcatgaacggctacggcagcgccgccatgagcaacctgggcggcagccccaccttcctgaacggcagcgccgccaacagcccctacgccatcgtgcccagcagccccaccatggccagcagcaccagcctgcccagcaactgcagcagcagcagcggcatcttcagcttcagccccgccaacatggtgagcgccgtgaagcagaagagcgccttcgcccccgtggtgagaccccagaccagccccccccccacctgcaccagcaccaacggcaacagcctgcaggccatcagcggcatgatcgtgccccccatgtag

SEQ ID NO: 8023 - DNA, 1776 bp, Artificial Sequence; identical to SEQ ID NO: 8022
  Description of Artificial Sequence: Synthetic coding sequence

SEQ ID NO: 8024 - DNA, 1683 bp, Artificial Sequence
  Description of Artificial Sequence: Synthetic coding sequence
atgttcggcatccaggagagcatccagagaagcggcagcagcatgaaggaggagcccctgggcagcggcatgaacgccgtgagaacctggatgcagggcgccggcgtgctggacgccaacaccgccgcccagagcggcgtgggcctggccagagcccacttcgagaagcagccccccagcaacctgagaaagagcaacttcttccacttcgtgctggccctgtacgacagacagggccagcccgtggagatcgagagaaccgccttcgtgggcttcgtggagaaggagaaggaggccaacagcgagaagaccaacaacggcatccactacagactgcagctgctgtacagcaacggcatcagaaccgagcaggacttctacgtgagactgatcgacagcatgaccaagcaggccatcgtgtacgagggccaggacaagaaccccgagatgtgcagagtgctgctgacccacgagatcatgtgcagattcttcctgaagttcttcctgaagtgcaaccagaactgcctgaagaacgccggcaaccccagagacatgagaagattccaggtggtggtgagcaccaccgtgaacgtggacggccacgtgctggccgtgagcgacaacatgttcgtgcacaacaacagcaagcacggcagaagagccagaagactggaccccagcgaggccaccccctgcatcaaggccatcagccccagcgagggctggaccaccggcggcgccaccgtgatcatcatcggcgacaacttcttcgacggcctgcaggtgatcttcggcaccatgctggtgtggagcgagctgatcaccccccacgccatcagagtgcagaccccccccagacacatccccggcgtggtggaggtgaccctgagctacaagagcaagcagttctgcaagggcacccccggcagattcatctacaccgccctgaacgagcccaccatcgactacggcttccagagactgcagaaggtgatccccagacaccccggcgaccccgagagactgcccaaggaggtgatcctgaagagagccgccgacctggtggaggccctgtacggcatgccccacaacaaccaggagatcatcctgaagagagccgccgacatcgccgaggccctgtacagcgtgcccagaaaccacaaccagctgcccgccctggccaacaccagcgtgcacgccggcatgatgggcgtgaacagcttcagcggccagctggccgtgaacgtgagcgaggccagccaggccaccaaccagggcttcaccagaaacagcagcagcgtgagcccccacggctacgtgcccagcaccaccccccagcagaccaactacaacagcgtgaccaccagcatgaacggctacggcagcgccgccatgagcaacctgggcggcagccccaccttcctgaacggcagcgccgccaacagcccctacgccatcgtgcccagcagccccaccatggccagcagcaccagcctgcccagcaactgcagcagcagcagcggcatcttcagcttcagccccgccaacatggtgagcgccgtgaagcagaagagcgccttcgcccccgtggtgagaccccagaccagccccccccccacctgcaccagcaccaacggcaacagcctgcaggccatcagcggcatgatcgtgccccccatgtag

SEQ ID NO: 8025 - DNA, 4506 bp, Artificial Sequence
  Description of Artificial Sequence: Synthetic coding sequence
atgtgcaagatggccatcatccccgactggctgagaagccacccccacaccagaaagttcacccacagcagaccccacagcagcccctgcagagtgtacagcagaaacggcagccccaacaagttcagaagcagcagcaccaccgccgtggccaaccccaccctgagcagcctggacgtgaagagaatcctgttccagaagatcaccgacagaggcgacgagctgcagaaggccttccagctgctggacaccggccagaacctgaccgtgagcaagagcgagctgagaagaatcatcaccgacttcctgatgcccctgaccagagagcagttccaggacgtgctggcccagatccccctgagcaccagcggcaccgtgccctacctggccttcctgagcagattcggcggcatcgacctgtacatcaacggcatcaagagaggcggcggcaacgagatgaactgctgcagaaccctgagagagctggagatccaggtgggcgagaaggtgttcaagaacatcaagaccgtgatgaaggccttcgagctgatcgacgtgaacaagaccggcctggtgagaccccaggagctgagaagagtgctggagaccttctgcatgaagctgagagacgaggagtacgagaagttcagcaagcactacaacatccacaaggacaccgccgtggactacaacgtgttcctgaagaacctgagcatcaacaacgacctgaacctgagatactgcatgggcaaccaggaggtgagcctggagaaccagcaggccaagaacagcaagaaggagagactgctgggcagcgccagcagcgaggacatctggagaaactacagcctggacgagatcgagagaaacttctgcctgcagctgagcaagagctacgagaaggtggagaaggccctgagcgccggcgacccctgcaagggcggctacgtgagcttcaactacctgaagatcgtgctggacaccttcgtgtaccagatccccagaagaatcttcatccagctgatgaagagattcggcctgaaggccaccaccaagatcaactggaagcagttcctgaccagcttccacgagccccagggcctgcaggtgagcagcaagggccccctgaccaagagaaacagcatcaacagcagaaacgagagccacaaggagaacatcatcaccaagctgttcagacacaccgaggaccacagcgccagcctgaagaaggccctgctgatcatcaacaccaagcccgacggccccatcaccagagaggagttcagatacatcctgaactgcatggccgtgaagctgagcgacagcgagttcaaggagctgatgcagatgctggaccccggcgacaccggcgtggtgaacaccagcatgttcatcgacctgatcgaggagaactgcagaatgagaaagaccagcccctgcaccgacgccaagacccccttcctgctggcctgggacagcgtggaggagatcgtgcacgacaccatcaccagaaacctgcaggccttctacaacatgctgagaagctacgacctgggcgacaccggcagaatcggcagaaacaacttcaagaagatcatgcacgtgttctgccccttcctgaccaacgcccacttcatcaagctgtgcagcaagatccaggacatcggcagcggcagaatcctgtacaagaagctgctggcctgcatcggcatcgacggcccccccaccgtgagccccgtgctggtgcccaaggaccagctgctgagcgagcacctgcagaaggacgagcagcagcagcccgacctgagcgagagaaccaagctgaccgaggacaagaccaccctgaccaagaagatgaccaccgaggaggtgatcgagaagttcaagaagtgcatccagcagcaggaccccgccttcaagaagagattcctggacttcagcaaggagcccaacggcaagatcaacgtgcacgacttcaagaaggtgctggaggacaccggcatgcccatggacgacgaccagtacgccctgctgaccaccaagatcggcttcgagaaggagggcatgagctacctggacttcgccgccggcttcgaggacccccccatgagaggccccgagaccacccccccccagccccccacccccagcaagagctacgtgaacagccacttcatcaccgccgaggagtgcctgaagctgttccccagaagactgaaggagagcttcagagacccctacagcgccttcttcaagaccgacgccgacagagacggcatcatcaacatgcacgacctgcacagactgctgctgcacctgctgctgaacctgaaggacgacgagttcgagagattcctgggcctgctgggcctgagactgagcgtgaccctgaacttcagagagttccagaacctgtgcgagaagagaccctggagaaccgacgaggccccccagagactgatcagacccaagcagaaggtggccgacagcgagctggcctgcgagcaggcccaccagtacctggtgaccaaggccaagaacagatggagcgacctgagcaagaacttcctggagaccgacaacgagggcaacggcatcctgagaagaagagacatcaagaacgccctgtacggcttcgacatccccctgacccccagagagttcgagaagctgtgggccagatacgacaccgagggcaagggccacatcacctaccaggagttcctgcagaagctgggcatcaactacagccccgccgtgcacagaccctgcgccgaggactacttcaacttcatgggccacttcaccaagccccagcagctgcaggaggagatgaaggagctgcagcagagcaccgagaaggccgtggccgccagagacaagctgatggacagacaccaggacatcagcaaggccttcaccaagaccgaccagagcaagaccaactacatcagcatctgcaagatgcaggaggtgctggaggagtgcggctgcagcctgaccgagggcgagctgacccacctgctgaacagctggggcgtgagcagacacgacaacgccatcaactacctggacttcctgagagccgtggagaacagcaagagcaccggcgcccagcccaaggagaaggaggagagcatgcccatcaacttcgccaccctgaacccccaggaggccgtgagaaagatccaggaggtggtggagagcagccagctggccctgagcaccgccttcagcgccctggacaaggaggacaccggcttcgtgaaggccaccgagttcggccaggtgctgaaggacttctgctacaagctgaccgacaaccagtaccactacttcctgagaaagctgagaatccacctgaccccctacatcaactggaagtacttcctgcagaacttcagctgcttcctggaggagaccgccgacgagtgggccgagaagatgcccaagggccccccccccaccagccccaaggccaccgccgacagagacatcctggccagactgcacaaggccgtgaccagccactaccacgccatcacccaggagttcgagaacttcgacaccatgaagaccaacaccatcagcagagaggagttcagagccatctgcaacagaagagtgcagatcctgaccgacgagcagttcgacagactgtggaacgagatgcccgtgaacgccaagggcagactgaagtaccccgacttcctgagcagattcagcagcgagaccgccgccacccccatggccaccggcgacagcgccgtggcccagagaggcagcagcgtgcccgacgtgagcgagggcaccagaagcgccctgagcctgcccacccaggagctgagacccggcagcaagagccagagccacccctgcacccccgccagcaccaccgtgatccccggcaccccccccctgcagaactgcgaccccatcgagagcagactgagaaagagaatccagggctgctggagacagctgctgaaggagtgcaaggagaaggacgtggccagacagggcgacatcaacgccagcgacttcctggccctggtggagaagttcaacctggacatcagcaaggaggagtgccagcagctgatcatcaagtacgacctgaagagcaacggcaagttcgcctactgcgacttcatccagagctgcgtgctgctgctgaaggccaaggagagcagcctgatgcacagaatgaagatccagaacgcccacaagatgaaggaggccggcgccgagacccccagcttctacagcgccctgctgagaatccagcccaagatcgtgcactgctggagacccatgagaagaaccttcaagagctacgacgaggccggcaccggcctgctgagcgtggccgacttcagaaccgtgctgagacagtacagcatcaacctgagcgaggaggagttcttccacatcctggagtactacgacaagaccctgagcagcaagatcagctacaacgacttcctgagagccttcctgcagtag

SEQ ID NO: 8026 - DNA, 732 bp, Artificial Sequence
  Description of Artificial Sequence: Synthetic coding sequence
atggtgccccagatcagcagcgacctgctgcagatccccctgagcaccagcggcaccgtgccctacctggccttcctgagcagattcggcggcatcgacctgtacatcaacggcatcaagagaggcggcggcaacgagatgaactgctgcagaaccctgagagagctggagatccaggtgggcgagaaggtgttcaagaacatcaagaccgtgatgaaggccttcgagctgatcgacgtgaacaagaccggcctggtgagaccccaggagctgagaagagtgctggagaccttctgcatgaagctgagagacgaggagtacgagaagttcagcaagcactacaacatccacaaggacaccgccgtggactacaacgtgttcctgaagaacctgagcatcaacaacgacctgaacctgagatactgcatgggcaaccaggaggtgagcctggagaaccagcaggccaagaacagcaagaaggagagactgctgggcagcgccagcagcgaggacatctggagaaactacagcctggacgagatcgagagaaacttctgcctgcagctgagcaagagctacgagaaggtggagaaggccctgagcgccggcgacccctgcaagggcggctacgtgagcttcaactacctgaagatcgtgctggacaccttcgtgtaccagatccccagaagaatcttcatccagctgatgaagagaaaccccatggacagatag

SEQ ID NO: 8027 - DNA, 4050 bp, Artificial Sequence
  Description of Artificial Sequence: Synthetic coding sequence
atgaactgctgcagaaccctgagagagctggagatccaggtgggcgagaaggtgttcaagaacatcaagaccgtgatgaaggccttcgagctgatcgacgtgaacaagaccggcctggtgagaccccaggagctgagaagagtgctggagaccttctgcatgaagctgagagacgaggagtacgagaagttcagcaagcactacaacatccacaaggacaccgccgtggactacaacgtgttcctgaagaacctgagcatcaacaacgacctgaacctgagatactgcatgggcaaccaggaggtgagcctggagaaccagcaggccaagaacagcaagaaggagagactgctgggcagcgccagcagcgaggacatctggagaaactacagcctggacgagatcgagagaaacttctgcctgcagctgagcaagagctacgagaaggtggagaaggccctgagcgccggcgacccctgcaagggcggctacgtgagcttcaactacctgaagatcgtgctggacaccttcgtgtaccagatccccagaagaatcttcatccagctgatgaagagattcggcctgaaggccaccaccaagatcaactggaagcagttcctgaccagcttccacgagccccagggcctgcaggtgagcagcaagggccccctgaccaagagaaacagcatcaacagcagaaacgagagccacaaggagaacatcatcaccaagctgttcagacacaccgaggaccacagcgccagcctgaagaaggccctgctgatcatcaacaccaagcccgacggccccatcaccagagaggagttcagatacatcctgaactgcatggccgtgaagctgagcgacagcgagttcaaggagctgatgcagatgctggaccccggcgacaccggcgtggtgaacaccagcatgttcatcgacctgatcgaggagaactgcagaatgagaaagaccagcccctgcaccgacgccaagacccccttcctgctggcctgggacagcgtggaggagatcgtgcacgacaccatcaccagaaacctgcaggccttctacaacatgctgagaagctacgacctgggcgacaccggcagaatcggcagaaacaacttcaagaagatcatgcacgtgttctgccccttcctgaccaacgcccacttcatcaagctgtgcagcaagatccaggacatcggcagcggcagaatcctgtacaagaagctgctggcctgcatcggcatcgacggcccccccaccgtgagccccgtgctggtgcccaaggaccagctgctgagcgagcacctgcagaaggacgagcagcagcagcccgacctgagcgagagaaccaagctgaccgaggacaagaccaccctgaccaagaagatgaccaccgaggaggtgatcgagaagttcaagaagtgcatccagcagcaggaccccgccttcaagaagagattcctggacttcagcaaggagcccaacggcaagatcaacgtgcacgacttcaagaaggtgctggaggacaccggcatgcccatggacgacgaccagtacgccctgctgaccaccaagatcggcttcgagaaggagggcatgagctacctggacttcgccgccggcttcgaggacccccccatgagaggccccgagaccacccccccccagccccccacccccagcaagagctacgtgaacagccacttcatcaccgccgaggagtgcctgaagctgttccccagaagactgaaggagagcttcagagacccctacagcgccttcttcaagaccgacgccgacagagacggcatcatcaacatgcacgacctgcacagactgctgctgcacctgctgctgaacctgaaggacgacgagttcgagagattcctgggcctgctgggcctgagactgagcgtgaccctgaacttcagagagttccagaacctgtgcgagaagagaccctggagaaccgacgaggccccccagagactgatcagacccaagcagaaggtggccgacagcgagctggcctgcgagcaggcccaccagtacctggtgaccaaggccaagaacagatggagcgacctgagcaagaacttcctggagaccgacaacgagggcaacggcatcctgagaagaagagacatcaagaacgccctgtacggcttcgacatccccctgacccccagagagttcgagaagctgtgggccagatacgacaccgagggcaagggccacatcacctaccaggagttcctgcagaagctgggcatcaactacagccccgccgtgcacagaccctgcgccgaggactacttcaacttcatgggccacttcaccaagccccagcagctgcaggaggagatgaaggagctgcagcagagcaccgagaaggccgtggccgccagagacaagctgatggacagacaccaggacatcagcaaggccttcaccaagaccgaccagagcaagaccaactacatcagcatctgcaagatgcaggaggtgctggaggagtgcggctgcagcctgaccgagggcgagctgacccacctgctgaacagctggggcgtgagcagacacgacaacgccatcaactacctggacttcctgagagccgtggagaacagcaagagcaccggcgcccagcccaaggagaaggaggagagcatgcccatcaacttcgccaccctgaacccccaggaggccgtgagaaagatccaggaggtggtggagagcagccagctggccctgagcaccgccttcagcgccctggacaaggaggacaccggcttcgtgaaggccaccgagttcggccaggtgctgaaggacttctgctacaagctgaccgacaaccagtaccactacttcctgagaaagctgagaatccacctgaccccctacatcaactggaagtacttcctgcagaacttcagctgcttcctggaggagaccgccgacgagtgggccgagaagatgcccaagggccccccccccaccagccccaaggccaccgccgacagagacatcctggccagactgcacaaggccgtgaccagccactaccacgccatcacccaggagttcgagaacttcgacaccatgaagaccaacaccatcagcagagaggagttcagagccatctgcaacagaagagtgcagatcctgaccgacgagcagttcgacagactgtggaacgagatgcccgtgaacgccaagggcagactgaagtaccccgacttcctgagcagattcagcagcgagaccgccgccacccccatggccaccggcgacagcgccgtggcccagagaggcagcagcgtgcccgacgtgagcgagggcaccagaagcgccctgagcctgcccacccaggagctgagacccggcagcaagagccagagccacccctgcacccccgccagcaccaccgtgatccccggcaccccccccctgcagaactgcgaccccatcgagagcagactgagaaagagaatccagggctgctggagacagctgctgaaggagtgcaaggagaaggacgtggccagacagggcgacatcaacgccagcgacttcctggccctggtggagaagttcaacctggacatcagcaaggaggagtgccagcagctgatcatcaagtacgacctgaagagcaacggcaagttcgcctactgcgacttcatccagagctgcgtgctgctgctgaaggccaaggagagcagcctgatgcacagaatgaagatccagaacgcccacaagatgaaggaggccggcgccgagacccccagcttctacagcgccctgctgagaatccagcccaagatcgtgcactgctggagacccatgagaagaaccttcaagagctacgacgaggccggcaccggcctgctgagcgtggccgacttcagaaccgtgctgagacagtacagcatcaacctgagcgaggaggagttcttccacatcctggagtactacgacaagaccctgagcagcaagatcagctacaacgacttcctgagagccttcctgcagtag

SEQ ID NO: 8028 - DNA, 783 bp, Artificial Sequence
  Description of Artificial Sequence: Synthetic coding sequence
atgaacagcgccgccggcttcagccacctggacagaagagagagagtgctgaagctgggcgagagcttcgagaagcagcccagatgcgccttccacaccgtgagatacgacttcaagcccgccagcatcgacaccagcagcgagggctacctggaggtgggcgagggcgagcaggtgaccatcaccctgcccaacatcgagggcagcaccccccccgtgaccgtgttcaagggcagcaagaagccctacctgaaggagtgcatcctgatcatcaaccacgacaccggcgagtgcagactggagaagctgagcagcaacatcaccgtgaagaagaccagagtggagggcagcagcaagatccagtacagaaaggagcagcagcagcagcagatgtggaacagcgccagaacccccaacctggtgaagcacagccccagcgaggacaagatgagccccgccagccccatcgacgacatcgagagagagctgaaggccgaggccagcctgatggaccagatgagcagctgcgacagcagcagcgacagcaagagcagcagcagcagcagcagcgaggacagcagcagcgacagcgaggacgaggactgcaagagcagcaccagcgacaccggcaactgcgtgagcggccaccccaccatgacccagtacagaatccccgacatcgacgccagccacaacagattcagagacaacagcggcctgctgatgaacaccctgagaaacgacctgcagctgagcgagagcggcagcgacagcgacgactag

SEQ ID NO: 8029 - DNA, 792 bp, Artificial Sequence
  Description of Artificial Sequence: Synthetic coding sequence
atgaacagcgccgccggcttcagccacctggacagaagagagagagtgctgaagctgggcgagagcttcgagaagcagcccagatgcgccttccacaccgtgagatacgacttcaagcccgccagcatcgacaccagcagcgagggctacctggaggtgggcgagggcgagcaggtgaccatcaccctgcccaacatcgagggcagcaccccccccgtgaccgtgttcaagggcagcaagaagccctacctgaaggagtgcatcctgatcatcaaccacgacaccggcgagtgcagactggagaagctgagcagcaacatcaccgtgaagaagaccagagtggagggcagcagcaagatccagtacagaaaggagcagcagcagcagcagatgtggaacagcgccagaacccccaacctggtgaagcacagccccagcgaggacaagatgagccccgccagccccatcgacgacatcgagagagagctgaaggccgaggccagcctgatggaccagatgagcagctgcgacagcagcagcgacagcaagagcagcagcagcagcagcagcgaggacagcagcagcgacagcgaggacgaggactgcaagagcagcaccagcgacaccggcaactgcgtgagcggccaccccaccatgacccagtacagaatccccgacatcgacgccagccacaacagattcagagacaacagcggcctgctgatgaacaccctgaacaacctgagcagccacagcttcagcagcctgtacgaccccctgctgagccactag

SEQ ID NO: 8030 - DNA, 252 bp, Artificial Sequence
  Description of Artificial Sequence: Synthetic coding sequence
atgggcagaagaaagagcaagagaaagcccccccccaagaagaagatgaccggcaccctggagacccagttcacctgccccttctgcaaccacgagaagagctgcgacgtgaagatggacagagccagaaacaccggcgtgatcagctgcaccgtgtgcctggaggagttccagacccccatcacctacctgagcgagcccgtggacgtgtacagcgactggatcgacgcctgcgaggccgccaaccagtag

SEQ ID NO: 8031 - DNA, 306 bp, Artificial Sequence
  Description of Artificial Sequence: Synthetic coding sequence
atggtggtgagcaagatgaacaaggacgcccagatgagagccgccatcaaccagaagctgatcgagaccggcgagagagagagactgaaggagctgctgagagccaagctgatcgagtgcggctggaaggaccagctgaaggcccactgcaaggaggtgatcaaggagaagggcctggagcacgtgaccgtggacgacctggtggccgagatcacccccaagggcagagccctggtgcccgacagcgtgaagaaggagctgctgcagagaatcagaaccttcctggcccagcacgccagcctgtag

SEQ ID NO: 8032 - DNA, 291 bp, Artificial Sequence
  Description of Artificial Sequence: Synthetic coding sequence
atgaacaaggacgcccagatgagagccgccatcaaccagaagctgatcgagaccggcgagagagagagactgaaggagctgctgagagccaagctgatcgagtgcggctggaaggaccagctgaaggcccactgcaaggaggtgatcaaggagaagggcctggagcacgtgaccgtggacgacctggtggccgagatcacccccaagggcagagccctggtgcccgacagcgtgaagaaggagctgctgcagagaatcagaaccttcctggcccagcacgccagcctgtag

SEQ ID NO: 8033 - DNA, 486 bp, Artificial Sequence
  Description of Artificial Sequence: Synthetic coding sequence
atggccgagcccaccggcctgctggagatgagcgagctgcccggcgacagcagcgtgccccaggtgggcaccgccagcggcgtgagcgacgtgctgagaggcgccgtgggcggcggcgtgagagtgcaggaggccagagagggccccgtggccgaggccgccagaagcatggccagaatgcccggccccgtgcccggccccatccccagcagcgtgcccggcctggccagcgcccccgacccccaccagcagctggccttcctggagatcaacagacagctgctgttcagagagtacctggacggcagcagcatgatccccgtgagactgctgagagacttcgaggagagaagaagactgttcgtggagggctgcaaggccagagaggccgccttcgacgccgaccccccccagatggacttcgccgccgtggccttcaccgtggccctgaccgccagcgaggccctgagccccctggccgactag

SEQ ID NO: 8034 - DNA, 2556 bp, Artificial Sequence
  Description of Artificial Sequence: Synthetic coding sequence
atgagcagcaagcaggagatcatgagcgaccagagattcagaagagtggccaaggaccccagattctgggagatgcccgagaaggacagaaaggtgaagatcgacaagagattcagagccatgttccacgacaagaagttcaagctgaactacgccgtggacaagagaggcagacccatcagccacagcaccaccgaggacctgaagagattctacgacctgagcgacagcgacagcaacctgagcggcgaggacagcaaggccctgagccagaagaagatcaagaagaagaagacccagaccaagaaggagatcgacagcaagaacctggtggagaagaagaaggagaccaagaaggccaaccacaagggcagcgagaacaagaccgacctggacaacagcatcggcatcaagaagatgaagaccagctgcaagttcaagatcgacagcaacatcagccccaagaaggacagcaaggagttcacccagaagaacaagaaggagaagaagaacatcgtgcagcacaccaccgacagcagcctggaggagaagcagagaaccctggacagcggcaccagcgagatcgtgaagagccccagaatcgagtgcagcaagaccagaagagagatgcagagcgtggtgcagctgatcatgaccagagacagcgacggctacgagaacagcaccgacggcgagatgtgcgacaaggacgccctggaggaggacagcgagagcgtgagcgagatcggcagcgacgaggagagcgagaacgagatcaccagcgtgggcagagccagcggcgacgacgacggcagcgaggacgacgaggaggaggacgaggacgaggaggaggacgaggacgaggacagcgaggacgacgacaagagcgacagcggccccgacctggccagaggcaagggcaacatcgagaccagcagcgaggacgaggacgacaccgccgacctgttccccgaggagagcggcttcgagcacgcctggagagagctggacaaggacgcccccagagccgacgagatcaccagaagactggccgtgtgcaacatggactgggacagactgaaggccaaggacctgctggccctgttcaacagcttcaagcccaagggcggcgtgatcttcagcgtgaagatctaccccagcgagttcggcaaggagagaatgaaggaggagcaggtgcagggccccgtggagctgctgagcatccccgaggacgcccccgagaaggactggaccagcagagagaagctgagagactaccagttcaagagactgaagtactactacgccgtggtggactgcgacagccccgagaccgccagcaagatctacgaggactgcgacggcctggagttcgagagcagctgcagcttcatcgacctgagattcatccccgacgacatcaccttcgacgacgagcccaaggacgtggccagcgaggtgaacctgaccgcctacaagcccaagtacttcaccagcgccgccatgggcaccagcaccgtggagatcacctgggacgagaccgaccacgagagaatcaccatgctgaacagaaagttcaagaaggaggagctgctggacatggacttccaggcctacctggccagcagcagcgaggacgaggaggagatcgaggaggagctgcagggcgacgacggcgtgaacgtggaggaggacggcaagaccaagaagagccagaaggacgacgaggagcagatcgccaagtacagacagctgctgcaggtgatccaggagaaggagaagaagggcaaggagaacgacatggagatggagatcaagtgggtgcccggcctgaaggagagcgccgaggagatggtgaagaacaagctggagggcaaggacaagctgaccccctgggagcagttcctggagaagaagaaggagaagaagagactgaagagaaagcagaaggccctggccgaggaggccagcgaggaggagctgcccagcgacgtggacctgaacgacccctacttcgccgaggaggtgaagcagatcggcatcaacaagaagagcgtgaagagcgccaaggacggcaccagccccgaggaggagatcgagatcgagagacagaaggccgagatggccctgctgatgatggacgaggacgaggacagcaagaagcacttcaactacaacaagatcgtggagcaccagaacctgagcaagaagaagaagaagcagctgatgaagaagaaggagctgatcgaggacgacttcgaggtgaacgtgaacgacgccagattccaggccatgtacaccagccacctgttcaacctggaccccagcgaccccaacttcaagaagaccaaggccatggagaagatcctggaggagaaggccagacagagagagagaaaggagcaggagctgacccaggccatcaagaagaaggagagcgagatcgagaaggagagccagagaaagagcatcgaccccgccctgagcatgctgatcaagagcatcaagaccaagaccgagcagttccaggccagaaagaagcagaaggtgaagtag

SEQ ID NO: 8035 - DNA, 333 bp, Artificial Sequence
  Description of Artificial Sequence: Synthetic coding sequence
atgagcagcaagcaggagatcatgagcgaccagagattcagaagagtggccaaggaccccagattctgggagatgcccgagaaggacagaaaggtgaagatcgacaagagattcagagccatgttccacgacaagaagttcaagctgaactacgccgtggacaagagaggcagacccatcagccacagcaccaccgaggacctgaagagattctacgacctgagcgacagcgacagcaacctgagcggcgaggacagcaaggccctgagccagaagaagatcaagaagaagaagacccagaccaagaagaagaagaagaagaagaagaagtag

SEQ ID NO: 8036 - DNA, 1086 bp, Artificial Sequence
  Description of Artificial Sequence: Synthetic coding sequence
atgcactgcagctgcctggccgagggcatccccgccaaccccggcaactggatcagcggcctggccttccccgactgggcctacaaggccgagagcagccccggcagcagacagatccagctgtggcacttcatcctggagctgctgcagaaggaggagttcagacacgtgatcgcctggcagcagggcgagtacggcgagttcgtgatcaaggaccccgacgaggtggccagactgtggggcagaagaaagtgcaagccccagatgaactacgacaagctgagcagagccctgagatactactacaacaagagaatcctgcacaagaccaagggcaagagattcacctacaagttcaacttcagcaagctgatcgtggtgaactaccccctgtgggaggtgagagccccccccagcccccacctgctgctgggcgcccccgccctgtgcagacccgccctggtgcccgtgggcgtgcagagcgagctgctgcacagcatgctgttcgcccaccaggccatggtggagcagctgaccggccagcagacccccagaggcccccccgagaccagcggcgacaagaagggcagcagcagcagcgtgtacagactgggcagcgcccccggcccctgcagactgggcctgtgctgccacctgggcagcgtgcagggcgagctgcccggcgtggccagcttcaccccccccctgcccccccccctgcccagcaactggacctgcctgagcggccccttcctgccccccctgcccagcgagcagcagctgcccggcgccttcaagcccgacatcctgctgcccggccccagaagcctgcccggcgcctggcacttccccggcctgcccctgctggccggcctgggccagggcgccggcgagagactgtggctgctgagcctgagacccgagggcctggaggtgaagcccgcccccatgatggaggccaagggcggcctggaccccagagaggtgttctgccccgagaccagaagactgaagaccggcgaggagagcctgaccagccccaacctggagaacctgaaggccgtgtggcccctggaccccccctag

SEQ ID NO: 8037 - DNA, 498 bp, Artificial Sequence
  Description of Artificial Sequence: Synthetic coding sequence
atgagccaggccaccaagagaaagcacgtggtgaaggaggtgctgggcgagcacatcgtgcccagcgaccagcagcagatcgtgagagtgctgagaacccccggcaacaacctgcacgaggtggagaccgcccagggccagagattcctggtgagcatgcccagcaagtacagaaagaacatctggatcaagagaggcgacttcctgatcgtggaccccatcgaggagggcgagaaggtgaaggccgagatcagcttcgtgctgtgcaaggaccacgtgagaagcctgcagaaggagggcttctggcccgaggccttcagcgaggtggccgagaagcacaacaacagaaacagacagacccagcccgagctgcccgccgagccccagctgagcggcgaggagagcagcagcgaggacgacagcgacctgttcgtgaacaccaacagaagacagtaccacgagagcgaggaggagagcgaggaggaggaggccgcctag

SEQ ID NO: 8038 - DNA, 498 bp, Artificial Sequence; identical to SEQ ID NO: 8037
  Description of Artificial Sequence: Synthetic coding sequence

SEQ ID NO: 8039 - DNA, 237 bp, Artificial Sequence
  Description of Artificial Sequence: Synthetic coding sequence
atgagccaggccaccaagagaaagcacgtggtgaaggaggtgctgggcgagcacatcgtgcccagcgaccagcagcagatcgtgagagtgctgagaacccccggcaacaacctgcacgaggtggagaccgcccagggccagagattcctggtgagcatgcccagcaagtacagaaagaacatctggatcaagagaggcgacttcctgatcgtggaccccatcgaggagggcgagtag

SEQ ID NO: 8040 - DNA, 498 bp, Artificial Sequence; identical to SEQ ID NO: 8037
  Description of Artificial Sequence: Synthetic coding sequence

SEQ ID NO: 8041 - DNA, 441 bp, Artificial Sequence
  Description of Artificial Sequence: Synthetic coding sequence
atgagccaggccaccaagagaaagcacgtggtgaaggaggtgctgggcgagcacatcgtgcccagcgaccagcagcagatcgtgagagtgctgagaacccccggcaacaacctgcacgaggtggagaccgcccagggccagagattcctggtgagcatgcccagcaagtacagaaagaacatctggatcaagagaggcgacttcctgatcgtggaccccatcgaggagggcgagaaggtgaaggccgagatcagcttcgtgctgtgcaaggaccacgtgagaagcctgcagaaggagggcttctggcccgaggccttcagcgaggtggccgagaagcacaacaacagaaacagacagacccagcccgagctgcccgccgagccccagctgagcggcgaggagagcagcagcgaggacgacagcgacctgttcgtgaactag

SEQ ID NO: 8042 - DNA, 345 bp, Artificial Sequence
  Description of Artificial Sequence: Synthetic coding sequence
atgagccaggccaccaagagaaagcacgtggtgaaggaggtgctgggcgagcacatcgtgcccagcgaccagcagcagatcgtgagagtgctgagaacccccggcaacaacctgcacgaggtggagaccgcccagggccagagattcctggtgagcatgcccagcaagtacagaaagaacatctggatcaagagaggcgacttcctgatcgtggaccccatcgaggagggcgagaaggtgaaggccgagatcagcttcgtgctgtgcaaggaccacgtgagaagcctgcagaaggagggcttctggcccgaggccttcagcgaggtggccgagaagcacaactag

SEQ ID NO: 8043 - DNA, 342 bp, Artificial Sequence
  Description of Artificial Sequence: Synthetic coding sequence
atgagccaggccaccaagagaaagcacgtggtgaaggaggtgctgggcgagcacatcgtgcccagcgaccagcagcagatcgtgagagtgctgagaacccccggcaacaacctgcacgaggtggagaccgcccagggccagagattcctggtgagcatgcccagcaagtacagaaagaacatctggatcaagagaggcgacttcctgatcgtggaccccatcgaggagggcgagaaggtgaaggccgagatcagcttcgtgctgtgcaaggaccacgtgagaagcctgcagaaggagggcttctggcccgaggccttcagcgaggtggccgagaagcactag

SEQ ID NO: 8044 - DNA, 498 bp, Artificial Sequence; identical to SEQ ID NO: 8037
  Description of Artificial Sequence: Synthetic coding sequence

SEQ ID NO: 8045 - DNA, 1230 bp, Artificial Sequence
  Description of Artificial Sequence: Synthetic coding sequence
atggagggcgagagcaccagcgccgtgctgagcggcttcgtgctgggcgccctggccttccagcacctgaacaccgacagcgacaccgagggcttcctgctgggcgaggtgaagggcgaggccaagaacagcatcaccgacagccagatggacgacgtggaggtggtgtacaccatcgacatccagaagtacatcccctgctaccagctgttcagcttctacaacagcagcggcgaggtgaacgagcaggccctgaagaagatcctgagcaacgtgaagaagaacgtggtgggctggtacaagttcagaagacacagcgaccagatcatgaccttcagagagagactgctgcacaagaacctgcaggagcacttcagcaaccaggacctggtgttcctgctgctgacccccagcatcatcaccgagagctgcagcacccacagactggagcacagcctgtacaagccccagaagggcctgttccacagagtgcccctggtggtggccaacctgggcatgagcgagcagctgggctacaagaccgtgagcggcagctgcatgagcaccggcttcagcagagccgtgcagacccacagcagcaagttcttcgaggaggacggcagcctgaaggaggtgcacaagatcaacgagatgtacgccagcctgcaggaggagctgaagagcatctgcaagaaggtggaggacagcgagcaggccgtggacaagctggtgaaggacgtgaacagactgaagagagagatcgagaagagaagaggcgcccagatccaggccgccagagagaagaacatccagaaggacccccaggagaacatcttcctgtgccaggccctgagaaccttcttccccaacagcgagttcctgcacagctgcgtgatgagcctgaagaacagacacgtgagcaagagcagctgcaactacaaccaccacctggacgtggtggacaacctgaccctgatggtggagcacaccgacatccccgaggccagccccgccagcaccccccagatcatcaagcacaaggccctggacctggacgacagatggcagttcaagagaagcagactgctggacacccaggacaagagaagcaaggccgacaccggcagcagcaaccaggacaaggccagcaagatgagcagccccgagaccgacgaggagatcgagaagatgaagggcttcggcgagtacagcagaagccccaccttctag

SEQ ID NO: 8046 - DNA, 1083 bp, Artificial Sequence
  Description of Artificial Sequence: Synthetic coding sequence
atggacgacgtggaggtggtgtacaccatcgacatccagaagtacatcccctgctaccagctgttcagcttctacaacagcagcggcgaggtgaacgagcaggccctgaagaagatcctgagcaacgtgaagaagaacgtggtgggctggtacaagttcagaagacacagcgaccagatcatgaccttcagagagagactgctgcacaagaacctgcaggagcacttcagcaaccaggacctggtgttcctgctgctgacccccagcatcatcaccgagagctgcagcacccacagactggagcacagcctgtacaagccccagaagggcctgttccacagagtgcccctggtggtggccaacctgggcatgagcgagcagctgggctacaagaccgtgagcggcagctgcatgagcaccggcttcagcagagccgtgcagacccacagcagcaagttcttcgaggaggacggcagcctgaaggaggtgcacaagatcaacgagatgtacgccagcctgcaggaggagctgaagagcatctgcaagaaggtggaggacagcgagcaggccgtggacaagctggtgaaggacgtgaacagactgaagagagagatcgagaagagaagaggcgcccagatccaggccgccagagagaagaacatccagaaggacccccaggagaacatcttcctgtgccaggccctgagaaccttcttccccaacagcgagttcctgcacagctgcgtgatgagcctgaagaacagacacgtgagcaagagcagctgcaactacaaccaccacctggacgtggtggacaacctgaccctgatggtggagcacaccgacatccccgaggccagccccgccagcaccccccagatcatcaagcacaaggccctggacctggacgacagatggcagttcaagagaagcagactgctggacacccaggacaagagaagcaaggccgacaccggcagcagcaaccaggacaaggccagcaagatgagcagccccgagaccgacgaggagatcgagaagatgaagggcttcggcgagtacagcagaagccccaccttctag

SEQ ID NO: 8047 - DNA, 333 bp, Artificial Sequence
  Description of Artificial Sequence: Synthetic coding sequence
atggacgacgtggaggtggtgtacaccatcgacatccagaagtacatcccctgctaccagctgttcagcttctacaacagcagcggcgaggtgaacgagcaggccctgaagaagatcctgagcaacgtgaagaagaacgtggtgggctggtacaagttcagaagacacagcgaccagatcatgaccttcagagagagactgctgcacaagaacctgcaggagcacttcagcaaccaggacctggtgttcctgctgctgacccccagcatcatcaccgagagctgcagcacccacagactggagcacagcctgtacaagccccagaagggctag

SEQ ID NO: 8048 - DNA, 1338 bp, Artificial Sequence
  Description of Artificial Sequence: Synthetic coding sequence
atgagcgagctgaccaaggagctgatggagctggtgtggggcaccaagagcagccccggcctgagcgacaccatcttctgcagatggacccagggcttcgtgttcagcgagagcgagggcagcgccctggagcagttcgagggcggcccctgcgccgtgatcgcccccgtgcaggccttcctgctgaagaagctgctgttcagcagcgagaagagcagctggagagactgcagcgaggaggagcagaaggagctgctgtgccacaccctgtgcgacatcctggagagcgcctgctgcgaccacagcggcagctactgcctggtgagctggctgagaggcaagaccaccgaggagaccgccagcatcagcggcagccccgccgagagcagctgccaggtggagcacagcagcgccctggccgtggaggagctgggcttcgagagattccacgccctgatccagaagagaagcttcagaagcctgcccgagctgaaggacgccgtgctggaccagtacagcatgtggggcaacaagttcggcgtgctgctgttcctgtacagcgtgctgctgaccaagggcatcgagaacatcaagaacgagatcgaggacgccagcgagcccctgatcgaccccgtgtacggccacggcagccagagcctgatcaacctgctgctgaccggccacgccgtgagcaacgtgtgggacggcgacagagagtgcagcggcatgaagctgctgggcatccacgagcaggccgccgtgggcttcctgaccctgatggaggccctgagatactgcaaggtgggcagctacctgaagagccccaagttccccatctggatcgtgggcagcgagacccacctgaccgtgttcttcgccaaggacatggccctggtggcccccgaggcccccagcgagcaggccagaagagtgttccagacctacgaccccgaggacaacggcttcatccccgacagcctgctggaggacgtgatgaaggccctggacctggtgagcgaccccgagtacatcaacctgatgaagaacaagctggaccccgagggcctgggcatcatcctgctgggccccttcctgcaggagttcttccccgaccagggcagcagcggccccgagagcttcaccgtgtaccactacaacggcctgaagcagagcaactacaacgagaaggtgatgtacgtggagggcaccgccgtggtgatgggcttcgaggaccccatgctgcagaccgacgacacccccatcaagagatgcctgcagaccaagtggccctacatcgagctgctgtggaccaccgacagaagccccagcctgaactag

SEQ ID NO: 8049 - DNA, 453 bp, Artificial Sequence
  Description of Artificial Sequence: Synthetic coding sequence
atggccctggtggcccccgaggcccccagcgagcaggccagaagagtgttccagacctacgaccccgaggacaacggcttcatccccgacagcctgctggaggacgtgatgaaggccctggacctggtgagcgaccccgagtacatcaacctgatgaagaacaagctggaccccgagggcctgggcatcatcctgctgggccccttcctgcaggagttcttccccgaccagggcagcagcggccccgagagcttcaccgtgtaccactacaacggcctgaagcagagcaactacaacgagaaggtgatgtacgtggagggcaccgccgtggtgatgggcttcgaggaccccatgctgcagaccgacgacacccccatcaagagatgcctgcagaccaagtggccctacatcgagctgctgtggaccaccgacagaagccccagcctgaactag

SEQ ID NO: 8050 - DNA, 453 bp, Artificial Sequence; identical to SEQ ID NO: 8049
  Description of Artificial Sequence: Synthetic coding sequence

SEQ ID NO: 8051 - DNA, 549 bp, Artificial Sequence
  Description of Artificial Sequence: Synthetic coding sequence
ctgcccgagctgaaggacgccgtgctggaccagtacagcatgtggggcaacaagttcggcgtgctgctgttcctgtacagcgtgctgctgaccaagggcatcgagaacatcaagaacgagatcgaggacgccagcgagcccctgatcgaccccgtgtacggccacggcagccagagcctgatcaacctgctgctgaccggccacgccgtgagcaacgtgtgggacggcgacagagagtgcagcggcatgaagctgctgggcatccacgagcaggccgccgtgggcttcctgaccctgatggaggccctgagatactgcaaggtgggcagctacctgaagagccccaagttccccatctggatcgtgggcagcgagacccacctgaccgtgttcttcgccaaggacatggccctggtggcccccgaggcccccagcgagcaggccagaagagtgttccagacctacgaccccgaggacaacggcttcatccccgacagcctgctggaggacgtgatgaaggccctggacctggtgagcgaccccgagtag

SEQ ID NO: 8052 - DNA, 495 bp, Artificial Sequence
  Description of Artificial Sequence: Synthetic coding sequence
atgaagagattccccgccaagaagagaagcttcagaagcctgcccgagctgaaggacgccgtgctggaccagtacagcatgtggggcaacaagttcggcgtgctgctgttcctgtacagcgtgctgctgaccaagggcatcgagaacatcaagaacgagatcgaggacgccagcgagcccctgatcgaccccgtgtacggccacggcagccagagcctgatcaacctgctgctgaccggccacgccgtgagcaacgtgtgggacggcgacagagagtgcagcggcatgaagctgctgggcatccacgagcaggccgccgtgggcttcctgaccctgatggaggccctgagatactgcaaggtgggcagctacctgaagagccccaagttccccatctggatcgtgggcagcgagacccacctgaccgtgttcttcgccaaggacatggccctggtggcccccgaggcccccagcgagcaggccagaagagtgtag

SEQ ID NO: 8053 - DNA, 765 bp, Artificial Sequence
  Description of Artificial Sequence: Synthetic coding sequence
atggacggcggcgacgacggcaacctgatcatcaagaagagattcgtgagcgaggccgagctggacgagagaagaaagagaagacaggaggagtgggagaaggtgagaaagcccgaggaccccgaggagtgccccgaggaggtgtacgaccccagaagcctgtacgagagactgcaggagcagaaggacagaaagcagcaggagtacgaggagcagttcaagttcaagaacatggtgagaggcctggacgaggacgagaccaacttcctggacgaggtgagcagacagcaggagctgatcgagaagcagagaagagaggaggagctgaaggagctgaaggagtacagaaacaacctgaagaaggtgggcatcagccaggagaacaagaaggaggtggagaagaagctgaccgtgaagcccatcgagaccaagaacaagttcagccaggccaagctgctggccggcgccgtgaagcacaagagcagcgagagcggcaacagcgtgaagagactgaagcccgaccccgagcccgacgacaagaaccaggagcccagcagctgcaagagcctgggcaacaccagcctgagcggccccagcatccactgccccagcgccgccgtgtgcatcggcatcctgcccggcctgggcgcctacagcggcagcagcgacagcgagagcagcagcgacagcgagggcaccatcaacgccaccggcaagatcgtgagcagcatcttcagaaccaacaccttcctggaggccccctag

SEQ ID NO: 8054 - DNA, 765 bp, Artificial Sequence; identical to SEQ ID NO: 8053
  Description of Artificial Sequence: Synthetic coding sequence

SEQ ID NO: 8055 - DNA, 246 bp, Artificial Sequence
  Description of Artificial Sequence: Synthetic coding sequence
atggacggcggcgacgacggcaacctgatcatcaagaagagattcgtgagcgaggccgagctggacgagagaagaaagagaagacaggaggagtgggagaaggtgagaaagcccgaggaccccgaggagtgccccgaggaggtgtacgaccccagaagcctgtacgagagactgcaggagcagaaggacagaaagcagcaggagtacgaggagcagttcaagttcagcaagcagttcgacccctag

SEQ ID NO: 8056 - DNA, 1617 bp, Artificial Sequence
  Description of Artificial Sequence: Synthetic coding sequence
atgagacacgtgcaggccgagcccagccccagcagcgagcccgaggccggccccagccagccccccgtgagacagggcgccctgcagggcggcctgctgatgggctacagccccgccggcggcgccaccagccccggcgtgtaccaggtgagcatcttcagcccccccgccggcaccagcgagccccacagagccctgaagagacaggcccccagcaccgagggccccagagagctgaagagaggccccggcctgggcgccagagagggcctgccccccgaggagcccagcaccgtgggcctgctgggccccgagggccccggcctgggcctgggcgtggccagccagcacttcagccacagaggcctgtgcgtggtggagcagagaagcagcgtgaccagcagctggaccagcggcgcctggagccccccctgcccccccagcaacgccagctgcaacaccctgcacaccagagactgggccagccccgaccccggcggccagggcagcctgggcgagagccccggccccgccccccccggccagctgcacaccctggacaccgacctgcacagcctggcccagatcggcggcaagagccccgtggccggcgtgggcaacggcggcagcctgtggcccagagagagccccggcaccgccaacggccacagccccgagcacaccccccccggccccggcccccccggcccctgccccaccaagagaagactgctgcccgccggcgaggcccccgacgtgagcagcgaggaggagggccccgcccccagaagaagaagaggcagcctgggccaccccaccgccgccaacagcagcgacgccaaggccacccccttctggagccacctgctgcccggccccaaggagcccgtgctggaccccaccgactgcggccccatgggcagaagactgaagggcgccagaagactgaagctgagccccctgagaagcctgagaaagggccccggcctgctgagcccccccagcgccagccccgtgcccacccccgccgtgagcagaaccctgctgggcaacttcgaggagagcctgctgagaggcagattcgcccccagcggccacatcgagggcttcaccgccgagatcggcgccagcggcagctactgcccccagcacgtgaccctgcccgtgaccgtgaccttcttcgacgtgagcgagcagaacgcccccgcccccttcctgggcatcgtggacctgaaccccctgggcagaaagggctacagcgtgcccaaggtgggcaccgtgcaggtgaccctgttcaaccccaaccagaccgtggtgaagatgttcctggtgaccttcgacttcagcgacatgcccgccgcccacatgaccttcctgagacacagactgttcctggtgcccgtgggcgaggagggcaacgccaaccccacccacagactgctgtgctacctgctgcacctgagattcagaagcagcagaagcggcagactgagcctgcacggcgacatcagactgctgttcagcagaagaagcctggagctggacaccggcctgccctacgagctgcaggccgtgaccgaggccccccacaaccccagatacagccccctgccctag

SEQ ID NO: 8057 - DNA, 1329 bp, Artificial Sequence
  Description of Artificial Sequence: Synthetic coding sequence
atgagacacgtgcaggccgagcccagccccagcagcgagcccgaggccggccccagccagccccccgtgagacagggcgccctgcagggcggcctgctgatgggctacagccccgccggcggcgccaccagccccggcgtgtaccaggtgagcatcttcagcccccccgccggcaccagcgagccccacagagccctgaagagacaggcccccagcaccgagggccccagagagctgaagagaggccccggcctgggcgccagagagggcctgccccccgaggagcccagcaccgtgggcctgctgggccccgagggccccggcctgggcctgggcgtggccagccagcacttcagccacagaggcctgtgcgtggtggagcagagaagcagcgtgaccagcagctggaccagcggcgcctggagccccccctgcccccccagcaacgccagctgcaacaccctgcacaccagagactgggccagccccgaccccggcggccagggcagcctgggcgagagccccggccccgccccccccggccagctgcacaccctggacaccgacctgcacagcctggcccagatcggcggcaagagccccgtggccggcgtgggcaacggcggcagcctgtggcccagagagagccccggcaccgccaacggccacagccccgagcacaccccccccggccccggcccccccggcccctgccccaccaagagaagactgctgcccgccggcgaggcccccgacgtgagcagcgaggaggagggccccgcccccagaagaagaagaggcagcctgggccaccccaccgccgccaacagcagcgacgccaaggccacccccttctggagccacctgctgcccggccccaaggagcccgtgctggaccccaccgactgcggccccatgggcagaagactgaagggcgccagaagactgaagctgagccccctgagaagcctgagaaagggccccggcctgctgagcccccccagcgccagccccgtgcccacccccgccgtgagcagaaccctgctgggcaacttcgaggagagcctgctgagaggcagattcgcccccagcggccacatcgagggcttcaccgccgagatcggcgccagcggcagctactgcccccagcacgtgaccctgcccgtgaccgtgaccttcttcgacgtgagcgagcagaacgcccccgcccccttcctgggcatcgtggacctgaaccccctgggcagaaagggctacagcgtgcccaaggtgggcaccgtgcaggtgaccctgttcaaccccaaccccttcaccagccccaccctgtag

SEQ ID NO: 8058 - DNA, 1617 bp, Artificial Sequence; identical to SEQ ID NO: 8056
  Description of Artificial Sequence: Synthetic coding sequence

SEQ ID NO: 8059 - DNA, 1617 bp, Artificial Sequence; identical to SEQ ID NO: 8056
  Description of Artificial Sequence: Synthetic coding sequence

SEQ ID NO: 8060 - DNA, 702 bp, Artificial Sequence
  Description of Artificial Sequence: Synthetic coding sequence
atgggcagaagactgaagggcgccagaagactgaagctgagccccctgagaagcctgagaaagggccccggcctgctgagcccccccagcgccagccccgtgcccacccccgccgtgagcagaaccctgctgggcaacttcgaggagagcctgctgagaggcagattcgcccccagcggccacatcgagggcttcaccgccgagatcggcgccagcggcagctactgcccccagcacgtgaccctgcccgtgaccgtgaccttcttcgacgtgagcgagcagaacgcccccgcccccttcctgggcatcgtggacctgaaccccctgggcagaaagggctacagcgtgcccaaggtgggcaccgtgcaggtgaccctgttcaaccccaaccagaccgtggtgaagatgttcctggtgaccttcgacttcagcgacatgcccgccgcccacatgaccttcctgagacacagactgttcctggtgcccgtgggcgaggagggcaacgccaaccccacccacagactgctgtgctacctgctgcacctgagattcagaagcagcagaagcggcagactgagcctgcacggcgacatcagactgctgttcagcagaagaagcctggagctggacaccggcctgccctacgagctgcaggccgtgaccgaggccccccacaaccccagatacagccccctgccctag

SEQ ID NO: 8061 - DNA, 339 bp, Artificial Sequence
  Description of Artificial Sequence: Synthetic coding sequence
atggaggcctacgagcaggtgcagaagggccccctgaagctgaagggcgtggccgagctgggcgtgaccaagagaaagaagaagaagaaggacaaggacaaggccaagctgctggaggccatgggcaccagcaagaagaacgaggaggagaagagaagaggcctggacaagagaacccccgcccaggccgccttcgagaagatgcaggagaagagacagatggagagaatcctgaagaaggccagcaagacccacaagcagagagtggaggacttcaacagacacctggacaccctgaccgagcactacgacatccccaaggtgagctggaccaagtag

SEQ ID NO: 8062 - DNA, 639 bp, Artificial Sequence
  Description of Artificial Sequence: Synthetic coding sequence
atggagcccgccgtgggcggccccggccccctgatcgtgaacaacaagcagccccagcccccccccccccccccccccgccgccgcccagcccccccccggcgcccccagagccgccgccggcctgctgcccggcggcaaggccagagagttcaacagaaaccagagaaaggacagcgagggctacagcgagagccccgacctggagttcgagtacgccgacaccgacaagtgggccgccgagctgagcgagctgtacagctacaccgagggccccgagttcctgatgaacagaaagtgcttcgaggaggacttcagaatccacgtgaccgacaagaagtggaccgagctggacaccaaccagcacagaacccacgccatgagactgctggacggcctggaggtgaccgccagagagaagagactgaaggtggccagagccatcctgtacgtggcccagggcaccttcggcgagtgcagcagcgaggccgaggtgcagagctggatgagatacaacatcttcctgctgctggaggtgggcaccttcaacgccctggtggagctgctgaacatggagatcgagcactgctgcgtgagacccgccgtgagcgccctggccggcggccaggcccaggactag

SEQ ID NO: 8063 - DNA, 2514 bp, Artificial Sequence
  Description of Artificial Sequence: Synthetic coding sequence
atggagcccgccgtgggcggccccggccccctgatcgtgaacaacaagcagccccagcccccccccccccccccccccgccgccgcccagcccccccccggcgcccccagagccgccgccggcctgctgcccggcggcaaggccagagagttcaacagaaaccagagaaaggacagcgagggctacagcgagagccccgacctggagttcgagtacgccgacaccgacaagtgggccgccgagctgagcgagctgtacagctacaccgagggccccgagttcctgatgaacagaaagtgcttcgaggaggacttcagaatccacgtgaccgacaagaagtggaccgagctggacaccaaccagcacagaacccacgccatgagactgctggacggcctggaggtgaccgccagagagaagagactgaaggtggccagagccatcctgtacgtggcccagggcaccttcggcgagtgcagcagcgaggccgaggtgcagagctggatgagatacaacatcttcctgctgctggaggtgggcaccttcaacgccctggtggagctgctgaacatggagatcgacaacagcgccgcctgcagcagcgccgtgagaaagcccgccatcagcctggccgacagcaccgacctgagagtgctgctgaacatcatgtacctgatcgtggagaccgtgcaccaggagtgcgagggcgacaaggccgagtggagaaccatgagacagaccttcagagccgagctgggcagccccctgtacaacaacgagcccttcgccatcatgctgttcggcatggtgaccaagttctgcagcggccacgccccccacttccccatgaagaaggtgctgctgctgctgtggaagaccgtgctgtgcaccctgggcggcttcgaggagctgcagagcatgaaggccgagaagagaagcatcctgggcctgccccccctgcccgaggacagcatcaaggtgatcagaaacatgagagccgccagcccccccgccagcgccagcgacctgatcgagcagcagcagaagagaggcagaagagagcacaaggccctgatcaagcaggacaacctggacgccttcaacgagagagacccctacaaggccgacgacagcagagaggaggaggaggagaacgacgacgacaacagcctggagggcgagaccttccccctggagagagacgaggtgatgcccccccccctgcagcacccccagaccgacagactgacctgccccaagggcctgccctgggcccccaaggtgagagagaaggacatcgagatgttcctggagagcagcagaagcaagttcatcggctacaccctgggcagcgacaccaacaccgtggtgggcctgcccagacccatccacgagagcatcaagaccctgaagcagcacaagtacaccagcatcgccgaggtgcaggcccagatggaggaggagtacctgagaagccccctgagcggcggcgaggaggaggtggagcaggtgcccgccgagaccctgtaccagggcctgctgcccagcctgccccagtacatgatcgccctgctgaagatcctgctggccgccgcccccaccagcaaggccaagaccgacagcatcaacatcctggccgacgtgctgcccgaggagatgcccaccaccgtgctgcagagcatgaagctgggcgtggacgtgaacagacacaaggaggtgatcgtgaaggccatcagcgccgtgctgctgctgctgctgaagcacttcaagctgaaccacgtgtaccagttcgagtacatggcccagcacctggtgttcgccaactgcatccccctgatcctgaagttcttcaaccagaacatcatgagctacatcaccgccaagaacagcatcagcgtgctggactacccccactgcgtggtgcacgagctgcccgagctgaccgccgagagcctggaggccggcgacagcaaccagttctgctggagaaacctgttcagctgcatcaacctgctgagaatcctgaacaagctgaccaagtggaagcacagcagaaccatgatgctggtggtgttcaagagcgcccccatcctgaagagagccctgaaggtgaagcaggccatgatgcagctgtacgtgctgaagctgctgaaggtgcagaccaagtacctgggcagacagtggagaaagagcaacatgaagaccatgagcgccatctaccagaaggtgagacacagactgaacgacgactgggcctacggcaacgacctggacgccagaccctgggacttccaggccgaggagtgcgccctgagagccaacatcgagagattcaacgccagaagatacgacagagcccacagcaaccccgacttcctgcccgtggacaactgcctgcagagcgtgctgggccagagagtggacctgcccgaggacttccagatgaactacgacctgtggctggagagagaggtgttcagcaagcccatcagctgggaggagctgctgcagtag

SEQ ID NO: 8064 - DNA, 2229 bp, Artificial Sequence
  Description of Artificial Sequence: Synthetic coding sequence
atgaacagaaagtgcttcgaggaggacttcagaatccacgtgaccgacaagaagtggaccgagctggacaccaaccagcacagaacccacgccatgagactgctggacggcctggaggtgaccgccagagagaagagactgaaggtggccagagccatcctgtacgtggcccagggcaccttcggcgagtgcagcagcgaggccgaggtgcagagctggatgagatacaacatcttcctgctgctggaggtgggcaccttcaacgccctggtggagctgctgaacatggagatcgacaacagcgccgcctgcagcagcgccgtgagaaagcccgccatcagcctggccgacagcaccgacctgagagtgctgctgaacatcatgtacctgatcgtggagaccgtgcaccaggagtgcgagggcgacaaggccgagtggagaaccatgagacagaccttcagagccgagctgggcagccccctgtacaacaacgagcccttcgccatcatgctgttcggcatggtgaccaagttctgcagcggccacgccccccacttccccatgaagaaggtgctgctgctgctgtggaagaccgtgctgtgcaccctgggcggcttcgaggagctgcagagcatgaaggccgagaagagaagcatcctgggcctgccccccctgcccgaggacagcatcaaggtgatcagaaacatgagagccgccagcccccccgccagcgccagcgacctgatcgagcagcagcagaagagaggcagaagagagcacaaggccctgatcaagcaggacaacctggacgccttcaacgagagagacccctacaaggccgacgacagcagagaggaggaggaggagaacgacgacgacaacagcctggagggcgagaccttccccctggagagagacgaggtgatgcccccccccctgcagcacccccagaccgacagactgacctgccccaagggcctgccctgggcccccaaggtgagagagaaggacatcgagatgttcctggagagcagcagaagcaagttcatcggctacaccctgggcagcgacaccaacaccgtggtgggcctgcccagacccatccacgagagcatcaagaccctgaagcagcacaagtacaccagcatcgccgaggtgcaggcccagatggaggaggagtacctgagaagccccctgagcggcggcgaggaggaggtggagcaggtgcccgccgagaccctgtaccagggcctgctgcccagcctgccccagtacatgatcgccctgctgaagatcctgctggccgccgcccccaccagcaaggccaagaccgacagcatcaacatcctggccgacgtgctgcccgaggagatgcccaccaccgtgctgcagagcatgaagctgggcgtggacgtgaacagacacaaggaggtgatcgtgaaggccatcagcgccgtgctgctgctgctgctgaagcacttcaagctgaaccacgtgtaccagttcgagtacatggcccagcacctggtgttcgccaactgcatccccctgatcctgaagttcttcaaccagaacatcatgagctacatcaccgccaagaacagcatcagcgtgctggactacccccactgcgtggtgcacgagctgcccgagctgaccgccgagagcctggaggccggcgacagcaaccagttctgctggagaaacctgttcagctgcatcaacctgctgagaatcctgaacaagctgaccaagtggaagcacagcagaaccatgatgctggtggtgttcaagagcgcccccatcctgaagagagccctgaaggtgaagcaggccatgatgcagctgtacgtgctgaagctgctgaaggtgcagaccaagtacctgggcagacagtggagaaagagcaacatgaagaccatgagcgccatctaccagaaggtgagacacagactgaacgacgactgggcctacggcaacgacctggacgccagaccctgggacttccaggccgaggagtgcgccctgagagccaacatcgagagattcaacgccagaagatacgacagagcccacagcaaccccgacttcctgcccgtggacaactgcctgcagagcgtgctgggccagagagtggacctgcccgaggacttccagatgaactacgacctgtggctggagagagaggtgttcagcaagcccatcagctgggaggagctgctgcagtag

SEQ ID NO: 8065 - DNA, 783 bp, Artificial Sequence
  Description of Artificial Sequence: Synthetic coding sequence
atgaagagcaacatcgacaagaagttcagcgcccactacgacgccgtggaggccgagctgaagagcagcaccgtgggcctggtgaccctgaacgacatgaaggccaagcaggaggccctggtgaaggagagagagaagcagctggccaagaaggagcagagcaaggagctgcagatgaagctggagaagctgagagagaaggagagaaagaaggaggccaagagaaagatcagcagcctgagcttcaccctggaggaggaggaggagggcggcgaggaggaggaggaggccgccatgtacgaggaggagatggagagagaggagatcaccaccaagaagagaaagctgggcaagaaccccgacgtggacaccagcttcctgcccgacagagacagagaggaggaggagaacagactgagagaggagctgagacaggagtgggaggccaagcaggagaagatcaagagcgaggagatcgagatcaccttcagctactgggacggcagcggccacagaagaaccgtgaagatgagaaagggcaacaccatgcagcagttcctgcagaaggccctggagatcctgagaaaggacttcagcgagctgagaagcgccggcgtggagcagctgatgtacatcaaggaggacctgatcatcccccaccaccacagcttctacgacttcatcgtgaccaaggccagaggcaagagcggccccctgttcaacttcgacgtgcacgacgacgtgagactgctgagcgacgccaccgtggagaaggacgagtag

SEQ ID NO: 8066 - DNA, 1020 bp, Artificial Sequence
  Description of Artificial Sequence: Synthetic coding sequence
atggcccagtacaagggcgccgccagcgaggccggcagagccatgcacctgatgaagaagagagagaagcagagagagcagatggagcagatgaagcagagaatcgccgaggagaacatcatgaagagcaacatcgacaagaagttcagcgcccactacgacgccgtggaggccgagctgaagagcagcaccgtgggcctggtgaccctgaacgacatgaaggccaagcaggaggccctggtgaaggagagagagaagcagctggccaagaaggagcagagcaaggagctgcagatgaagctggagaagctgagagagaaggagagaaagaaggaggccaagagaaagatcagcagcctgagcttcaccctggaggaggaggaggagggcggcgaggaggaggaggaggccgccatgtacgaggaggagatggagagagaggagatcaccaccaagaagagaaagctgggcaagaaccccgacgtggacaccagcttcctgcccgacagagacagagaggaggaggagaacagactgagagaggagctgagacaggagtgggaggccaagcaggagaagatcaagagcgaggagatcgagatcaccttcagctactgggacggcagcggccacagaagaaccgtgaagatgagaaagggcaacaccatgcagcagttcctgcagaaggccctggagatcctgagaaaggacttcagcgagctgagaagcgccggcgtggagcagctgatgtacatcaaggaggacctgatcatcccccaccaccacagcttctacgacttcatcgtgaccaaggccagaggcaagagcggccccctgttcaacttcgacgtgcacgacgacgtgagactgctgagcgacgccaccgtggagaaggacgagagccacgccggcaaggtggtgctgagaagctggtacgagaagaacaagcacatcttccccgccagcagatgggagccctacgaccccgagaagaagtgggacaagtacaccatcagatag

SEQ ID NO: 8067 - DNA, 1197 bp, Artificial Sequence
  Description of Artificial Sequence: Synthetic coding sequence
atggtgaccctgatcaccgagaagctgcagagccagagcctggacgacctgacctgcaaggccgaggccggccccctgcagtacagcgccgagaccctgaacaagagcggcagactgttccccctggagctgaacgaccagagcccctggaaggtgttcagcggcggcccccccgtgagaagccaggccgccaccggccccgacttcagcttcctgcccggcctgagcgccgccgcccacaccatgggcctgcagtggcagccccagagccccagacccggcgccggcctgggcgccgccagcaccgtggaccccagcgagagcaccggcagcagcaccgccccccccaccaagagacactgcagaagcctgagcgagcccgaggagctggtgagatgcagaagcccctggagacccggcagcagcaaggtgtggacccccgtgagcaagagaagatgcgacagcggcggcagcgccaccagacagggcagccccggcgccgtgctgcccagaagcgccgtgtggagcaccggccccaccagccccgccacccccagacccagcagcgccagcggcggcttcgtggacagcagcgagggcagcgccggcagcggccccctgtggtgcagcgccgagagctgcctgcccagcaccagaagaagacccagcctgagccaggagagactggccggcgccggcacccccctgccctgggccagcagcagccccaccagcacccccgccctgggcggcagaagaggcctgctgagatgcagaagccagccctgcgtgctgagcggcaagagaagcagaagaaagagaagaagagaggaggacgccagatggaccagacccagcctggacttcctgaagatgacccagaccctgaagaacagcaagagcctgtgcagcctgaactacgaggacgacgacgaggacgacacccccgtgaagaccgtgctgagcagcccctgcgacagcagaggcctgcccggcatcaccatgcccggctgcagccagagaggcctgagaaccagccccgtgcaccccaacctgtgggccagcagagagagcgtgaccagcgacggcagcagaagaagcagcggcgaccccagagacggcgacagcgtgggcgaggagggcgtgttccccagagccagatgggagctggacctggagcagatcgagaacaactag

SEQ ID NO: 8068 - DNA, 1197 bp, Artificial Sequence; identical to SEQ ID NO: 8067
  Description of Artificial Sequence: Synthetic coding sequence

SEQ ID NO: 8069 - DNA, 327 bp, Artificial Sequence
  Description of Artificial Sequence: Synthetic coding sequence
atggtgaccctgatcaccgagaagctgcagagccagagcctggacgacctgacctgcaaggccgaggccggccccctgcagtacagcgccgagaccctgaacaagagcggcagactgttccccctggagctgaacgaccagagcccctggaaggtgttcagcggcggcccccccgtgagaagccaggccgccaccggccccgacttcagcttcctgcccggcctgagcgccgccgcccacaccatgggcctgcagtggcagccccagagccccagacccggcgccggcctgggcgccgccagcaccgtggaccccagcgagagctag

SEQ ID NO: 8070 - DNA, 1197 bp, Artificial Sequence; identical to SEQ ID NO: 8067
  Description of Artificial Sequence: Synthetic coding sequence

SEQ ID NO: 8071 - DNA, 717 bp, Artificial Sequence
  Description of Artificial Sequence: Synthetic coding sequence
atggccagcagatggcagaacatgggcaccagcgtgagaagaagaagcctgcagcaccaggagcagctggaggacagcaaggagctgcagcccgtggtgagccaccaggagaccagcgtgggcgccctgggcagcctgtgcagacagttccagagaagactgcccctgagagccgtgaacctgaacctgagagccggccccagctggaagagactggagacccccgagcccggccagcagggcctgcaggccgccgccagaagcgccaagagcgccctgggcgccgtgagccagagaatccaggagagctgccagagcggcaccaagtggctggtggagacccaggtgaaggccagaagaagaaagagaggcgcccagaagggcagcggcagccccacccacagcctgagccagaagagcaccagactgagcggcgccgcccccgcccacagcgccgccgacccctgggagaaggagcaccacagactgagcgtgagaatgggcagccacgcccaccccctgagaagaagcagaagagaggccgccttcagaagcccctacagcagcaccgagcccctgtgcagccccagcgagagcgacagcgacctggagcccgtgggcgccggcatccagcacctgcagaagctgagccaggagctggacgaggccatcatggccgaggagagcggcgacatcgtgagcctgatccacgactag

SEQ ID NO: 8072 - DNA, 747 bp, Artificial Sequence
  Description of Artificial Sequence: Synthetic coding sequence
atggccagcagatggcagaacatgggcaccagcgtgagaagaagaagcctgcagcaccaggagcagctggaggacagcaaggagctgcagcccgtggtgagccaccaggagaccagcgtgggcgccctgggcagcctgtgcagacagttccagagaagactgcccctgagagccgtgaacctgaacctgagagccggccccagctggaagagactggagacccccgagcccggccagcagggcctgcaggccgccgccagaagcgccaagagcgccctgggcgccgtgagccagagaatccaggagagctgccagagcggcaccaagtggctggtggagacccaggtgaaggccagaagaagaaagagaggcgcccagaagggcagcggcagccccacccacagcctgagccagaagagcaccagactgagcggcgccgcccccgcccacagcgccgccgacccctgggagaaggagcaccacagactgagcgtgagaatgggcagccacgcccaccccctgagaagaagcagaagagaggccgccttcagaagcccctacagcagcaccgagcccctgtgcagccccagcgagagcgacagcgacctggagcccgtgggcgccggcatccagcacctgcagaagctgagccaggagctggacgaggccatcatggccgaggagagaaagcaggccctgagcgacagacagggcttcatcctgaaggacgtgtacgccagcccctag

SEQ ID NO: 8073 - DNA, 717 bp, Artificial Sequence; identical to SEQ ID NO: 8071
  Description of Artificial Sequence: Synthetic coding sequence

SEQ ID NO: 8074 - DNA, 1818 bp, Artificial Sequence
  Description of Artificial Sequence: Synthetic coding sequence
atgagcaacgagagctgcctgccctactacaccgcccacagctacagcagcatgagcgccttcaagaccagcatgggcgacctgcagagacagctgtacaacagaggcgagtacaacatcttcaagtacgcccccatgttcgagagcaacttcatccagatcaacaagaagggcgaggtgatcgacgtgcacaacagagtgagaatggtgaccgtgggcatcgtgtgcaccagccccatcctgcccctgcccgacgtgatggtgctggcccagcccaccaagatctgcgagcagcacgtgagatggggcagattcgccaagggcagaggcagaagacccgtgaagaccctggagctgaccagactgctgcccctgaagttcgtgaagatcagcatccacgaccacgagaagcagcagctgagactgaagctggccaccggcagaaccttctacctgcagctgtgccccagcagcgacaccagagaggacctgttctgctactgggagaagctggtgtacctgctgagaccccccgtggagagctactgcagcacccccaccctgctgagcggcgacgccccccccgaggacaacaagagcctggtggccgccgagctgcacagagagggcgaccagagcgagaccggcctgtacaagccctgcgacgtgagcgccgccaccagcagcgcctacgccggcggcgagggcatccagcacgccagccacggcaccgccagcgccgccagccccagcaccagcacccccggcgccgccgagggcggcgccgccagaaccgccggcggcatggccgtggccggcaccgccaccggccccagaaccgacgtggccatcgccggcgccgccatgagccccgccaccggcgccatgagcatcgccaccaccaagagcgccggccccggccaggtgaccaccgccctggccggcgccgccatcaagaaccccggcgagaacgagagcagcaagagcatggccggcgccgccaacatcagcagcgagggcatcagcctggccctggtgggcgccgccagcaccagcctggagggcaccagcaccagcatggccggcgccgccagcctgagccaggacagcagcctgagcgccgccttcgccggcagcatcaccaccagcaagtgcgccgccgagagaaccgagggccccgccgtgggccccctgatcagcaccctgcagagcgagggctacatgagcgagagagacggcagccagaaggtgagccagcccagcgccgaggtgtggaacgagaacaaggagagaagagagaagaaggacagacaccccagcagaaagagcagccaccacagaaaggccggcgagagccacagaagaagagccggcgacaagaaccagaaggccagcagccacagaagcgccagcggccacaagaacaccagagacgacaagaaggagaagggctacagcaacgtgagaggcaagagacacggcagcagcagaaagagcagcacccacagcagcaccaagaaggagagcagaaccacccaggagctgggcaagaaccagagcgccagcagcaccggcgccctgcagaagaaggccagcaagatcagcagcttcctgagaagcctgagagccacccccggcagcaagaccagagtgaccagccacgacagagaggtggacatcgtggccaagatggtggagaagcagaacatcgaggccaaggtggagaaggcccagggcggccaggagctggagatgatcagcggcaccatgaccagcgagaagaccgagatgatcgtgttcgagaccaagagcatctag

SEQ ID NO: 8075 - DNA, 3054 bp, Artificial Sequence
  Description of Artificial Sequence: Synthetic coding sequence
atgatgagcgagggcaagccccccgacaagaagagacccagaagaagcctgagcatcagcaagaacaagaagaaggccagcaacagcatcatcagctgcttcaacaacgccccccccgccaagctggcctgccccgtgtgcagcaagatggtgcccagatacgacctgaacagacacctggacgagatgtgcgccaacaacgacttcgtgcaggtggaccccggccaggtgggcctgatcaacagcaacgtgagcatggtggacctgaccagcgtgaccctggaggacgtgacccccaagaagagccccccccccaagaccaacctgacccccggccagagcgacagcgccaagagagaggtgaagcagaagatcagcccctacttcaagagcaacgacgtggtgtgcaagaaccaggacgagctgagaaacagaagcgtgaaggtgatctgcctgggcagcctggccagcaagctgagcagaaagtacgtgaaggccaagaagagcatcgacaaggacgaggagttcgccggcagcagcccccagagcagcaagagcaccgtggtgaagagcctgatcgacaacagcagcgagatcgaggacgaggaccagatcctggagaacagcagccagaaggagaacgtgttcaagtgcgacagcctgaaggaggagtgcatccccgagcacatggtgagaggcagcaagatcatggaggccgagagccagaaggccaccagagagtgcgagaagagcgccctgacccccggcttcagcgacaacgccatcatgctgttcagccccgacttcaccctgagaaacaccctgaagagcaccagcgaggacagcctggtgaagcaggagtgcatcaaggaggtggtggagaagagagaggcctgccactgcgaggaggtgaagatgaccgtggccagcgaggccaagatccagctgagcgacagcgaggccaagagccacagcagcgccgacgacgccagcgcctggagcaacatccaggaggcccccctgcaggacgacagctgcctgaacaacgacatcccccacagcatccccctggagcagggcagcagctgcaacggccccggccagaccaccggccacccctactacctgagaagcttcctggtggtgctgaagaccgtgctggagaacgaggacgacatgctgctgttcgacgagcaggagaagggcatcgtgaccaagttctaccagctgagcgccaccggccagaagctgtacgtgagactgttccagagaaagctgagctggatcaagatgaccaagctggagtacgaggagatcgccctggacctgacccccgtgatcgaggagctgaccaacgccggcttcctgcagaccgagagcgagctgcaggagctgagcgaggtgctggagctgctgagcgcccccgagctgaagagcctggccaagaccttccacctggtgaaccccaacggccagaagcagcagctggtggacgccttcctgaagctggccaagcagagaagcgtgtgcacctggggcaagaacaagcccggcatcggcgccgtgatcctgaagagagccaaggccctggccggccagagcgtgagaatctgcaagggccccagagccgtgttcagcagaatcctgctgctgttcagcctgaccgacagcatggaggacgaggacgccgcctgcggcggccagggccagctgagcaccgtgctgctggtgaacctgggcagaatggagttccccagctacaccatcaacagaaagacccacatcttccaggacagagacgacctgatcagatacgccgccgccacccacatgctgagcgacatcagcagcgccatggccaacggcaactgggaggaggccaaggagctggcccagtgcgccaagagagactggaacagactgaagaaccaccccagcctgagatgccacgaggacctgcccctgttcctgagatgcttcaccgtgggctggatctacaccagaatcctgagcagattcgtggagatcctgcagagactgcacatgtacgaggaggccgtgagagagctggagagcctgctgagccagagaatctactgccccgacagcagaggcagatggtgggacagactggccctgaacctgcaccagcacctgaagagactggagcccaccatcaagtgcatcaccgagggcctggccgaccccgaggtgagaaccggccacagactgagcctgtaccagagagccgtgagactgagagagagccccagctgcaagaagttcaagcacctgttccagcagctgcccgagatggccgtgcaggacgtgaagcacgtgaccatcaccggcagactgtgcccccagagaggcatgtgcaagagcgtgttcgtgatggaggccggcgaggccgccgaccccaccaccgtgctgtgcagcgtggaggagctggccctggcccactacagaagaagcggcttcgaccagggcatccacggcgagggcagcaccttcagcaccctgtacggcctgctgctgtgggacatcatcttcatggacggcatccccgacgtgttcagaaacgcctgccaggccttccccctggacctgtgcaccgacagcttcttcaccagcagaagacccgccctggaggccagactgcagctgatccacgacgcccccgaggagagcctgagagcctgggtggccgccacctggcacgagcaggagggcagagtggccagcctggtgagctgggacagattcaccagcctgcagcaggcccaggacctggtgagctgcctgggcggccccgtgctgagcggcgtgtgcagacacctggccgccgacttcagacactgcagaggcggcctgcccgacctggtggtgtggaacagccagagcagacacttcaagctggtggaggtgaagggccccaacgacagactgagccacaagcagatgatctggctggccgagctgcagaagctgggcgccgaggtggaggtgtgccacgtggtggccgtgggcgccaagagccagagcctgagctag

SEQ ID NO: 8076 - DNA, 1602 bp, Artificial Sequence
  Description of Artificial Sequence: Synthetic coding sequence
atgatgagcgagggcaagccccccgacaagaagagacccagaagaagcctgagcatcagcaagaacaagaagaaggccagcaacagcatcatcagctgcttcaacaacgccccccccgccaagctggcctgccccgtgtgcagcaagatggtgcccagatacgacctgaacagacacctggacgagatgtgcgccaacaacgacttcgtgcaggtggaccccggccaggtgggcctgatcaacagcaacgtgagcatggtggacctgaccagcgtgaccctggaggacgtgacccccaagaagagccccccccccaagaccaacctgacccccggccagagcgacagcgccaagagagaggtgaagcagaagatcagcccctacttcaagagcaacgacgtggtgtgcaagaaccaggacgagctgagaaacagaagcgtgaaggtgatctgcctgggcagcctggccagcaagctgagcagaaagtacgtgaaggccaagaagagcatcgacaaggacgaggagttcgccggcagcagcccccagagcagcaagagcaccgtggtgaagagcctgatcgacaacagcagcgagatcgaggacgaggaccagatcctggagaacagcagccagaaggagaacgtgttcaagtgcgacagcctgaaggaggagtgcatccccgagcacatggtgagaggcagcaagatcatggaggccgagagccagaaggccaccagagagtgcgagaagagcgccctgacccccggcttcagcgacaacgccatcatgctgttcagccccgacttcaccctgagaaacaccctgaagagcaccagcgaggacagcctggtgaagcaggagtgcatcaaggaggtggtggagaagagagaggcctgccactgcgaggaggtgaagatgaccgtggccagcgaggccaagatccagctgagcgacagcgaggccaagagccacagcagcgccgacgacgccagcgcctggagcaacatccaggaggcccccctgcaggacgacagctgcctgaacaacgacatcccccacagcatccccctggagcagggcagcagctgcaacggccccggccagaccaccggccacccctactacctgagaagcttcctggtggtgctgaagaccgtgctggagaacgaggacgacatgctgctgttcgacgagcaggagaagggcatcgtgaccaagttctaccagctgagcgccaccggccagaagctgtacgtgagactgttccagagaaagctgagctggatcaagatgaccaagctggagtacgaggagatcgccctggacctgacccccgtgatcgaggagctgaccaacgccggcttcctgcagaccgagagcgagctgcaggagctgagcgaggtgctggagctgctgagcgcccccgagctgaagagcctggccaagaccttccacctggtgaaccccaacggccagaagcagcagctggtggacgccttcctgaagctggccaagcagagaagcgtgtgcacctggggcaagaacaagcccggcatcggcgccgtgatcctgaagagattctgctggctgctgctgcagtag

SEQ ID NO: 8077 - DNA, 1719 bp, Artificial Sequence
  Description of Artificial Sequence: Synthetic coding sequence
atggccgagctggtgcagggccagagcgcccccgtgggcatgaaggccgagggcttcgtggacgccctgcacagagtgagacagatcgccgccaagatcgacagcatcccccacctgaacaacagcacccccctggtggaccccagcgtgtacggctacggcgtgcagaagagacccctggacgacggcgtgggcaaccagctgggcgccctggtgcaccagagaaccgtgatcaccgaggagttcaaggtgcccgacaagatggtgggcttcatcatcggcagaggcggcgagcagatcagcagaatccaggccgagagcggctgcaagatccagatcgccagcgagagcagcggcatccccgagagaccctgcgtgctgaccggcacccccgagagcatcgagcaggccaagagactgctgggccagatcgtggacagatgcagaaacggccccggcttccacaacgacatcgacagcaacagcaccatccaggagatcctgatccccgccagcaaggtgggcctggtgatcggcagaggcggcgagaccatcaagcagctgcaggagagaaccggcgtgaagatggtgatgatccaggacggccccctgcccaccggcgccgacaagcccctgagaatcaccggcgacgccttcaaggtgcagcaggccagagagatggtgctggagatcatcagagagaaggaccaggccgacttcagaggcgtgagaggcgacttcaacagcagaatgggcggcggcagcatcgaggtgagcgtgcccagattcgccgtgggcatcgtgatcggcagaaacggcgagatgatcaagaagatccagaacgacgccggcgtgagaatccagttcaagcccgacgacggcatcagccccgagagagccgcccaggtgatgggcccccccgacagatgccagcacgccgcccacatcatcagcgagctgatcctgaccgcccaggagagagacggcttcggcggcctggccgccgccagaggcagaggcagaggcagaggcgactggagcgtgggcgcccccggcggcgtgcaggagatcacctacaccgtgcccgccgacaagtgcggcctggtgatcggcaagggcggcgagaacatcaagagcatcaaccagcagagcggcgcccacgtggagctgcagagaaaccccccccccaacagcgaccccaacctgagaagattcaccatcagaggcgtgccccagcagatcgaggtggccagacagctgatcgacgagaaggtgggcggcaccaacctgggcgcccccggcgccttcggccagagccccttcagccagccccccgcccccccccaccagaacaccttcccccccagaagcagcggctgcttccccaacatggccgccaaggtgaacggcaacccccacagcacccccgtgagcggcccccccgccttcctgacccagggctggggcagcacctaccaggcctggcagcagcccacccagcaggtgcccagccagcagagccagccccagagcagccagcccaactacagcaaggcctgggaggactactacaagaagcagagccacgccgccagcgccgccccccaggccagcagcccccccgactacaccatggcctgggccgagtactacagacagcaggtggccttctacggccagaccctgggccaggcccaggcccacagccaggagcagtag

SEQ ID NO: 8078 - DNA, 927 bp, Artificial Sequence
  Description of Artificial Sequence: Synthetic coding sequence
atgaaggccgagggcttcgtggacgccctgcacagagtgagacagatcgccgccaagatcgacagcatcccccacctgaacaacagcacccccctggtggaccccagcgtgtacggctacggcgtgcagaagagacccctggacgacggcgtgggcaaccagctgggcgccctggtgcaccagagaaccgtgatcaccgaggagttcaaggtgcccgacaagatggtgggcttcatcatcggcagaggcggcgagcagatcagcagaatccaggccgagagcggctgcaagatccagatcgccagcgagagcagcggcatccccgagagaccctgcgtgctgaccggcacccccgagagcatcgagcaggccaagagactgctgggccagatcgtggacagatgcagaaacggccccggcttccacaacgacatcgacagcaacagcaccatccaggagatcctgatccccgccagcaaggtgggcctggtgatcggcagaggcggcgagaccatcaagcagctgcaggagagaaccggcgtgaagatggtgatgatccaggacggccccctgcccaccggcgccgacaagcccctgagaatcaccggcgacgccttcaaggtgcagcaggccagagagatggtgctggagatcatcagagagaaggaccaggccgacttcagaggcgtgagaggcgacttcaacagcagaatgggcggcggcagcatcgaggtgagcgtgcccagattcgccgtgggcatcgtgatcggcagaaacggcgagatgatcaagaagatccagaacgacgccggcgtgagaatccagttcaagcccgacgacggcatcagccccgagtactacagacagcaggtggccttctacggccagaccctgggccaggcccaggcccacagccaggacgagtag

SEQ ID NO: 8079 - DNA, 786 bp, Artificial Sequence
  Description of Artificial Sequence: Synthetic coding sequence
atgccccccatcggcaaccagctgggcgccctggtgcaccagagaaccgtgatcaccgaggagttcaaggtgcccgacaagatggtgggcttcatcatcggcagaggcggcgagcagatcagcagaatccaggccgagagcggctgcaagatccagatcgccagcgagagcagcggcatccccgagagaccctgcgtgctgaccggcacccccgagagcatcgagcaggccaagagactgctgggccagatcgtggacagatgcagaaacggccccggcttccacaacgacatcgacagcaacagcaccatccaggagatcctgatccccgccagcaaggtgggcctggtgatcggcagaggcggcgagaccatcaagcagctgcaggagagaaccggcgtgaagatggtgatgatccaggacggccccctgcccaccggcgccgacaagcccctgagaatcaccggcgacgccttcaaggtgcagcaggccagagagatggtgctggagatcatcagagagaaggaccaggccgacttcagaggcgtgagaggcgacttcaacagcagaatgggcggcggcagcatcgaggtgagcgtgcccagattcgccgtgggcatcgtgatcggcagaaacggcgagatgatcaagaagatccagaacgacgccggcgtgagaatccagttcaagcccgacgacggcatcagccccgagtactacagacagcaggtggccttctacggccagaccctgggccaggcccaggcccacagccaggagcagtag

SEQ ID NO: 8080 - DNA, 597 bp, Artificial Sequence
  Description of Artificial Sequence: Synthetic coding sequence
atgggcaagcagaagaagaccagaaagtacgccaccatgaagagaatgctgagcctgagagaccagagactgaaggagaaggacagactgaagcccaagaagaaggagaagaaggaccccagcgccctgaaggagagagaggtgccccagcaccccagctgcctgttcttccagtacaacacccagctgggccccccctaccacatcctggtggacaccaacttcatcaacttcagcatcaaggccaagctggacctggtgcagagcatgatggactgcctgtacgccaagtgcatcccctgcatcaccgactgcgtgatggccgagatcgagaagctgggccagaagtacagagtggccctgagaatcgccaaggaccccagattcgagagactgccctgcacccacaagggcacctacgccgacgactgcctggtgcagagagtgacccagcacaagtgctacatcgtggccaccgtggacagagacctgaagagaagaatcagaaagatccccggcgtgcccatcatgtacatcagcaaccacagatacaacatcgagagaatgcccgacgactacggcgcccccagattctag

SEQ ID NO: 8081 - DNA, 501 bp, Artificial Sequence
  Description of Artificial Sequence: Synthetic coding sequence
atggccgcctaccccgagagctgcgtggacaccaccgtgctggacttcgtggccgacctgagcctggccagccccagaagacccctgctgtgcgacttcgcccccggcgtgagcctgggcgaccccgccctggccctgagagagggcagacccagaagaatggccagattcgaggagggcgaccccgaggaggaggagtgcgaggtggaccagggcgacggcgaggaggaggaggaggaggagagaggcagaggcgtgagcctgctgggcagacccaagagaaagagagtgatcacctacgcccagagacaggccgccaacatcagagagagaaagagaatgttcaacctgaacgaggccttcgaccagctgagaagaaaggtgcccaccttcgcctacgagaagagactgagcagaatcgagaccctgagactggccatcgtgtacatcagcttcatgaccgagctgctggagagctgcgagaagaaggagagcggctag

SEQ ID NO: 8082 - DNA, 2280 bp, Artificial Sequence
  Description of Artificial Sequence: Synthetic coding sequence
atgatcagcagcaccagcgtgtacggcctgaagatgcagtggacccccgagcacgcccagtggcccgagcagcacttcgacatcaccagcaccaccagaagccccgcccacaaggtggaggcctacagaggccacctgcagagaacctaccagtacgcctgggccaacgacgacatcagcgccctgaccgccagcaacctgctgaagaagtacgccgagaagtacagcggcatcctggagggccccgtggacagacccgtgctgagcaactacagcgacacccccagcggcctggtgaacggcagaaagaacgagagcgagccctggcagcccagcctgaacagcgaggccgtgtaccccatgaactgcgtgcccgacgtgatcaccgccagcaaggccggcgtgagcagcgccctgccccccgccgacgtgagcgccagcatcggcagcagccccggcgtggccagcaacctgaccgagcccagctacagcagcagcacctgcggcagccacaccgtgcccagcctgcacgccggcctgcccagccaggagtacgcccccggctacaacggcagctacctgcacagcacctacagcagccagcccgcccccgccctgcccagcccccaccccagccccctgcacagcagcggcctgctgcagcccccccccccccccccccccccccccgccctggtgcccggctacaacggcaccagcaacctgagcagctacagctaccccagcgccagctaccccccccagaccgccgtgggcagcggctacagccccggcggcgccccccccccccccagcgcctacctgcccagcggcatccccgcccccacccccctgccccccaccaccgtgcccggctacacctaccagggccacggcctgacccccatcgcccccagcgccctgaccaacagcagcgccagcagcctgaagagaaaggccttctacatggccggccagggcgacatggacagcagctacggcaactacagctacggccagcagagaagcacccagagccccatgtacagaatgcccgacaacagcatcagcaacaccaacagaggcaacggcttcgacagaagcgccgagaccagcagcctggccttcaagcccaccaagcagctgatgagcagcgagcagcagagaaagttcagcagccagagcagcagagccctgaccccccccagctacagcaccgccaagaacagcctgggcagcagaagcagcgagagcttcggcaagtacaccagccccgtgatgagcgagcacggcgacgagcacagacagctgctgagccaccccatgcagggccccggcctgagagccgccaccagcagcaaccacagcgtggacgagcagctgaagaacaccgacacccacctgatcgacctggtgaccaacgagatcatcacccagggcccccccgtggactggaacgacatcgccggcctggacctggtgaaggccgtgatcaaggaggaggtgctgtggcccgtgctgagaagcgacgccttcagcggcctgaccgccctgcccagaagcatcctgctgttcggccccagaggcaccggcaagaccctgctgggcagatgcatcgccagccagctgggcgccaccttcttcaagatcgccggcagcggcctggtggccaagtggctgggcgaggccgagaagatcatccacgccagcttcctggtggccagatgcagacagcccagcgtgatcttcgtgagcgacatcgacatgctgctgagcagccaggtgaacgaggagcacagccccgtgagcagaatgagaaccgagttcctgatgcagctggacaccgtgctgaccagcgccgaggaccagatcgtggtgatctgcgccaccagcaagcccgaggagatcgacgagagcctgagaagatacttcatgaagagactgctgatccccctgcccgacagcaccgccagacaccagatcatcgtgcagctgctgagccagcacaactactgcctgaacgacaaggagttcgccctgctggtgcagagaaccgagggcttcagcggcctggacgtggcccacctgtgccaggaggccgtggtgggccccctgcacgccatgcccgccaccgacctgagcgccatcatgcccagccagctgagacccgtgacctaccaggacttcgagaacgccttctgcaagatccagcccagcatcagccagaaggagctggacatgtacgtggagtggaacaagatgttcggctgcagccagtag

SEQ ID NO: 8083 - DNA, 1050 bp, Artificial Sequence
  Description of Artificial Sequence: Synthetic coding sequence
atggagaccccccccgtgaacaccatcggcgagaaggacaccagccagccccagcaggagtgggagaagaacctgagagagaacctggacagcgtgatccagatcagacagcagcccagagacccccccaccgagaccctggagctggaggtgagccccgaccccgccagccagatcctggagcacacccagggcgccgagaagctggtggccgagctggagggcgacagccacaagagccacggcagcaccagccagatgcccgaggccctgcaggccagcgacctgtggtactgccccgacggcagcttcgtgaagaagatcgtgatcagaggccacggcctggacaagcccaagctgggcagctgctgcagagtgctggccctgggcttccccttcggcagcggcccccccgagggctggaccgagctgaccatgggcgtgggcccctggagagaggagacctggggcgagctgatcgagaagtgcctggagagcatgtgccagggcgaggaggccgagctgcagctgcccggccacagcggcccccccgtgagactgaccctggccagcttcacccagggcagagacagctgggagctggagaccagcgagaaggaggccctggccagagaggagagagccagaggcaccgagctgttcagagccggcaaccccgagggcgccgccagatgctacggcagagccctgagactgctgctgaccctgcccccccccggcccccccgagagaaccgtgctgcacgccaacctggccgcctgccagctgctgctgggccagccccagctggccgcccagagctgcgacagagtgctggagagagagcccggccacctgaaggccctgtacagaagaggcgtggcccaggccgccctgggcaacctggagaaggccaccgccgacctgaagaaggtgctggccatcgaccccaagaacagagccgcccaggaggagctgggcaaggtggtgatccagggcaagaaccaggacgccggcctggcccagggcctgagaaagatgttcggctag

SEQ ID NO: 8084 - DNA, 1050 bp, Artificial Sequence; identical to SEQ ID NO: 8083
  Description of Artificial Sequence: Synthetic coding sequence

SEQ ID NO: 8085 - DNA, 1050 bp, Artificial Sequence; identical to SEQ ID NO: 8083
  Description of Artificial Sequence: Synthetic coding sequence

SEQ ID NO: 8086 - DNA, 2151 bp, Artificial Sequence
  Description of Artificial Sequence: Synthetic coding sequence
atgcccctgcccgagcccagcgagcaggagggcgagagcgtgaaggccggccaggagcccagccccaagcccggcaccgacgtgatccccgccgcccccagaaagcccagagagttcagcaagctggtgctgctgaccgccagcgaccaggacgaggacggcgtgggcagcaagccccaggaggtgcactgcgtgctgagcctggagatggccggccccgccaccctggccagcaccctgcagatcctgcccgtggaggagcagggcggcgtggtgcagcccgccctggagatgcccgagcagaagtgcagcaagctggacgccgccgccccccagagcctggagttcctgagaacccccttcggcggcagactgctggtgctggagagcttcctgtacaagcaggagaaggccgtgggcgacaaggtgtactggaagtgcagacagcacgccgagctgggctgcagaggcagagccatcaccagaggcctgagagccaccgtgatgagaggccactgccacgcccccgacgagcagggcctggaggccagaagacagagagagaagctgcccagcctggccctgcccgagggcctgggcgagccccagggccccgagggccccggcggcagagtggaggagcccctggagggcgtgggcccctggcagtgccccgaggagcccgagcccacccccggcctggtgctgagcaagcccgccctggaggaggaggaggcccccagagccctgagcctgctgagcctgccccccaagaagagaagcatcctgggcctgggccaggccagacccctggagttcctgagaacctgctacggcggcagcttcctggtgcacgagagcttcctgtacaagagagagaaggccgtgggcgacaaggtgtactggacctgcagagaccacgccctgcacggctgcagaagcagagccatcacccagggccagagagtgaccgtgatgagaggccactgccaccagcccgacatggagggcctggaggccagaagacagcaggagaaggccgtggagaccctgcaggccggccaggacggccccggcagccaggtggacaccctgctgagaggcgtggacagcctgctgtacagaagaggccccggccccctgaccctgaccagacccagacccagaaagagagccaaggtggaggaccaggagctgcccacccagcccgaggcccccgacgagcaccaggacatggacgccgaccccggcggccccgagttcctgaagacccccctgggcggcagcttcctggtgtacgagagcttcctgtacagaagagagaaggccgccggcgagaaggtgtactggacctgcagagaccaggccagaatgggctgcagaagcagagccatcacccagggcagaagagtgaccgtgatgagaggccactgccacccccccgacctgggcggcctggaggccctgagacagagagagaagagacccaacaccgcccagagaggcagccccggcggccccgagttcctgaagacccccctgggcggcagcttcctggtgtacgagagcttcctgtacagaagagagaaggccgccggcgagaaggtgtactggacctgcagagaccaggccagaatgggctgcagaagcagagccatcacccagggcagaagagtgatggtgatgagaagacactgccacccccccgacctgggcggcctggaggccctgagacagagagagcacttccccaacctggcccagtgggacagccccgaccccctgagacccctggagttcctgagaaccagcctgggcggcagattcctggtgcacgagagcttcctgtacagaaaggagaaggccgccggcgagaaggtgtactggatgtgcagagaccaggccagactgggctgcagaagcagagccatcacccagggccacagaatcatggtgatgagaagccactgccaccagcccgacctggccggcctggaggccctgagacagagagagagactgcccaccaccgcccagcaggaggaccccgagaagatccaggtgcagctgtgcttcaagacctgcagccccgagagccagcagatctacggcgacatcaaggacgtgagactggacggcgagagccagtag

SEQ ID NO: 8087 - DNA, 987 bp, Artificial Sequence
  Description of Artificial Sequence: Synthetic coding sequence
atgccccaggccaccagcccccccctgtggcccctgagcctgcacggcggcaagggcatcctgtgggccagacacagccacccccccggcccccccagccaccacatccaggacagcggcagatgcagcctgcccctgccccagagccccggcgtgacccccctgcccgccagactgagcggcgccacccccctgagccccatcagactgctgagcagcttcgtgcccagaggccccagagtgatccccctgaccaaccaggccagaagaaccctgcacgccagcctgggcggctgctggggcagaaccagcgacgccgccgacaccgccagcctgaaggcctggcagggcggccccgagttcctgaagacccccctgggcggcagcttcctggtgtacgagagcttcctgtacagaagagagaaggccgccggcgagaaggtgtactggacctgcagagaccaggccagaatgggctgcagaagcagagccatcacccagggcagaagagtgatggtgatgagaagacactgccacccccccgacctgggcggcctggaggccctgagacagagagagcacttccccaacctggcccagtgggacagccccgaccccctgagacccctggagttcctgagaaccagcctgggcggcagattcctggtgcacgagagcttcctgtacagaaaggagaaggccgccggcgagaaggtgtactggatgtgcagagaccaggccagactgggctgcagaagcagagccatcacccagggccacagaatcatggtgatgagaagccactgccaccagcccgacctggccggcctggaggccctgagacagagagagagactgcccaccaccgcccagcaggaggaccccgagaagatccaggtgcagctgtgcttcaagacctgcagccccgagagccagcagatctacggcgacatcaaggacgtgagactggacggcgagagccagtag

SEQ ID NO: 8088 - DNA, 2298 bp, Artificial Sequence
  Description of Artificial Sequence: Synthetic coding sequence
atgcccctgcccgagcccagcgagcaggagggcgagagcgtgaaggccggccaggagcccagccccaagcccggcaccgacgtgatccccgccgcccccagaaagcccagagagttcagcaagctggtgctgctgaccgccagcgaccaggacgaggacggcgtgggcagcaagccccaggaggtgcactgcgtgctgagcctggagatggccggccccgccaccctggccagcaccctgcagatcctgcccgtggaggagcagggcggcgtggtgcagcccgccctggagatgcccgagcagaagtgcagcaagctggacgccgccgccccccagagcctggagttcctgagaacccccttcggcggcagactgctggtgctggagagcttcctgtacaagcaggagaaggccgtgggcgacaaggtgtactggaagtgcagacagcacgccgagctgggctgcagaggcagagccatcaccagaggcctgagagccaccgtgatgagaggccactgccacgcccccgacgagcagggcctggaggccagaagacagagagagaagctgcccagcctggccctgcccgagggcctgggcgagccccagggccccgagggccccggcggcagagtggaggagcccctggagggcgtgggcccctggcagtgccccgaggagcccgagcccacccccggcctggtgctgagcaagcccgccctggaggaggaggaggcccccagagccctgagcctgctgagcctgccccccaagaagagaagcatcctgggcctgggccaggccagacccctggagttcctgagaacctgctacggcggcagcttcctggtgcacgagagcttcctgtacaagagagagaaggccgtgggcgacaaggtgtactggacctgcagagaccacgccctgcacggctgcagaagcagagccatcacccagggccagagagtgaccgtgatgagaggccactgccaccagcccgacatggagggcctggaggccagaagacagcaggagaaggccgtggagaccctgcaggccggccaggacggccccggcagccaggtggacaccctgctgagaggcgtggacagcctgctgtacagaagaggccccggccccctgaccctgaccagacccagacccagaaagagagccaaggtggaggaccaggagctgcccacccagcccgaggcccccgacgagcaccaggacatggacgccgaccccggcggccccgagttcctgaagacccccctgggcggcagcttcctggtgtacgagagcttcctgtacagaagagagaaggccgccggcgagaaggtgtactggacctgcagagaccaggccagaatgggctgcagaagcagagccatcacccagggcagaagagtgaccgtgatgagaggccactgccacccccccgacctgggcggcctggaggccctgagacagagagagaagagacccaacaccgcccagagaggcagccccggcgccggcctgagcttccagtggctgttcagaatcctgcagctgctgggccacgcccccgtgctgctgtgccccagcggcagcagctgcctgcccagcctgcccgccccccacggcccctgccccgccctgagcatccccctggagggcggccccgagttcctgaagacccccctgggcggcagcttcctggtgtacgagagcttcctgtacagaagagagaaggccgccggcgagaaggtgtactggacctgcagagaccaggccagaatgggctgcagaagcagagccatcacccagggcagaagagtgatggtgatgagaagacactgccacccccccgacctgggcggcctggaggccctgagacagagagagcacttccccaacctggcccagtgggacagccccgaccccctgagacccctggagttcctgagaaccagcctgggcggcagattcctggtgcacgagagcttcctgtacagaaaggagaaggccgccggcgagaaggtgtactggatgtgcagagaccaggccagactgggctgcagaagcagagccatcacccagggccacagaatcatggtgatgagaagccactgccaccagcccgacctggccggcctggaggccctgagacagagagagagactgcccaccaccgcccagcaggaggaccccgagaagatccaggtgcagctgtgcttcaagacctgcagccccgagagccagcagatctacggcgacatcaaggacgtgagactggacggcgagagccagtag

SEQ ID NO: 8089 - DNA, 2148 bp, Artificial Sequence
  Description of Artificial Sequence: Synthetic coding sequence
atgcccctgcccgagcccagcgagcaggagggcgagagcgtgaaggccggccaggagcccagccccaagcccggcaccgacgtgatccccgccgcccccagaaagcccagagagttcagcaagctggtgctgctgaccgccagcgaccaggacgaggacggcgtgggcagcaagccccaggaggtgcactgcgtgctgagcctggagatggccggccccgccaccctggccagcaccctgcagatcctgcccgtggaggagcagggcggcgtggtgcagcccgccctggagatgcccgagcagaagtgcagcaagctggacgccgccccccagagcctggagttcctgagaacccccttcggcggcagactgctggtgctggagagcttcctgtacaagcaggagaaggccgtgggcgacaaggtgtactggaagtgcagacagcacgccgagctgggctgcagaggcagagccatcaccagaggcctgagagccaccgtgatgagaggccactgccacgcccccgacgagcagggcctggaggccagaagacagagagagaagctgcccagcctggccctgcccgagggcctgggcgagccccagggccccgagggccccggcggcagagtggaggagcccctggagggcgtgggcccctggcagtgccccgaggagcccgagcccacccccggcctggtgctgagcaagcccgccctggaggaggaggaggcccccagagccctgagcctgctgagcctgccccccaagaagagaagcatcctgggcctgggccaggccagacccctggagttcctgagaacctgctacggcggcagcttcctggtgcacgagagcttcctgtacaagagagagaaggccgtgggcgacaaggtgtactggacctgcagagaccacgccctgcacggctgcagaagcagagccatcacccagggccagagagtgaccgtgatgagaggccactgccaccagcccgacatggagggcctggaggccagaagacagcaggagaaggccgtggagaccctgcaggccggccaggacggccccggcagccaggtggacaccctgctgagaggcgtggacagcctgctgtacagaagaggccccggccccctgaccctgaccagacccagacccagaaagagagccaaggtggaggaccaggagctgcccacccagcccgaggcccccgacgagcaccaggacatggacgccgaccccggcggccccgagttcctgaagacccccctgggcggcagcttcctggtgtacgagagcttcctgtacagaagagagaaggccgccggcgagaaggtgtactggacctgcagagaccaggccagaatgggctgcagaagcagagccatcacccagggcagaagagtgaccgtgatgagaggccactgccacccccccgacctgggcggcctggaggccctgagacagagagagaagagacccaacaccgcccagagaggcagccccggcggccccgagttcctgaagacccccctgggcggcagcttcctggtgtacgagagcttcctgtacagaagagagaaggccgccggcgagaaggtgtactggacctgcagagaccaggccagaatgggctgcagaagcagagccatcacccagggcagaagagtgatggtgatgagaagacactgccacccccccgacctgggcggcctggaggccctgagacagagagagcacttccccaacctggcccagtgggacagccccgaccccctgagacccctggagttcctgagaaccagcctgggcggcagattcctggtgcacgagagcttcctgtacagaaaggagaaggccgccggcgagaaggtgtactggatgtgcagagaccaggccagactgggctgcagaagcagagccatcacccagggccacagaatcatggtgatgagaagccactgccaccagcccgacctggccggcctggaggccctgagacagagagagagactgcccaccaccgcccagcaggaggaccccgagaagatccaggtgcagctgtgcttcaagacctgcagccccgagagccagcagatctacggcgacatcaaggacgtgagactggacggcgagagccagtag

SEQ ID NO: 8090 - DNA, 978 bp, Artificial Sequence
  Description of Artificial Sequence: Synthetic coding sequence
atgcccagacccggcagaaacacctacagcgaccagaagcccccctacagctacatcagcctgaccgccatggccatccagagcagccccgagaagatgctgcccctgagcgagatctacaagttcatcatggacagattcccctactacagagagaacacccagagatggcagaacagcctgagacacaacctgagcttcaacgactgcttcatcaagatccccagaagacccgaccagcccggcaagggcagcttctgggccctgcaccccagctgcggcgacatgttcgagaacggcagcttcctgagaagaagaaagagattcaaggtgctgaagagcgaccacctggcccccagcaagcccgccgacgccgcccagtacctgcagcagcaggccaagctgagactgagcgccctggccgccagcggcacccacctgccccagatgcccgccgccgcctacaacctgggcggcgtggcccagcccagcggcttcaagcaccccttcgccatcgagaacatcatcgccagagagtacaagatgcccggcggcctggccttcagcgccatgcagcccgtgcccgccgcctaccccctgcccaaccagctgaccaccatgggcagcagcctgggcaccggctggccccacgtgtacggcagcgccggcatgatcgacagcgccacccccatcagcatggccagcggcgactacagcgcctacggcgtgcccctgaagcccctgtgccacgccgccggccagaccctgcccgccatccccgtgcccatcaagcccacccccgccgccgtgcccgccctgcccgccctgcccgcccccatccccaccctgctgagcaacagcccccccagcctgagccccaccagcagccagaccgccaccagccagagcagccccgccacccccagcgagaccctgaccagccccgccagcgccctgcacagcgtggccgtgcactag

SEQ ID NO: 8091 - DNA, 1299 bp, Artificial Sequence
  Description of Artificial Sequence: Synthetic coding sequence
atgcccagacccggcaagagcagctacagcgaccagaagcccccctacagctacatcagcctgaccgccatggccatccagcacagcgccgagaagatgctgcccctgagcgacatctacaagttcatcatggagagattcccctactacagagagcacacccagagatggcagaacagcctgagacacaacctgagcttcaacgactgcttcatcaagatccccagaagacccgaccagcccggcaagggcagcttctgggccctgcaccccgactgcggcgacatgttcgagaacggcagcttcctgagaagaagaaagagattcaaggtgctgagagccgaccacacccacctgcacgccggcagcaccaagagcgcccccggcgccggccccggcggccacctgcacccccaccaccaccaccacccccaccaccaccaccaccaccacgccgccgcccaccaccaccaccaccaccaccccccccagcccccccccccccccccccccccccccccccacatggtgcactacttccaccagcagccccccaccgccccccagccccccccccacctgcccagccagcccccccagcagcccccccagcagagccagccccagcagcccagccaccccggcaagatgcaggaggccgccgccgtggccgccgccgccgccgccgccgccgccgccgccgtgggcagcgtgggcagactgagccagttccccccctacggcctgggcagcgccgccgccgccgccgccgccgccgccgccagcaccagcggcttcaagcaccccttcgccatcgagaacatcatcggcagagactacaagggcgtgctgcaggccggcggcctgcccctggccagcgtgatgcaccacctgggctaccccgtgcccggccagctgggcaacgtggtgagcagcgtgtggccccacgtgggcgtgatggacagcgtggccgccgccgccgccgccgccgccgccgccggcgtgcccgtgggccccgagtacggcgccttcggcgtgcccgtgaagagcctgtgccacagcgccagccagagcctgcccgccatgcccgtgcccatcaagcccacccccgccctgccccccgtgagcgccctgcagcccggcctgaccgtgcccgccgccagccagcagccccccgcccccagcaccgtgtgcagcgccgccgccgccagccccgtggccagcctgctggagcccaccgcccccaccagcgccgagagcaagggcggcagcctgcacagcgtgctggtgcacagctag

SEQ ID NO: 8092 - DNA, 1251 bp, Artificial Sequence
  Description of Artificial Sequence: Synthetic coding sequence
atgaacctgcccagagccgagagacccagaagcaccccccagagaagcctgagagacagcgacggcgaggacggcaagatcgacgtgctgggcgaggaggaggacgaggacgaggtggaggacgaggaggaggaggccagacagcagttcctggagcagagcctgcagcccggcctgcaggtggccagatggggcggcgtggccctgcccagagagcacatcgagggcggcggcggccccagcgaccccagcgagttcggcaccaagttcagagccccccccagaagcgccgccgccagcgaggacgccagacagcccgccaagcccccctacagctacatcgccctgatcaccatggccatcctgcagaacccccacaagagactgaccctgagcggcatctgcgccttcatcagcggcagattcccctactacagaagaaagttccccgcctggcagaacagcatcagacacaacctgagcctgaacgactgcttcgtgaagatccccagagagcccggccaccccggcaagggcaactactggagcctggaccccgccagccaggacatgttcgacaacggcagcttcctgagaagaagaaagagattcaagagacaccagctgacccccggcgcccacctgccccaccccttccccctgcccgccgcccacgccgccctgcacaacccccaccccggccccctgctgggcgcccccgcccccccccagcccgtgcccggcgcctaccccaacaccgcccccggcagaagaccctacgccctgctgcacccccaccccctgagatacctgctgctgagcgccagagtgtacgccggcgcccccaagaaggccgagggcgccgacctggccacccccgcccccttcccctgctgcagcccccacctggtgctgagcctgggcagaagagccagagtgtggagaagacacagagaggccgacgccagcctgagcgccctgagagtgctgtgcaagggcagcggcgagagagtgcagggcctgagaagagtgtgccccagacccagaggcgccaccgccacctgcagcagcgaccaccaggcctgctgcatccccaagcccctgcccctgtgctgcaagtgccccccccccctgctgctgggccagttctgcagcaacagcagcagcatcagaagaaccgcccccaccgccgccctgccccccagagccagatgctgggccggcacctgcagacccagaagaagatgctag

SEQ ID NO: 8093 - DNA, 1251 bp, Artificial Sequence
  Description of Artificial Sequence: Synthetic coding sequence
atgaacctgcccagagccgagagacccagaagcaccccccagagaagcctgagagacagcgacggcgaggacggcaagatcgacgtgctgggcgaggaggaggacgaggacgaggtggaggacgaggaggaggaggccagacagcagttcctggagcagagcctgcagcccggcctgcaggtggccagatggggcggcgtggccctgcccagagagcacatcgagggcggcggcggccccagcgaccccagcgagttcggcaccaagttcagagccccccccagaagcgccgccgccagcgaggacgccagacagcccgccaagcccccctacagctacatcgccctgatcaccatggccatcctgcagaacccccacaagagactgaccctgagcggcatctgcgccttcatcagcggcagattcccctactacagaagaaagttccccgcctggcagaacagcatcagacacaacctgagcctgaacgactgcttcgtgaagatccccagagagcccggccaccccggcaagggcaactactggagcctggaccccgccagccaggacatgttcgacaacggcagcttcctgagaagaagaaagagattcaagagacaccagctgacccccggcgcccacctgccccaccccttccccctgcccgccgcccacgccgccctgcacaacccccaccccggccccctgctgggcgcccccgcccccccccagcccgtgcccggcgcctaccccaacaccgcccccggcagatgcccctacgccctgctgcacccccaccccctgagatacctgctgctgagcgcccccgtgtacgccggcgcccccaagaaggccgagggcgccgacctggccacccccgcccccttcccctgctgcagcccccacctggtgctgagcctgggcagaagagccagagtgtggagaagacacagagaggccgacgccagcctgagcgccctgagagtgctgtgcaagggcagcggcgagagagtgcagggcctgagaagagtgtgccccagacccagaggcgccaccgccacctgcagcagcgaccaccaggcctgctgcatccccaagcccctgcccctgtgctgcaagtgccccccccccctgctgctgggccagttctgcagcaacagcagcagcatcagaagaaccgcccccaccgccgccctgccccccagagccagatgctgggccggcacctgcagacccagaagaagatgctag

SEQ ID NO: 8094 - DNA, 1254 bp, Artificial Sequence
  Description of Artificial Sequence: Synthetic coding sequence
atgaacctgcccagagccgagagactgagaagcaccccccagagaagcctgagagacagcgacggcgaggacggcaagatcgacgtgctgggcgaggaggaggacgaggacgaggtggaggacgaggaggaggccgccagccagcagttcctggagcagagcctgcagcccggcctgcaggtggccagatggggcggcgtggccctgcccagagagcacatcgagggcggcggcggccccagcgaccccagcgagttcggcaccaagttcagagccccccccagaagcgccgccgccagcgaggacgccagacagcccgccaagcccccctacagctacatcgccctgatcaccatggccatcctgcagaacccccacaagagactgaccctgagcggcatctgcgccttcatcagcggcagattcccctactacagaagaaagttccccgcctggcagaacagcatcagacacaacctgagcctgaacgactgcttcgtgaagatccccagagagcccggccaccccggcaagggcaactactggagcctggaccccgccagccaggacatgttcgacaacggcagcttcctgagaagaagaaagagattcaagagacaccagctgacccccggcgcccacctgccccaccccttccccctgcccgccgcccacgccgccctgcacaacccccaccccggccccctgctgggcgcccccgcccccccccagcccgtgcccggcgcctaccccaacaccgcccccggcagaagaccctacgccctgctgcacccccaccccctgagatacctgctgctgagcgcccccgtgtacgccggcgcccccaagaaggccgagggcgccgccctggccacccccgcccccttcccctgctgcagcccccacctggtgctgagcctgggcagaagagccagagtgtggagaagacacagagaggccgacgccagcctgagcgccctgagagtgctgtgcaagggcagcggcgagagagtgcagggcctgagaagagtgtgccccagacccagaggcgccaccgccacctgcagcagcgaccaccaggcctgctgcatccccagacccctgcccctgtgctgcaagtgcccccccccccccctgctgggccagttctgcagcaacagcagcagcatcagaagaagaaccgcccccaccgccgccctgccccccagagccagatgctgggccggcacctgcagacccagaagaccctgctag

SEQ ID NO: 8095 - DNA, 1140 bp, Artificial Sequence
  Description of Artificial Sequence: Synthetic coding sequence
atgagcagcgcccccgagaagcagcagcccccccacggcggcggcggcggcggcggcggcggcggcggcgccgccatggaccccgccagcagcggccccagcaaggccaagaagaccaacgccggcatcagaagacccgagaagcccccctacagctacatcgccctgatcgtgatggccatccagagcagccccaccaagagactgaccctgagcgagatctaccagttcctgcagagcagattccccttcttcagaggcagctaccagggctggaagaacagcgtgagacacaacctgagcctgaacgagtgcttcatcaagctgcccaagggcctgggcagacccggcaagggccactactggaccatcgaccccgccagcgagttcatgttcgaggagggcagcttcagaagaagacccagaggcttcagaagaaagtgccaggccctgaagcccatgtacagcatgatgaacggcctgggcttcaaccacctgcccgacacctacggcttccagggcagcgccggcggcctgagctgcccccccaacagcctggccctggagggcggcctgggcatgatgaacggccacctgcccggcaacgtggacggcatggccctgcccagccacagcgtgccccacctgcccagcaacggcggccacagctacatgggcggctgcggcggcgccgccgccggcgagtacccccaccacgacagcagcgtgcccgccagccccctgctgcccaccggcgccggcggcgtgatggagccccacgccgtgtacagcggcagcgccgccgcctggccccccagcgccagcgccgccctgaacagcggcgccagctacatcaagcagcagcccctgagcccctgcaaccccgccgccaaccccctgagcggcagcctgagcacccacagcctggagcagccctacctgcaccagaacagccacaacgcccccgccgagctgcagggcatccccagataccacagccagagccccagcatgtgcgacagaaaggagttcgtgttcagcttcaacgccatggccagcagcagcatgcacagcgccggcggcggcagctactaccaccagcaggtgacctaccaggacatcaagccctgcgtgatgtag

SEQ ID NO: 8096 - DNA, 765 bp, Artificial Sequence
  Description of Artificial Sequence: Synthetic coding sequence
cccgccctgcccagcaccctgccccacagacccgcccccagcaccagacccggcccctgccccagatgcctgcccagcagaatgggcccctgcagcggcagcagactgggcccccccgaggccgagagccccagccagccccccaagagaagaaagaagagatacctgagacacgacaagcccccctacacctacctggccatgatcgccctggtgatccaggccgcccccagcagaagactgaagctggcccagatcatcagacaggtgcaggccgtgttccccttcttcagagaggactacgagggctggaaggacagcatcagacacaacctgagcagcaacagatgcttcagaaaggtgcccaaggaccccgccaagccccaggccaagggcaacttctgggccgtggacgtgagcctgatccccgccgaggccctgagactgcagaacaccgccctgtgcagaagatggcagaacggcggcgccagaggcgccttcgccaaggacctgggcccctacgtgctgcacggcagaccctacagaccccccagccccccccccccccccagcgagggcttcagcatcaagagcctgctgggcggcagcggcgagggcgccccctggcccggcctggccccccagagcagccccgtgcccgccggcaccggcaacagcggcgaggaggccgtgcccaccccccccccccccagcggcggcagctgccccccccccacctgcctgagcaccctgcccatgtggtag

SEQ ID NO: 8097 - DNA, 1098 bp, Artificial Sequence
  Description of Artificial Sequence: Synthetic coding sequence
atgggcccctgcagcggcagcagactgggcccccccgaggccgagagccccagccagccccccaagagaagaaagaagagatacctgagacacgacaagcccccctacacctacctggccatgatcgccctggtgatccaggccgcccccagcagaagactgaagctggcccagatcatcagacaggtgcaggccgtgttccccttcttcagagaggactacgagggctggaaggacagcatcagacacaacctgagcagcaacagatgcttcagaaaggtgcccaaggaccccgccaagccccaggccaagggcaacttctgggccgtggacgtgagcctgatccccgccgaggccctgagactgcagaacaccgccctgtgcagaagatggcagaacggcggcgccagaggcgccttcgccaaggacctgggcccctacgtgctgcacggcagaccctacagaccccccagccccccccccccccccagcgagggcttcagcatcaagagcctgctgggcggcagcggcgagggcgccccctggcccggcctggccccccagagcagccccgtgcccgccggcaccggcaacagcggcgaggaggccgtgcccaccccccccctgcccagcagcgagagacccctgtggcccctgtgccccctgcccggccccaccagagtggagggcgagaccgtgcagggcggcgccatcggccccagcaccctgagccccgagcccagagcctggcccctgcacctgctgcagggcaccgccgtgcccggcggcagaagcagcggcggccacagagccagcctgtggggccagctgcccaccagctacctgcccatctacacccccaacgtggtgatgcccctggcccccccccccaccagctgcccccagtgccccagcaccagccccgcctactggggcgtggcccccgagaccagaggcccccccggcctgctgtgcgacctggacgccctgttccagggcgtgccccccaacaagagcatctacgacgtgtgggtgagccaccccagagacctggccgcccccggccccggctggctgctgagctggtgcagcctgtag

SEQ ID NO: 8098 - DNA, 957 bp, Artificial Sequence
  Description of Artificial Sequence: Synthetic coding sequence
atggccacctactgcgacgacctgggccccagcagcgccccccccggccaggcccaggccaccgcccacccccccggctacgagcccggcgacctgggcgccgtgggcggcggccccctgctgtgggtgaacgcccccgccctgagccccaagagctacgccagcggccccggccccgcccccccctacgccgcccccagctacggcgcccccggccccctgctgggcgcccccggcggcctggccggcgccgacctggcctggctgagcctgagcggccagcaggagctgctgagactggtgagacccccctacagctacagcgccctgatcgccatggccatccagagcgcccccctgagaaagctgaccctgagccagatctaccagtacgtggccggcaacttccccttctacaagagaagcaaggccggctggcagaacagcatcagacacaacctgagcctgaacgactgcttcaagaaggtgcccagagacgaggacgaccccggcaagggcaactactggaccctggaccccaactgcgagaagatgttcgacaacggcaacttcagaagaaagagaaagagaagagccgaggccagcgccgccgtgagaagcggcgccagaagcgtgggcggcgccgaggcccccgccctggagccccccagcgccgcctgcctggacctgcaggccagccccagccccagcgcccccgaggccgccacctgcttcagcggcttcgccagcgccatgagcgccctggccggcggcctgggcaccttccccggcggcctggccggcgacttcagcttcggcagaagaccccccaccgtggccacccacgccccccagaccctgaaccccagccccggcttcgcccccggccaccagaccgccgccgccggcttcagactgagccacctgctgtacagcagagagggcaccgaggtgtag

SEQ ID NO: 8099 - DNA, 1725 bp, Artificial Sequence
  Description of Artificial Sequence: Synthetic coding sequence
atggccagcgacctggagagcagcctgaccagcatcgactggctgccccagctgaccctgagagccaccatcgagaagctgggcagcgccagccaggccggcccccccggcagcagcagaaagtgcagccccggcagccccaccgaccccaacgccaccctgagcaaggacgaggccgccgtgcaccaggacggcaagcccagatacagctacgccaccctgatcacctacgccatcaacagcagccccgccaagaagatgaccctgagcgagatctacagatggatctgcgacaacttcccctactacaagaacgccggcatcggctggaagaacagcatcagacacaacctgagcctgaacaagtgcttcagaaaggtgcccagacccagagacgaccccggcaagggcagctactggaccatcgacacctgccccgacatcagcagaaagagaagacacccccccgacgacgacctgagccaggacagccccgagcaggaggccagcaagagccccagaggcggcgtggccggcagcggcgaggccagcctgccccccgagggcaacccccagatgagcctgcagagccccaccagcatcgccagctacagccagggcaccggcagcgtggacggcggcgccgtggccgccggcgccagcggcagagagagcgccgagggccccccccccctgtacaacaccaaccacgacttcaagttcagctacagcgagatcaacttccaggacctgagctggagcttcagaaacctgtacaagagcatgctggagaagagcagcagcagcagccagcacggcttcagcagcctgctgggcgacatcccccccagcaacaactactacatgtaccagcagcagcagcccccccccccccagcagcagcagcagcagcagcagcccccccagccccccccccagcagagccagccccagcagcagcaggcccccgcccagggccccagcgccgtgggcggcgccccccccctgcacacccccagcaccgacggctgcaccccccccggcggcaagcaggccggcgccgagggctacggccccccccccgtgatggccatgcaccccccccccctgcagcacggcggctaccacccccaccagcaccacccccacagccaccccgcccagcagcccccccccccccagccccaggcccagggccaggcccccatcaacaacaccggcttcgccttccccagcgactggtgcagcaacatcgacagcctgaaggagagcttcaagatggtgaacagactgaactggagcagcatcgagcagagccagttcagcgagctgatggagagcctgagacaggccgagcagaagaactggaccctggaccagcaccacatcgccaacctgtgcgacagcctgaaccacttcctgacccagaccggccacgtgcccccccagggcggcacccacagaccccccgcccccgccagaatcgccgacagctgcgccctgaccagcggcaagcaggagagcgccatgagccaggtgaacagctacggccacccccaggccccccacctgtaccccggccccagccccatgtaccccatccccacccaggacagcgccggctacaacagacccgcccaccacatggtgcccagacccagcgtgcccccccccggcgccaacgaggagatccccgacgacttcgactgggacctgatcacctag

SEQ ID NO: 8100 - DNA, 1581 bp, Artificial Sequence
  Description of Artificial Sequence: Synthetic coding sequence
atggccagcgacctggagagcagcctgaccagcatcgactggctgccccagctgaccctgagagccaccatcgagaagctgggcagcgccagccaggccggcccccccggcagcagcagaaagtgcagccccggcagccccaccgaccccaacgccaccctgagcaaggacgaggccgccgtgcaccaggacggcaagcccagatacagctacgccaccctgatcacctacgccatcaacagcagccccgccaagaagatgaccctgagcgagatctacagatggatctgcgacaacttcccctactacaagaacgccggcatcggctggaagaacagcatcagacacaacctgagcctgaacaagtgcttcagaaaggtgcccagacccagagacgaccccggcaagggcagctactggaccatcgacacctgccccgacatcagcagaaagagaagacacccccccgacgacgacctgagccaggacagccccgagcaggaggccagcaagagccccagaggcggcgtggccggcagcggcgaggccagcctgccccccgagggcaacccccagatgagcctgcagagccccaccagcatcgccagctacagccagggcaccggcagcgtggacggcggcgccgtggccgccggcgccagcggcagagagagcgccgagggccccccccccctgtacaacaccaaccacgacttcaagttcagctacagcgagatcaacttccaggacctgagctggagcttcagaaacctgtacaagagcatgctggagaagagcagcagcagcagccagcacggcttcagcagcctgctgggcgacatcccccccagcaacaactactacatgtaccagcagcagcagcccccccccccccagcagcagcagcagcagcagcagcccccccagccccccccccagcagagccagccccagcagcagcaggcccccgcccagggccccagcgccgtgggcggcgccccccccctgcacacccccagcaccgacggctgcaccccccccggcggcaagcaggccggcgccgagggctacggccccccccccgtgatggccatgcaccccccccccctgcagcacggcggctaccacccccaccagcaccacccccacagccaccccgcccagcagcccccccccccccagccccaggcccagggccaggcccccatcaacaacaccggcttcgccttccccagcgactggtgcagcaacatcgacagcctgaaggagagcttcaagatggtgaacagactgaactggagcagcatcgagcagagccagttcagcgagctgatggagagcctgagacaggccgagcagaagaactggaccctggaccagcaccacatcgccaacctgtgcgacagcctgaaccacttcctgacccagaccggccacgtgcccccccagggcggcacccacagaccccccgcccccgccagaatcgccgacagctgcgccctgaccagcggcaagcaggagagcgccatgagccagggcaccgcccccagccagctgccctggagatggagactgtgctag

SEQ ID NO: 8101 - DNA, 1869 bp, Artificial Sequence
  Description of Artificial Sequence: Synthetic coding sequence
atgggcctgtacggccaggcctgccccagcgtgaccagcctgagaatgaccagcgagctggagagcagcctgaccagcatggactggctgccccagctgaccatgagagccgccatccagaagagcgacgccacccagaacgcccacggcaccggcatcagcaagaagaacgccctgctggaccccaacaccaccctggaccaggaggaggtgcagcagcacaaggacggcaagcccccctacagctacgccagcctgatcaccttcgccatcaacagcagccccaagaagaagatgaccctgagcgagatctaccagtggatctgcgacaacttcccctactacagagaggccggcagcggctggaagaacagcatcagacacaacctgagcctgaacaagtgcttcctgaaggtgcccagaagcaaggacgaccccggcaagggcagctactgggccatcgacaccaaccccaaggaggacgtgctgcccaccagacccaagaagagagccagaagcgtggagagagccagcaccccctacagcatcgacagcgacagcctgggcatggagtgcatcatcagcggcagcgccagccccaccctggccatcaacaccgtgaccaacaaggtgaccctgtacaacaccgaccaggacggcagcgacagccccagaagcagcctgaacaacagcctgagcgaccagagcctggccagcgtgaacctgaacagcgtgggcagcgtgcacagctacacccccgtgaccagccaccccgagagcgtgagccagagcctgaccccccagcagcagccccagtacaacctgcccgagagagacaagcagctgctgttcagcgagtacaacttcgaggacctgagcgccagcttcagaagcctgtacaagagcgtgttcgagcagagcctgagccagcagggcctgatgaacatccccagcgagagcagccagcagagccacaccagctgcacctaccagcacagccccagcagcaccgtgagcacccacccccacagcaaccagagcagcctgagcaacagccacggcagcggcctgaacaccaccggcagcaacagcgtggcccaggtgagcctgagccacccccagatgcacacccagcccagcccccaccccccccacagaccccacggcctgccccagcacccccagagaagcccccaccccgccccccacccccagcagcacagccagctgcagagcccccacccccagcaccccagcccccaccagcacatccagcaccaccccaaccaccagcaccagaccctgacccaccaggcccccccccccccccagcaggtgagctgcaacagcggcgtgagcaacgactggtacgccaccctggacatgctgaaggagagctgcagaatcgccagcagcgtgaactggagcgacgtggacctgagccagttccagggcctgatggagagcatgagacaggccgacctgaagaactggagcctggaccaggtgcagttcgccgacctgtgcagcagcctgaaccagttcttcacccagaccggcctgatccacagccagagcaacgtgcagcagaacgtgtgccacggcgccatgcaccccaccaagcccagccagcacatcggcaccggcaacctgtacatcgacagcagacagaacctgccccccagcgtgatgcccccccccggctacccccacatcccccaggccctgagcacccccggcaccaccatggccggccaccacagagccatgaaccagcagcacatgatgcccagccaggccttccagatgagaagaagcctgccccccgacgacatccaggacgacttcgactgggacagcatcgtgtag

SEQ ID NO: 8102 - DNA, 1767 bp, Artificial Sequence
  Description of Artificial Sequence: Synthetic coding sequence
atgggcctgtacggccaggcctgccccagcgtgaccagcctgagaatgaccagcgagctggagagcagcctgaccagcatggactggctgccccagctgaccatgagagccgccatccagaagagcgacgccacccagaacgcccacggcaccggcatcagcaagaagaacgccctgctggaccccaacaccaccctggaccaggaggaggtgcagcagcacaaggacggcaagcccccctacagctacgccagcctgatcaccttcgccatcaacagcagccccaagaagaagatgaccctgagcgagatctaccagtggatctgcgacaacttcccctactacagagaggccggcagcggctggaagaacagcatcagacacaacctgagcctgaacaagtgcttcctgaaggtgcccagaagcaaggacgaccccggcaagggcagctactgggccatcgacaccaaccccaaggaggacgtgctgcccaccagacccaagaagagagccagaagcgtggagagagtgaccctgtacaacaccgaccaggacggcagcgacagccccagaagcagcctgaacaacagcctgagcgaccagagcctggccagcgtgaacctgaacagcgtgggcagcgtgcacagctacacccccgtgaccagccaccccgagagcgtgagccagagcctgaccccccagcagcagccccagtacaacctgcccgagagagacaagcagctgctgttcagcgagtacaacttcgaggacctgagcgccagcttcagaagcctgtacaagagcgtgttcgagcagagcctgagccagcagggcctgatgaacatccccagcgagagcagccagcagagccacaccagctgcacctaccagcacagccccagcagcaccgtgagcacccacccccacagcaaccagagcagcctgagcaacagccacggcagcggcctgaacaccaccggcagcaacagcgtggcccaggtgagcctgagccacccccagatgcacacccagcccagcccccaccccccccacagaccccacggcctgccccagcacccccagagaagcccccaccccgccccccacccccagcagcacagccagctgcagagcccccacccccagcaccccagcccccaccagcacatccagcaccaccccaaccaccagcaccagaccctgacccaccaggcccccccccccccccagcaggtgagctgcaacagcggcgtgagcaacgactggtacgccaccctggacatgctgaaggagagctgcagaatcgccagcagcgtgaactggagcgacgtggacctgagccagttccagggcctgatggagagcatgagacaggccgacctgaagaactggagcctggaccaggtgcagttcgccgacctgtgcagcagcctgaaccagttcttcacccagaccggcctgatccacagccagagcaacgtgcagcagaacgtgtgccacggcgccatgcaccccaccaagcccagccagcacatcggcaccggcaacctgtacatcgacagcagacagaacctgccccccagcgtgatgcccccccccggctacccccacatcccccaggccctgagcacccccggcaccaccatggccggccaccacagagccatgaaccagcagcacatgatgcccagccaggccttccagatgagaagaagcctgccccccgacgacatccaggacgacttcgactgggacagcatcgtgtag

SEQ ID NO: 8103 - DNA, 411 bp, Artificial Sequence
  Description of Artificial Sequence: Synthetic coding sequence
atggagagcatgagacaggccgacctgaagaactggagcctggaccaggtgcagttcgccgacctgtgcagcagcctgaaccagttcttcacccagaccggcctgatccacagccagagcaacgtgcagcagaacgtgtgccacggcgccatgcaccccaccaagcccagccagcacatcggcaccggcaacctgtacatcgacagcagacagaacctgccccccagcgtgatgcccccccccggctacccccacatcccccaggccctgagcacccccggcaccaccatggccggccaccacagagccatgaaccagcagcacatgatgcccagccaggccttccagatgagaagaagcctgccccccgacgacatccaggacgacttcgactgggacagcatcgtgtag

SEQ ID NO: 8104 - DNA, 1869 bp, Artificial Sequence; identical to SEQ ID NO: 8101
  Description of Artificial Sequence: Synthetic coding sequence

SEQ ID NO: 8105 - DNA, 1869 bp, Artificial Sequence; identical to SEQ ID NO: 8101
  Description of Artificial Sequence: Synthetic coding sequence

SEQ ID NO: 8106 - DNA, 264 bp, Artificial Sequence
  Description of Artificial Sequence: Synthetic coding sequence
atggagtgcatcatcagcggcagcgccagccccaccctggccatcaacaccgtgaccaacaaggtgaccctgtacaacaccgaccaggacggcagcgacagccccagaagcagcctgaacaacagcctgagcgaccagagcctggccagcgtgaacctgaacagcgtgggcagcgtgcacagctacacccccgtgaccagccaccccgagagcgtgagccagagcctgaccccccagcagcagccccagtacaacctgccctag

SEQ ID NO: 8107 - DNA, 1149 bp, Artificial Sequence
  Description of Artificial Sequence: Synthetic coding sequence
atgggcctgtacggccaggcctgccccagcgtgaccagcctgagaatgaccagcgagctggagagcagcctgaccagcatggactggctgccccagctgaccatgagagccgccatccagaagagcgacgccacccagaacgcccacggcaccggcatcagcaagaagaacgccctgctggaccccaacaccaccctggaccaggaggaggtgcagcagcacaaggacggcaagcccccctacagctacgccagcctgatcaccttcgccatcaacagcagccccaagaagaagatgaccctgagcgagatctaccagtggatctgcgacaacttcccctactacagagaggccggcagcggctggaagaacagcatcagacacaacctgagcctgaacaagtgcttcctgaaggtgcccagaagcaaggacgaccccggcaagggcagctactgggccatcgacaccaaccccaaggaggacgtgctgcccaccagacccaagaagagagccagaagcgtggagagagtgaccctgtacaacaccgaccaggacggcagcgacagccccagaagcagcctgaacaacagcctgagcgaccagagcctggccagcgtgaacctgaacagcgtgggcagcgtgcacagctacacccccgtgaccagccaccccgagagcgtgagccagagcctgaccccccagcagcagccccagtacaacctgcccgagagagacaagcagctgctgttcagcgagtacaacttcgaggacctgagcgccagcttcagaagcctgtacaagagcgtgttcgagcagagcctgagccagcagggcctgatgaacatccccagcgagagcagccagcagagccacaccagctgcacctaccagcacagccccagcagcaccgtgagcacccacccccacagcaaccagagcagcctgagcaacagccacggcagcggcctgaacaccaccggcagcaacagcgtggcccaggtgagcctgagccacccccagatgcacacccagcccagcccccaccccccccacagaccccacggcctgccccagcacccccagagaagcccccaccccgccccccacccccagcagcacagccagctgcagagcccccacccccagtag

SEQ ID NO: 8108 - DNA, 378 bp, Artificial Sequence
  Description of Artificial Sequence: Synthetic coding sequence
gccacccagaacgcccacggcaccggcatcagcaagaagaacgccctgctggaccccaacaccaccctggaccaggaggaggtgcagcagcacaaggacggcaagcccccctacagctacgccagcctgatcaccttcgccatcaacagcagccccaagaagaagatgaccctgagcgagatctaccagtggatctgcgacaacttcccctactacagagaggccggcagcggctggaagaacagcatcagacacaacctgagcctgaacaagtgcttcctgaaggtgcccagaagcaaggacgaccccggcaaggtgggcttcatcttcctgaagcagctgaacagcagcgtgtgccacctgagctgcctgaactag

SEQ ID NO: 8109 - DNA, 1869 bp, Artificial Sequence; identical to SEQ ID NO: 8101
  Description of Artificial Sequence: Synthetic coding sequence

SEQ ID NO: 8110 - DNA, 1023 bp, Artificial Sequence
  Description of Artificial Sequence: Synthetic coding sequence
atgatgtgccaccccctggaccagctggccaccagaacccagaagaagagcgccaccagcaagcccccctacagcttcagcctgctgatctacatggccatcgagcacagccccaacaagtgcctgcccgtgaaggagatctacagctggatcctggaccacttcccctacttcgccaccgcccccaccggctggaagaacagcgtgagacacaacctgagcctgaacaagtgcttccagaaggtggagagaagccacggcaaggtgaacggcaagggcagcctgtggtgcgtggaccccgagtacaagcccaacctgatccaggccctgaagaagcagcccttcagcagcgccagcagccagaacggcagcctgagcccccactacctgagcagcgtgatcaagcagaaccaggtgagaaacctgaaggagagcgacatcgacgccgccgccgccatgatgctgctgaacaccagcatcgagcagggcatcctggagtgcgagaagcccctgcccctgaagaccgccctgcagaagaagagaagctacggcaacgccttccaccaccccagcgccgtgagactgcaggagagcgacagcctggccaccagcatcgaccccaaggaggaccacaactacagcgccagcagcatggccgcccagagatgcgccagcagaagcagcgtgagcagcctgagcagcgtggacgaggtgtacgagttcatccccaagaacagccacgtgggcagcgacggcagcgagggcttccacagcgaggaggacaccgacgtggactacgaggacgaccccctgggcgacagcggctacgccagccagccctgcgccaagatcagcgagaagggccagagcggcaagaagatgagaaagcagacctgccaggagatcgacgaggagctgaaggaggccgccggcagcctgctgcacctggccggcatcagaacctgcctgggcagcctgatcagcaccgccaagacccagaaccagaagcagagaaagaagtag

SEQ ID NO: 8111 - DNA, 1296 bp, Artificial Sequence
  Description of Artificial Sequence: Synthetic coding sequence
atgggccccgtgatcggcatgacccccgacaagagagccgagacccccggcgccgagaagatcgccggcctgagccagatctacaagatgggcagcctgcccgaggccgtggacgccgccagacccaaggccaccctggtggacagcgagagcgccgacgacgagctgaccaacctgaactggctgcacgagagcaccaacctgctgaccaacttcagcctgggcagcgagggcctgcccatcgtgagccccctgtacgacatcgagggcgacgacgtgcccagcttcggccccgcctgctaccagaaccccgagaagaagagcgccaccagcaagcccccctacagcttcagcctgctgatctacatggccatcgagcacagccccaacaagtgcctgcccgtgaaggagatctacagctggatcctggaccacttcccctacttcgccaccgcccccaccggctggaagaacagcgtgagacacaacctgagcctgaacaagtgcttccagaaggtggagagaagccacggcaaggtgaacggcaagggcagcctgtggtgcgtggaccccgagtacaagcccaacctgatccaggccctgaagaagcagcccttcagcagcgccagcagccagaacggcagcctgagcccccactacctgagcagcgtgatcaagcagaaccaggtgagaaacctgaaggagagcgacatcgacgccgccgccgccatgatgctgctgaacaccagcatcgagcagggcatcctggagtgcgagaagcccctgcccctgaagaccgccctgcagaagaagagaagctacggcaacgccttccaccaccccagcgccgtgagactgcaggagagcgacagcctggccaccagcatcgaccccaaggaggaccacaactacagcgccagcagcatggccgcccagagatgcgccagcagaagcagcgtgagcagcctgagcagcgtggacgaggtgtacgagttcatccccaagaacagccacgtgggcagcgacggcagcgagggcttccacagcgaggaggacaccgacgtggactacgaggacgaccccctgggcgacagcggctacgccagccagccctgcgccaagatcagcgagaagggccagagcggcaagaagatgagaaagcagacctgccaggagatcgacgaggagctgaaggaggccgccggcagcctgctgcacctggccggcatcagaacctgcctgggcagcctgatcagcaccgccaagacccagaaccagaagcagagaaagaagtag

SEQ ID NO: 8112 - DNA, 741 bp, Artificial Sequence
  Description of Artificial Sequence: Synthetic coding sequence
atgggccccgtgatcggcatgacccccgacaagagagccgagacccccggcgccgagaagatcgccggcctgagccagatctacaagatgggcagcctgcccgaggccgtggacgccgccagacccaaggccaccctggtggacagcgagagcgccgacgacgagctgaccaacctgaactggctgcacgagagcaccaacctgctgaccaacttcagcctgggcagcgagggcctgcccatcgtgagccccctgtacgacatcgagggcgacgacgtgcccagcttcggccccgcctgctaccagaaccccgagaagaagagcgccaccagcaagcccccctacagcttcagcctgctgatctacatggccatcgagcacagccccaacaagtgcctgcccgtgaaggagatctacagctggatcctggaccacttcccctacttcgccaccgcccccaccggctggaagaacagcgtgagacacaacctgagcctgaacaagtgcttccagaaggtggagagaagccacggcaaggtgaacggcaagggcagcctgtggtgcgtggaccccgagtacaagcccaacctgatccaggccctgaagaagcagcccttcagcagcgccagcagccagaacggcagcctgagcccccactacctgagcagcgtgatcaagcagaaccaggtgagaaacctgaaggagagcgacatcgacgccgccgccgccatgatgctgtag

SEQ ID NO: 8113 - DNA, 879 bp, Artificial Sequence
  Description of Artificial Sequence: Synthetic coding sequence
atgggcaacgagctgttcctggccttcaccaccagccacctgcccctggccgagcagaagctggccagatacaagctgagaatcgtgaagccccccaagctgcccctggagaagaagcccaaccccgacaaggacggccccgactacgagcccaacctgtggatgtgggtgaaccccaacatcgtgtacccccccggcaagctggaggtgagcggcagaagaaagagagaggacctgaccagcaccctgcccagcagccagcccccccagaaggaggaggacgccagctgcagcgaggccgccggcgtggagagcctgagccagagcagcagcaagagaagcccccccagaaagagattcgccttcagccccagcacctgggagctgaccgaggaggaggaggccgaggaccaggaggacagcagcagcatggccctgcccagcccccacaagagagcccccctgcagagcagaagactgagacaggccagcagccaggccggcagactgtggagcagaccccccctgaactacttccacctgatcgccctggccctgagaaacagcagcccctgcggcctgaacgtgcagcagatctacagcttcaccagaaagcacttccccttcttcagaaccgcccccgagggctggaagaacaccgtgagacacaacctgtgcttcagagacagcttcgagaaggtgcccgtgagcatgcagggcggcgccagcaccagacccagaagctgcctgtggaagctgaccgaggagggccacagaagattcgccgaggaggccagagccctggccagcaccagactggagagcatccagcagtgcatgagccagcccgacgtgatgcccttcctgttcgacctgtag

SEQ ID NO: 8114 - DNA, 936 bp, Artificial Sequence
  Description of Artificial Sequence: Synthetic coding sequence
atggacctgaagctgaaggactgcgagttctggtacagcctgcacggccaggtgcccggcctgctggactgggacatgagaaacgagctgttcctgccctgcaccaccgaccagtgcagcctggccgagcagatcctggccaagtacagagtgggcgtgatgaagccccccgagatgccccagaagagaagacccagccccgacggcgacggccccccctgcgagcccaacctgtggatgtgggtggaccccaacatcctgtgccccctgggcagccaggaggcccccaagcccagcggcaaggaggacctgaccaacatcagccccttcccccagcccccccagaaggacgagggcagcaactgcagcgaggacaaggtggtggagagcctgcccagcagcagcagcgagcagagccccctgcagaagcagggcatccacagccccagcgacttcgagctgaccgaggaggaggccgaggagcccgacgacaacagcctgcagagccccgagatgaagtgctaccagagccagaagctgtggcagatcaacaaccaggagaagagctggcagagaccccccctgaactgcagccacctgatcgccctggccctgagaaacaacccccactgcggcctgagcgtgcaggagatctacaacttcaccagacagcacttccccttcttctggaccgcccccgacggctggaagagcaccatccactacaacctgtgcttcctggacagcttcgagaaggtgcccgacagcctgaaggacgaggacaacgccagacccagaagctgcctgtggaagctgaccaaggagggccacagaagattctgggaggagaccagagtgctggccttcgcccagagagagagaatccaggagtgcatgagccagcccgagctgctgaccagcctgttcgacctgtag

SEQ ID NO: 8115 - DNA, 993 bp, Artificial Sequence
  Description of Artificial Sequence: Synthetic coding sequence
atgcagcagcagcccctgcccggccccggcgcccccaccaccgagcccaccaagcccccctacagctacatcgccctgatcgccatggccatccagagcagccccggccagagagccaccctgagcggcatctacagatacatcatgggcagattcgccttctacagacacaacagacccggctggcagaacagcatcagacacaacctgagcctgaacgagtgcttcgtgaaggtgcccagagacgacagaaagcccggcaagggcagctactggaccctggaccccgactgccacgacatgttcgagcacggcagcttcctgagaagaagaagaagattcaccagacagaccggcgccgagggcaccagaggccccgccaaggccagaagaggccccctgagagccaccagccaggaccccggcgtgcccaacgccaccaccggcagacagtgcagcttcccccccgagctgcccgaccccaagggcctgagcttcggcggcctggtgggcgccatgcccgccagcatgtgccccgccaccaccgacggcagacccagaccccccatggagcccaaggagatcagcacccccaagcccgcctgccccggcgagctgcccgtggccaccagcagcagcagctgccccgccttcggcttccccgccggcttcagcgaggccgagagcttcaacaaggcccccacccccgtgctgagccccgagagcggcatcggcagcagctaccagtgcagactgcaggccctgaacttctgcatgggcgccgaccccggcctggagcacctgctggccagcgccgcccccagccccgccccccccaccccccccggcagcctgagagcccccctgcccctgcccaccgaccacaaggagccctgggtggccggcggcttccccgtgcagggcggcagcggctaccccctgggcctgaccccctgcctgtacagaacccccggcatgttcttcttcgagtag

SEQ ID NO: 8116 - DNA, 957 bp, Artificial Sequence
  Description of Artificial Sequence: Synthetic coding sequence
atgaacagattcggcaccagactggtgggcgccaccgccaccagcagccccccccccaaggccagaagcaacgagaacctggacaagatcgacatgagcctggacgacatcatcaagctgaacagaaaggagggcaagaagcagaacttccccagactgaacagaagactgctgcagcagagcggcgcccagcagttcagaatgagagtgagatggggcatccagcagaacagcggcttcggcaagaccagcctgaacagaagaggcagagtgatgcccggcaagagaagacccaacggcgtgatcaccggcctggccgccagaaagaccaccggcatcagaaagggcatcagccccatgaacagaccccccctgagcgacaagaacatcgagcagtacttccccgtgctgaagagaaaggccaacctgctgagacagaacgagggccagagaaagcccgtggccgtgctgaagagacccagccagctgagcagaaagaacaacatccccgccaacttcaccagaagcggcaacaagctgaaccaccagaaggacaccagacaggccaccttcctgttcagaagaggcctgaaggtgcaggcccagctgaacaccgagcagctgctggacgacgtggtggccaagagaaccagacagtggagaaccagcaccaccaacggcggcatcctgaccgtgagcatcgacaaccccggcgccgtgcagtgccccgtgacccagaagcccagactgaccagaaccgccgtgcccagcttcctgaccaagagagagcagagcgacgtgaagaaggtgcccaagggcgtgcccctgcagttcgacatcaacagcgtgggcaagcagaccggcatgaccctgaacgagagattcggcatcctgaaggagcagagagccaccctgacctacaacaagggcggcagcagattcgtgaccgtgggctag

SEQ ID NO: 8117 - DNA, 684 bp, Artificial Sequence
  Description of Artificial Sequence: Synthetic coding sequence
atgcccggcaagagaagacccaacggcgtgatcaccggcctggccgccagaaagaccaccggcatcagaaagggcatcagccccatgaacagaccccccctgagcgacaagaacatcgagcagtacttccccgtgctgaagagaaaggccaacctgctgagacagaacgagggccagagaaagcccgtggccgtgctgaagagacccagccagctgagcagaaagaacaacatccccgccaacttcaccagaagcggcaacaagctgaaccaccagaaggacaccagacaggccaccttcctgttcagaagaggcctgaaggtgcaggcccagctgaacaccgagcagctgctggacgacgtggtggccaagagaaccagacagtggagaaccagcaccaccaacggcggcatcctgaccgtgagcatcgacaaccccggcgccgtgcagtgccccgtgacccagaagcccagactgaccagaaccgccgtgcccagcttcctgaccaagagagagcagagcgacgtgaagaaggtgcccaagggcgtgcccctgcagttcgacatcaacagcgtgggcaagcagaccggcatgaccctgaacgagagattcggcatcctgaaggagcagagagccaccctgacctacaacaagggcggcagcagattcgtgaccgtgggctag

SEQ ID NO: 8118 - DNA, 879 bp, Artificial Sequence
  Description of Artificial Sequence: Synthetic coding sequence
atggagcccagcgtgatcatgggcaacgacatcatcaagctgaacagaaaggagggcaagaagcagaacttccccagactgaacagaagactgctgcagcagagcggcgcccagcagttcagaatgagagtgagatggggcatccagcagaacagcggcttcggcaagaccagcctgaacagaagaggcagagtgatgcccggcaagagaagacccaacggcgtgatcaccggcctggccgccagaaagaccaccggcatcagaaagggcatcagccccatgaacagaccccccctgagcgacaagaacatcgagcagtacttccccgtgctgaagagaaaggccaacctgctgagacagaacgagggccagagaaagcccgtggccgtgctgaagagacccagccagctgagcagaaagaacaacatccccgccaacttcaccagaagcggcaacaagctgaaccaccagaaggacaccagacaggccaccttcctgttcagaagaggcctgaaggtgcaggcccagctgaacaccgagcagctgctggacgacgtggtggccaagagaaccagacagtggagaaccagcaccaccaacggcggcatcctgaccgtgagcatcgacaaccccggcgccgtgcagtgccccgtgacccagaagcccagactgaccagaaccgccgtgcccagcttcctgaccaagagagagcagagcgacgtgaagaaggtgcccaagggcgtgcccctgcagttcgacatcaacagcgtgggcaagcagaccggcatgaccctgaacgagagattcggcatcctgaaggagcagagagccaccctgacctacaacaagggcggcagcagattcgtgaccgtgggctag

SEQ ID NO: 8119 - DNA, 837 bp, Artificial Sequence
  Description of Artificial Sequence: Synthetic coding sequence
atgggcaagggcaacgaggaccccgacctgcactgcagcagcatccagtgcagcaccgaccagccccccttccagcagatcagcttcaccgagaagggcagcgacgagaagaagcccttcaaggagaagggcaagaccgccttcagccacagcagcgagaagcacatccagagacagggcagcgagcccaaccccaacaaggagaacagcgaggagaccaagctgaaggccggcaacagcaccgccggcagcgagcccgagagcagcagctacagagagaactgcagaaagagaaagatgagcagcaaggacagctgccaggacaccgccggcaactgccccgagaaggagtgcagcctgagcctgaacaagaagagcagaagcagcacccccgtgcacaacagcgagatccaggagacctgcgacgcccaccacagaggcagaagcagagcctgcaccggcagaagcaagagacacagaagcagagccctgggcgtgcagacccccagcatcagaaagagcctggtgaccagcgtgagagccatgagcgaggccgtgtaccaggacctggcccaggtgtgggcccagcagatccacagccccctgacctgcgagcagctgaccctgctgaccagactgagaggccccctgtgcgcccaggtgcagaccctgtacagcatggccacccaggccgcctacgtgttccccgccgagagctggctggtgcccgccaccctgcccggccccggcgagagcgccctggacagagaggcccaccccttccccggccaggagatcaccgagaccgtgagcggcagcgacgaggccaagctgtag

SEQ ID NO: 8120 - DNA, 840 bp, Artificial Sequence
  Description of Artificial Sequence: Synthetic coding sequence
atgggcaagggcaacgaggaccccgacctgcactgcagcagcatccagtgcagcaccgaccagccccccttccagcagatcagcttcaccgagaagggcagcgacgagaagaagcccttcaaggagaagggcaagaccgccttcagccacagcagcgagaagcacatccagagacaggccggcagcgagcccaaccccaacaaggagaacagcgaggagaccaagctgaaggccggcaacagcaccgccggcagcgagcccgagagcagcagctacagagagaactgcagaaagagaaagatgagcagcaaggacagctgccaggacaccgccggcaactgccccgagaaggagtgcagcctgagcctgaacaagaagagcagaagcagcacccccgtgcacaacagcgagatccaggagacctgcgacgcccaccacagaggcagaagcagagcctgcaccggcagaagcaagagacacagaagcagagccctgggcgtgcagacccccagcatcagaaagagcctggtgaccagcgtgagagccatgagcgaggccgtgtaccaggacctggcccaggtgtgggcccagcagatccacagccccctgacctgcgagcagctgaccctgctgaccagactgagaggccccctgtgcgcccaggtgcagaccctgtacagcatggccacccaggccgcctacgtgttccccgccgagagctggctggtgcccgccaccctgcccggccccggcgagagcgccctggacagagaggcccaccccttccccggccaggagatcaccgagaccgtgagcggcagcgacgaggccaagctgtag

SEQ ID NO: 8121 - DNA, 2544 bp, Artificial Sequence
  Description of Artificial Sequence: Synthetic coding sequence
atgggcaagaagggcaaggtgggcaagagcagaagagacaagttctaccacctggccaaggagaccggctacagaagcagaagcgccttcaagctgatccagctgaacagaagattccagttcctgcagaaggccagagccctgctggacctgtgcgccgcccccggcggctggctgcaggtggccgccaagttcatgcccgtgagcagcctgatcgtgggcgtggacctggtgcccatcaagcccctgcccaacgtggtgaccctgcagcaggacatcaccaccgagagatgcagacaggccctgagaaaggagctgaagacctggaaggtggacgtggtgctgaacgacggcgcccccaacgtgggcgccagctgggtgcacgacgcctacagccaggcccacctgaccctgatggccctgagactggcctgcgacttcctggccagaggcggcagcttcatcaccaaggtgttcagaagcagagactaccagcccctgctgtggatcttccagcagctgttcagaagagtgcaggccaccaagccccaggccagcagacacgagagcgccgagatcttcgtggtgtgccagggcttcctggcccccgacaaggtggacagcaagttcttcgaccccaagttcgccttcaaggaggtggaggtgcaggccaagaccgtgaccgagctggtgaccaagaagaagcccaaggccgagggctacgccgagggcgacctgaccctgtaccacagaaccagcgtgaccgacttcctgagagccgccaaccccgtggacttcctgagcaaggccagcgagatcatggtggacgacgaggagctggcccagcaccccgccaccaccgaggacatcagagtgtgctgccaggacatcagagtgctgggcagaaaggagctgagaagcctgctgaactggagaaccaagctgagaagatacgtggccaagaagctgaaggagcaggccaaggccctggacatcagcctgagcagcggcgaggaggacgagggcgacgaggaggacagcaccgccggcaccaccaagcagcccagcaaggaggaggaggaggaggaggaggaggagcagctgaaccagaccctggccgagatgaaggcccaggaggtggccgagctgaagagaaagaagaagaagctgctgagagagcagagaaagcagagagagagagtggagctgaagatggacctgcccggcgtgagcatcgccgacgagggcgagaccggcatgttcagcctgagcaccatcagaggccaccagctgctggaggaggtgacccagggcgacatgagcgccgccgacaccttcctgagcgacctgcccagagacgacatctacgtgagcgacgtggaggacgacggcgacgacaccagcctggacagcgacctggaccccgaggagctggccggcgtgagaggccaccagggcctgagagaccagaagagaatgagactgaccgaggtgcaggacgacaaggaggaggaggaggaggagaaccccctgctggtgcccctggaggagaaggccgtgctgcaggaggagcaggccaacctgtggttcagcaagggcagcttcgccggcatcgaggacgacgccgacgaggccctggagatcagccaggcccagctgctgttcgagaacagaagaaagggcagacagcagcagcagaagcagcagctgccccagaccccccccagctgcctgaagaccgagatcatgagccccctgtaccaggacgaggcccccaagggcaccgaggccagcagcggcaccgaggccgccaccggcctggagggcgaggagaaggacggcatcagcgacagcgacagcagcaccagcagcgaggaggaggagagctgggagcccctgagaggcaagaagagaagcagaggccccaagagcgacgacgacggcttcgagatcgtgcccatcgaggaccccgccaagcacagaatcctggaccccgagggcctggccctgggcgccgtgatcgccagcagcaagaaggccaagagagacctgatcgacaacagcttcaacagatacaccttcaacgaggacgagggcgagctgcccgagtggttcgtgcaggaggagaagcagcacagaatcagacagctgcccgtgggcaagaaggaggtggagcactacagaaagagatggagagagatcaacgccagacccatcaagaaggtggccgaggccaaggccagaaagaagagaagaatgctgaagagactggagcagaccagaaagaaggccgaggccgtggtgaacaccgtggacatcagcgagagagagaaggtggcccagctgagaagcctgtacaagaaggccggcctgggcaaggagaagagacacgtgacctacgtggtggccaagaagggcgtgggcagaaaggtgagaagacccgccggcgtgagaggccacttcaaggtggtggacagcagaatgaagaaggaccagagagcccagcagagaaaggagcagaagaagaagcacaagagaaagtag

SEQ ID NO: 8122 - DNA, 1431 bp, Artificial Sequence
  Description of Artificial Sequence: Synthetic coding sequence
atggccgacagcaaggagggcgtgctgcccctgaccgccgccagcaccgcccccatcagcttcggcttcaccagaaccagcgccagaagaagactggccgacagcggcgacggcgccggccccagccccgaggagaaggacttcctgaagaccgtggagggcagagagctgcagagcgtgaagccccaggaggcccccaaggagctggtgatccccctgatccagaacggccacagaagacagccccccgccagaccccccggccccagcaccgacaccggcgccctggccgacggcgtggtgagccaggccgtgaaggagctgatcgccgagagcaagaagagcctggaggagagagagaacgccggcgtggaccccaccctggccatccccatgatccagaagggctgcacccccagcggcgagggcgccgacagcgagcccagagccgagaccgtgcccgaggaggccaactacgaggccgtgcccgtggaggcctacggcctggccatgctgagaggcatgggctggaagcccggcgagggcatcggcagaaccttcaaccaggtggtgaagcccagagtgaacagcctgagacccaagggcctgggcctgggcgccaacctgaccgaggcccaggccctgacccccaccggccccagcagaatgcccagacccgacgaggagcaggagaaggacaaggaggaccagccccagggcctggtgcccggcggcgccgtggtggtgctgagcggcccccacagaggcctgtacggcaaggtggagggcctggaccccgacaacgtgagagccatggtgagactggccgtgggcagcagagtggtgaccgtgagcgagtactacctgagacccgtgagccagcaggagttcgacaagaacaccctggacctgagacagcagaacggcaccgccagcagcagaaagaccctgtggaaccaggagctgtacatccagcaggacaacagcgagagaaagagaaagcacctgcccgacagacaggacggccccgccgccaagagcgagaaggccgcccccagaagccagcactggctgcacagagacctgagagtgagattcgtggacaacatgtacaagggcggccagtactacaacaccaagatgatcatcgaggacgtgctgagccccgacacctgcgtgtgcagaaccgacgagggcagagtgctggagggcctgagagaggacatgctggagaccctggtgcccaaggccgagggcgacagagtgatggtggtgctgggcccccagaccggcagagtgggccacctgctgagcagagacagagccagaagcagagccctggtgcagctgcccagagagaaccaggtggtggagctgcactacgacgccatctgccagtacatgggccccagcgacaccgacgacgactag

SEQ ID NO: 8123 - DNA, 2796 bp, Artificial Sequence
  Description of Artificial Sequence: Synthetic coding sequence
atggccgccagagacagcgacagcgaggaggacctggtgagctacggcaccggcctggagcccctggaggagggcgagagacccaagaagcccatccccctgcaggaccagaccgtgagagacgagaagggcagatacaagagattccacggcgccttcagcggcggcttcagcgccggctacttcaacaccgtgggcagcaaggagggctggacccccagcaccttcgtgagcagcagacagaacagagccgacaagagcgtgctgggccccgaggacttcatggacgaggaggacctgagcgagttcggcatcgcccccaaggccatcgtgaccaccgacgacttcgccagcaagaccaaggacagaatcagagagaaggccagacagctggccgccgccaccgcccccatccccggcgccaccctgctggacgacctgatcacccccgccaagctgagcgtgggcttcgagctgctgagaaagatgggctggaaggagggccagggcgtgggccccagagtgaagagaagacccagaagacagaagcccgaccccggcgtgaagatctacggctgcgccctgccccccggcagcagcgagggcagcgagggcgaggacgacgactacctgcccgacaacgtgaccttcgcccccaaggacgtgacccccgtggacttcacccccaaggacaacgtgcacggcctggcctacaagggcctggacccccaccaggccctgttcggcaccagcggcgagcacttcaacctgttcagcggcggcagcgagagagccggcgacctgggcgagatcggcctgaacaagggcagaaagctgggcatcagcggccaggccttcggcgtgggcgccctggaggaggaggacgacgacatctacgccaccgagaccctgagcaagtacgacaccgtgctgaaggacgaggagcccggcgacggcctgtacggctggaccgcccccagacagtacaagaaccagaaggagagcgagaaggacctgagatacgtgggcaagatcctggacggcttcagcctggccagcaagcccctgagcagcaagaagatctaccccccccccgagctgcccagagactacagacccgtgcactacttcagacccatggtggccgccaccagcgagaacagccacctgctgcaggtgctgagcgagagcgccggcaaggccacccccgaccccggcacccacagcaagcaccagctgaacgccagcaagagagccgagctgctgggcgagacccccatccagggcagcgccaccagcgtgctggagttcctgagccagaaggacaaggagagaatcaaggagatgaagcaggccaccgacctgaaggccgcccagctgaaggccagaagcctggcccagaacgcccagagcagcagagcccagctgagccccgccgccgccgccggccactgcagctggaacatggccctgggcggcggcaccgccaccctgaaggccagcaacttcaagcccttcgccaaggaccccgagaagcagaagagatacgacgagttcctggtgcacatgaagcagggccagaaggacgccctggagagatgcctggaccccagcatgaccgagtgggagagaggcagagagagagacgagttcgccagagccgccctgctgtacgccagcagccacagcaccctgagcagcagattcacccacgccaaggaggaggacgacagcgaccaggtggaggtgcccagagaccaggagaacgacgtgggcgacaagcagagcgccgtgaagatgaagatgttcggcaagctgaccagagacaccttcgagtggcaccccgacaagctgctgtgcaagagattcaacgtgcccgacccctaccccgacagcaccctggtgggcctgcccagagtgaagagagacaagtacagcgtgttcaacttcctgaccctgcccgagaccgccagcctgcccaccacccaggccagcagcgagaaggtgagccagcacagaggccccgacaagagcagaaagcccagcagatgggacaccagcaagcacgagaagaaggaggacagcatcagcgagttcctgagcctggccagaagcaaggccgagccccccaagcagcagagcagccccctggtgaacaaggaggaggagcacgcccccgagctgagcgccaaccagaccgtgaacaaggacgtggacgcccaggccgagggcgagggcagcagacccagcatggacctgttcagagccatcttcgccagcagcagcgacgagaagagcagcagcagcgaggacgagcagggcgacagcgaggacgaccaggccggcagcggcgaggccaacttccagagcagccaggacaccgacctgggcgagaccagcagcgtggcccacgccctggtgcccgccccccaggagcccccccccagcttccccatccagaagatgcagatcgacgagagagaggagttcggccccagactgccccccgtgttctgccccaacgccagacagaccctggaggtgccccagaaggagaagcacaagaagaacaaggacaagcacaaggccaagaaggagcacagaagaaagaaggagaagaagaagaagcacagaaagcacaagcacaagggcaagcagaagaacaagaagcccgagaagagcagcagcagcgagagcagcgacagcagcgacagccagagcgacgaggagaccgccgacgtgagcccccaggagctgctgagaagactgaagagcctgcccctgagaagacagtag

SEQ ID NO: 8124 - DNA, 984 bp, Artificial Sequence
  Description of Artificial Sequence: Synthetic coding sequence
atgcccgccctgctggagagacccaagctgagcaacgccatggccagagccctgcacagacacatcatgatggagagagagagaaagagacaggaggaggaggaggtggacaagatgatggagcagaagatgaaggaggagcaggagagaagaaagaagaaggagatggaggagagaatgagcctggaggagaccaaggagcagatcctgaagctggaggagaagctgctggccctgcaggaggagaagcaccagctgttcctgcagctgaagaaggtgctgcacgaggaggagaagagaagaagaaaggagcagagcgacctgaccaccctgaccagcgccgcctaccagcagagcctgaccgtgcacaccggcacccacctgctgagcatgcagggcagccccggcggccacaacagacccggcaccctgatggccgccgacagagccaagcagatgttcggcccccaggtgctgaccaccagacactacgtgggcagcgccgccgccttcgccggcacccccgagcacggccagttccagggcagccccggcggcgcctacggcaccgcccagccccccccccactacggccccacccagcccgcctacagccccagccagcagctgagagcccccagcgccttccccgccgtgcagtacctgagccagccccagccccagccctacgccgtgcacggccacttccagcccacccagaccggcttcctgcagcccggcggcgccctgagcctgcagaagcagatggagcacgccaaccagcagaccggcttcagcgacagcagcagcctgagacccatgcacccccaggccctgcaccccgcccccggcctgctggccagcccccagctgcccgtgcagatgcagcccgccggcaagagcggcttcgccgccaccagccagcccggccccagactgcccttcatccagcacagccagaaccccagattctaccacaagtag

SEQ ID NO: 8125 - DNA, 984 bp, Artificial Sequence; identical to SEQ ID NO: 8124
  Description of Artificial Sequence: Synthetic coding sequence

SEQ ID NO: 8126 - DNA, 984 bp, Artificial Sequence; identical to SEQ ID NO: 8124
  Description of Artificial Sequence: Synthetic coding sequence

SEQ ID NO: 8127 - DNA, 912 bp, Artificial Sequence
  Description of Artificial Sequence: Synthetic coding sequence
atgcccgccctgctggagagacccaagctgagcaacgccatggccagagccctgcacagacacatcatgatggagagagagagaaagagacaggaggaggaggaggtggacaagatgatggagcagaagatgaaggaggagcaggagagaagaaagaagaaggagatggaggagagaatgagcctggaggagaccaaggagcagatcctgaagctggaggagaagctgctggccctgcaggaggagaagcaccagctgttcctgcagctgaagaaggtgctgcacgaggaggagaagagaagaagaaaggagcagagcgacctgaccaccctgaccagcgccgcctaccagcagagcctgaccgtgcacaccggcacccacctgctgagcatgcagggcagccccggcggccacaacagacccggcaccctgatggccgccgacagagccaagcagatgttcggcccccaggtgctgaccaccagacactacgtgggcagcgccgccgccttcgccggcacccccgagcacggccagttccagggcagccccggcggcgcctacggcaccgcccagccccccccccactacggccccacccagcccgcctacagccccagccagcagctgagagcccccagcgccttccccgccgtgcagtacctgagccagccccagccccagccctacgccgtgcacggccacttccagcccacccagaccggcttcctgcagcccggcggcgccctgagcctgcagaagcagatggagcacgccaaccagcagaccggcttcagcgacagcagcagcctgagacccatgcacccccaggccctgcaccccgcccccggcctgctggccagcccccagctgcccgtgcagatgcagcccgccggcaagaccgccccctag

SEQ ID NO: 8128 - DNA, 1986 bp, Artificial Sequence
  Description of Artificial Sequence: Synthetic coding sequence
atgagcaagagactgagaagcagcgaggtgtgcgccgactgcagcggccccgaccccagctgggccagcgtgaacagaggcaccttcctgtgcgacgagtgctgcagcgtgcacagaagcctgggcagacacatcagccaggtgagacacctgaagcacaccccctggccccccaccctgctgcagatggtggagaccctgtacaacaacggcgccaacagcatctgggagcacagcctgctggaccccgccagcatcatgagcggcagaagaaaggccaacccccaggacaaggtgcaccccaacaaggccgagttcatcagagccaagtaccagatgctggccttcgtgcacagactgccctgcagagacgacgacagcgtgaccgccaaggacctgagcaagcagctgcacagcagcgtgagaaccggcaacctggagacctgcctgagactgctgagcctgggcgcccaggccaacttcttccaccccgagaagggcaacacccccctgcacgtggccagcaaggccggccagatcctgcaggccgagctgctggccgtgtacggcgccgaccccggcacccaggacagcagcggcaagacccccgtggactacgccagacagggcggccaccacgagctggccgagagactggtggagatccagtacgagctgaccgacagactggccttctacctgtgcggcagaaagcccgaccacaagaacggccagcacttcatcatcccccagatggccgacagcagcctggacctgagcgagctggccaaggccgccaagaagaagctgcagagcctgagcaaccacctgttcgaggagctggccatggacgtgtacgacgaggtggacagaagagagaccgacgccgtgtggctggccacccagaaccacagcgccctggtgaccgagaccaccgtggtgcccttcctgcccgtgaaccccgagtacagcagcaccagaaaccagggcagacagaagctggccagattcaacgcccacgagttcgccaccctggtgatcgacatcctgagcgacgccaagagaagacagcagggcagcagcctgagcggcagcaaggacaacgtggagctgatcctgaagaccatcaacaaccagcacagcgtggagagccaggacaacgaccagcccgactacgacagcgtggccagcgacgaggacaccgacctggagaccaccgccagcaagaccaacagacagaagagcctggacagcgacctgagcgacggccccgtgaccgtgcaggagttcatggaggtgaagaacgccctggtggccagcgaggccaagatccagcagctgatgaagatcggcagaagcgccctggtgaccagcagcagcagcctgcccagcttccccagcaccctgagctggagcagagacgagagcgccagaagagccagcagactggagaagcagaacagcacccccgagagcgactacgacaacacccccaacgacatggagcccgacggcatgggcagcagcagaaagggcagacagagaagcatggtgtggcccggcgacggcctggtgcccgacaccgccgagccccacgtggcccccagccccaccctgcccagcaccgaggacgtgatcagaaagaccgagcagatcaccaagaacatccaggagctgctgagagccgcccaggagaacaagcacgacagctacatcccctgcagcgagagaatccacgtggccgtgaccgagatggccgccctgttccccaagaagcccaagagcgacatggtgagaaccagcctgagactgctgaccagcagcgcctacagactgcagagcgagtgcaagaagaccctgcccggcgaccccggcagccccaccgacgtgcagctggtgacccagcaggtgatccagtgcgcctacgacatcgccaaggccgccaagcagctggtgaccatcaccaccaaggagaacaacaactag

SEQ ID NO: 8129 - DNA, 1950 bp, Artificial Sequence
  Description of Artificial Sequence: Synthetic coding sequence
atgagcaagagactgagaagcagcgaggtgtgcgccgactgcagcggccccgaccccagctgggccagcgtgaacagaggcaccttcctgtgcgacgagtgctgcagcgtgcacagaagcctgggcagacacatcagccaggtgagacacctgaagcacaccccctggccccccaccctgctgcagatggtggagaccctgtacaacaacggcgccaacagcatctgggagcacagcctgctggaccccgccagcatcatgagcggcagaagaaaggccaacccccaggacaaggtgcaccccaacaaggccgagttcatcagagccaagtaccagatgctggccttcgtgcacagactgccctgcagagacgacgacagcgtgaccgccaaggacctgagcaagcagctgcacagcagcgtgagaaccggcaacctggagacctgcctgagactgctgagcctgggcgcccaggccaacttcttccaccccgagaagggcaacacccccctgcacgtggccagcaaggccggccagatcctgcaggccgagctgctggccgtgtacggcgccgaccccggcacccaggacagcagcggcaagacccccgtggactacgccagacagggcggccaccacgagctggccgagagactggtggagatccagtacgagctgaccgacagactggccttctacctgtgcggcagaaagcccgaccacaagaacggccagcacttcatcatcccccagatggccgacagcagcctggacctgagcgagctggccaaggccgccaagaagaagctgcagagcctgagcaaccacctgttcgaggagctggccatggacgtgtacgacgaggtggacagaagagagaccgacgccgtgtggctggccacccagaaccacagcgccctggtgaccgagaccaccgtggtgcccttcctgcccgtgaaccccgagtacagcagcaccagaaaccagggccagcccaagaagagcctggacagcgacctgagcgacggccccgtgaccgtgcaggagttcatggaggtgaagaacgccctggtggccagcgaggccaagatccagcagctgatgaaggtgaacaacaacctgagcgacgagctgagaatcatgcagaagaagctgcagaccctgcagagcgagaacagcaacctgagaaagcaggccaccaccaacgtgtaccaggtgcagaccggcagcgagtacaccgacaccagcaaccacagcagcctgaagagaagacccagcgccagaggcagcagacccatgagcatgtacgagaccggcagcggccagaagccctacctgcccatgggcgaggccagcagacccgaggagagcagaatgagactgcagcccttccccgcccacgccagcagactggagaagcagaacagcacccccgagagcgactacgacaacacccccaacgacatggagcccgacggcatgggcagcagcagaaagggcagacagagaagcatggtgtggcccggcgacggcctggtgcccgacaccgccgagccccacgtggcccccagccccaccctgcccagcaccgaggacgtgatcagaaagaccgagcagatcaccaagaacatccaggagctgctgagagccgcccaggagaacaagcacgacagctacatcccctgcagcgagagaatccacgtggccgtgaccgagatggccgccctgttccccaagaagcccaagagcgacatggtgagaaccagcctgagactgctgaccagcagcgcctacagactgcagagcgagtgcaagaagaccctgcccggcgaccccggcagccccaccgacgtgcagctggtgacccagcaggtgatccagtgcgcctacgacatcgccaaggccgccaagcagctggtgaccatcaccaccaaggagaacaacaactag

SEQ ID NO: 8130 - DNA, 2046 bp, Artificial Sequence
  Description of Artificial Sequence: Synthetic coding sequence
atgagcaagagactgagaagcagcgaggtgtgcgccgactgcagcggccccgaccccagctgggccagcgtgaacagaggcaccttcctgtgcgacgagtgctgcagcgtgcacagaagcctgggcagacacatcagccaggtgagacacctgaagcacaccccctggccccccaccctgctgcagatggtggagaccctgtacaacaacggcgccaacagcatctgggagcacagcctgctggaccccgccagcatcatgagcggcagaagaaaggccaacccccaggacaaggtgcaccccaacaaggccgagttcatcagagccaagtaccagatgctggccttcgtgcacagactgccctgcagagacgacgacagcgtgaccgccaaggacctgagcaagcagctgcacagcagcgtgagaaccggcaacctggagacctgcctgagactgctgagcctgggcgcccaggccaacttcttccaccccgagaagggcaacacccccctgcacgtggccagcaaggccggccagatcctgcaggccgagctgctggccgtgtacggcgccgaccccggcacccaggacagcagcggcaagacccccgtggactacgccagacagggcggccaccacgagctggccgagagactggtggagatccagtacgagctgaccgacagactggccttctacctgtgcggcagaaagcccgaccacaagaacggccagcacttcatcatcccccagatggccgacagaagaagcagcctggacctgagcgagctggccaaggccgccaagaagaagctgcagagcctgagcaaccacctgttcgaggagctggccatggacgtgtacgacgaggtggacagaagagagaccgacgccgtgtggctggccacccagaaccacagcgccctggtgaccgagaccaccgtggtgcccttcctgcccgtgaaccccgagtacagcagcaccagaaaccagggcagacagaagctggccagattcaacgcccacgagttcgccaccctggtgatcgacatcctgagcgacgccaagagaagacagcagggcagcagcctgagcggcagcaaggacaacgtggagctgatcctgaagaccatcaacaaccagcacagcgtggagagccaggacaacgaccagcccgactacgacagcgtggccagcgacgaggacaccgacctggagaccaccgccagcaagaccaacagacagaagctgcagaccctgcagagcgagaacagcaacctgagaaagcaggccaccaccaacgtgtaccaggtgcagaccggcagcgagtacaccgacaccagcaaccacagcagcctgaagagaagacccagcgccagaggcagcagacccatgagcatgtacgagaccggcagcggccagaagccctacctgcccatgggcgaggccagcagacccgaggagagcagaatgagactgcagcccttccccgcccacgccagcagactggagaagcagaacagcacccccgagagcgactacgacaacacccccaacgacatggagcccgacggcatgggcagcagcagaaagggcagacagagaagcatggtgtggcccggcgacggcctggtgcccgacaccgccgagccccacgtggcccccagccccaccctgcccagcaccgaggacgtgatcagaaagaccgagcagatcaccaagaacatccaggagctgctgagagccgcccaggagaacaagcacgacagctacatcccctgcagcgagagaatccacgtggccgtgaccgagatggccgccctgttccccaagaagcccaagagcgacatggtgagaaccagcctgagactgctgaccagcagcgcctacagactgcagagcgagtgcaagaagaccctgcccggcgaccccggcagccccaccgacgtgcagctggtgacccagcaggtgatccagtgcgcctacgacatcgccaaggccgccaagcagctggtgaccatcaccaccaaggagaacaacaactag

SEQ ID NO: 8131 - DNA, 2280 bp, Artificial Sequence
  Description of Artificial Sequence: Synthetic coding sequence
atgagcaagagactgagaagcagcgaggtgtgcgccgactgcagcggccccgaccccagctgggccagcgtgaacagaggcaccttcctgtgcgacgagtgctgcagcgtgcacagaagcctgggcagacacatcagccaggtgagacacctgaagcacaccccctggccccccaccctgctgcagatggtggagaccctgtacaacaacggcgccaacagcatctgggagcacagcctgctggaccccgccagcatcatgagcggcagaagaaaggccaacccccaggacaaggtgcaccccaacaaggccgagttcatcagagccaagtaccagatgctggccttcgtgcacagactgccctgcagagacgacgacagcgtgaccgccaaggacctgagcaagcagctgcacagcagcgtgagaaccggcaacctggagacctgcctgagactgctgagcctgggcgcccaggccaacttcttccaccccgagaagggcaacacccccctgcacgtggccagcaaggccggccagatcctgcaggccgagctgctggccgtgtacggcgccgaccccggcacccaggacagcagcggcaagacccccgtggactacgccagacagggcggccaccacgagctggccgagagactggtggagatccagtacgagctgaccgacagactggccttctacctgtgcggcagaaagcccgaccacaagaacggccagcacttcatcatcccccagatggccgacagcagcctggacctgagcgagctggccaaggccgccaagaagaagctgcagagcctgagcaaccacctgttcgaggagctggccatggacgtgtacgacgaggtggacagaagagagaccgacgccgtgtggctggccacccagaaccacagcgccctggtgaccgagaccaccgtggtgcccttcctgcccgtgaaccccgagtacagcagcaccagaaaccagggcagacagaagctggccagattcaacgcccacgagttcgccaccctggtgatcgacatcctgagcgacgccaagagaagacagcagggcagcagcctgagcggcagcaaggacaacgtggagctgatcctgaagaccatcaacaaccagcacagcgtggagagccaggacaacgaccagcccgactacgacagcgtggccagcgacgaggacaccgacctggagaccaccgccagcaagaccaacagacagaagagcctggacagcgacctgagcgacggccccgtgaccgtgcaggagttcatggaggtgaagaacgccctggtggccagcgaggccaagatccagcagctgatgaaggtgaacaacaacctgagcgacgagctgagaatcatgcagaagaagctgcagaccctgcagagcgagaacagcaacctgagaaagcaggccaccaccaacgtgtaccaggtgcagaccggcagcgagtacaccgacaccagcaaccacagcagcctgaagagaagacccagcgccagaggcagcagacccatgagcatgtacgagaccggcagcggccagaagccctacctgcccatgggcgaggccagcagacccgaggagagcagaatgagactgcagcccttccccgcccacatcggcagaagcgccctggtgaccagcagcagcagcctgcccagcttccccagcaccctgagctggagcagagacgagagcgccagaagagccagcagactggagaagcagaacagcacccccgagagcgactacgacaacacccccaacgacatggagcccgacggcatgggcagcagcagaaagggcagacagagaagcatggtgtggcccggcgacggcctggtgcccgacaccgccgagccccacgtggcccccagccccaccctgcccagcaccgaggacgtgatcagaaagaccgagcagatcaccaagaacatccaggagctgctgagagccgcccaggagaacaagcacgacagctacatcccctgcagcgagagaatccacgtggccgtgaccgagatggccgccctgttccccaagaagcccaagagcgacatggtgagaaccagcctgagactgctgaccagcagcgcctacagactgcagagcgagtgcaagaagaccctgcccggcgaccccggcagccccaccgacgtgcagctggtgacccagcaggtgatccagtgcgcctacgacatcgccaaggccgccaagcagctggtgaccatcaccaccaaggagaacaacaactag

SEQ ID NO: 8132 - DNA, 1941 bp, Artificial Sequence
  Description of Artificial Sequence: Synthetic coding sequence
atgagcaagagactgagaagcagcgaggtgtgcgccgactgcagcggccccgaccccagctgggccagcgtgaacagaggcaccttcctgtgcgacgagtgctgcagcgtgcacagaagcctgggcagacacatcagccaggtgagacacctgaagcacaccccctggccccccaccctgctgcagatggtggagaccctgtacaacaacggcgccaacagcatctgggagcacagcctgctggaccccgccagcatcatgagcggcagaagaaaggccaacccccaggacaaggtgcaccccaacaaggccgagttcatcagagccaagtaccagatgctggccttcgtgcacagactgccctgcagagacgacgacagcgtgaccgccaaggacctgagcaagcagctgcacagcagcgtgagaaccggcaacctggagacctgcctgagactgctgagcctgggcgcccaggccaacttcttccaccccgagaagggcaacacccccctgcacgtggccagcaaggccggccagatcctgcaggccgagctgctggccgtgtacggcgccgaccccggcacccaggacagcagcggcaagacccccgtggactacgccagacagggcggccaccacgagctggccgagagactggtggagatccagtacgagctgaccgacagactggccttctacctgtgcggcagaaagcccgaccacaagaacggccagcacttcatcatcccccagatggccgacagcagcctggacctgagcgagctggccaaggccgccaagaagaagctgcagagcctgagcaaccacctgttcgaggagctggccatggacgtgtacgacgaggtggacagaagagagaccgacgccgtgtggctggccacccagaaccacagcgccctggtgaccgagaccaccgtggtgcccttcctgcccgtgaaccccgagtacagcagcaccagaaaccagggcagacagaagctggccagattcaacgcccacgagttcgccaccctggtgatcgacatcctgagcgacgccaagagaagacagcagggcagcagcctgagcggcagcaaggacaacgtggagctgatcctgaagaccatcaacaaccagcacagcgtggagagccaggacaacgaccagcccgactacgacagcgtggccagcgacgaggacaccgacctggagaccaccgccagcaagaccaacagacagaagagcctggacagcgacctgagcgacggccccgtgaccgtgcaggagttcatggaggtgaagaacgccctggtggccagcgaggccaagatccagcagctgatgaaggtgaacaacaacctgagcgacgagctgagaatcatgcagaagaaggccagcagactggagaagcagaacagcacccccgagagcgactacgacaacacccccaacgacatggagcccgacggcatgggcagcagcagaaagggcagacagagaagcatggtgtggcccggcgacggcctggtgcccgacaccgccgagccccacgtggcccccagccccaccctgcccagcaccgaggacgtgatcagaaagaccgagcagatcaccaagaacatccaggagctgctgagagccgcccaggagaacaagcacgacagctacatcccctgcagcgagagaatccacgtggccgtgaccgagatggccgccctgttccccaagaagcccaagagcgacatggtgagaaccagcctgagactgctgaccagcagcgcctacagactgcagagcgagtgcaagaagaccctgcccggcgaccccggcagccccaccgacgtgcagctggtgacccagcaggtgatccagtgcgcctacgacatcgccaaggccgccaagcagctggtgaccatcaccaccaaggagaacaacaactag

SEQ ID NO: 8133 - DNA, 2130 bp, Artificial Sequence
  Description of Artificial Sequence: Synthetic coding sequence
atgagcaagagactgagaagcagcgaggtgtgcgccgactgcagcggccccgaccccagctgggccagcgtgaacagaggcaccttcctgtgcgacgagtgctgcagcgtgcacagaagcctgggcagacacatcagccaggtgagacacctgaagcacaccccctggccccccaccctgctgcagatggtggagaccctgtacaacaacggcgccaacagcatctgggagcacagcctgctggaccccgccagcatcatgagcggcagaagaaaggccaacccccaggacaaggtgcaccccaacaaggccgagttcatcagagccaagtaccagatgctggccttcgtgcacagactgccctgcagagacgacgacagcgtgaccgccaaggacctgagcaagcagctgcacagcagcgtgagaaccggcaacctggagacctgcctgagactgctgagcctgggcgcccaggccaacttcttccaccccgagaagggcaacacccccctgcacgtggccagcaaggccggccagatcctgcaggccgagctgctggccgtgtacggcgccgaccccggcacccaggacagcagcggcaagacccccgtggactacgccagacagggcggccaccacgagctggccgagagactggtggagatccagtacgagctgaccgacagactggccttctacctgtgcggcagaaagcccgaccacaagaacggccagcacttcatcatcccccagatggccgacagcagcctggacctgagcgagctggccaaggccgccaagaagaagctgcagagcctgagcaaccacctgttcgaggagctggccatggacgtgtacgacgaggtggacagaagagagaccgacgccgtgtggctggccacccagaaccacagcgccctggtgaccgagaccaccgtggtgcccttcctgcccgtgaaccccgagtacagcagcaccagaaaccagggcagacagaagctggccagattcaacgcccacgagttcgccaccctggtgatcgacatcctgagcgacgccaagagaagacagcagggcagcagcctgagcggcagcaaggacaacgtggagctgatcctgaagaccatcaacaaccagcacagcgtggagagccaggacaacgaccagcccgactacgacagcgtggccagcgacgaggacaccgacctggagaccaccgccagcaagaccaacagacagaagctgcagaccctgcagagcgagaacagcaacctgagaaagcaggccaccaccaacgtgtaccaggtgcagaccggcagcgagtacaccgacaccagcaaccacagcagcctgaagagaagacccagcgccagaggcagcagacccatgagcatgtacgagaccggcagcggccagaagccctacctgcccatgggcgaggccagcagacccgaggagagcagaatgagactgcagcccttccccgcccacatcggcagaagcgccctggtgaccagcagcagcagcctgcccagcttccccagcaccctgagctggagcagagacgagagcgccagaagagccagcagactggagaagcagaacagcacccccgagagcgactacgacaacacccccaacgacatggagcccgacggcatgggcagcagcagaaagggcagacagagaagcatggtgtggcccggcgacggcctggtgcccgacaccgccgagccccacgtggcccccagccccaccctgcccagcaccgaggacgtgatcagaaagaccgagcagatcaccaagaacatccaggagctgctgagagccgcccaggagaacaagcacgacagctacatcccctgcagcgagagaatccacgtggccgtgaccgagatggccgccctgttccccaagaagcccaagagcgacatggtgagaaccagcctgagactgctgaccagcagcgcctacagactgcagagcgagtgcaagaagaccctgcccggcgaccccggcagccccaccgacgtgcagctggtgacccagcaggtgatccagtgcgcctacgacatcgccaaggccgccaagcagctggtgaccatcaccaccaaggagaacaacaactag

SEQ ID NO: 8134 - DNA, 2190 bp, Artificial Sequence
  Description of Artificial Sequence: Synthetic coding sequence
atgagcaagagactgagaagcagcgaggtgtgcgccgactgcagcggccccgaccccagctgggccagcgtgaacagaggcaccttcctgtgcgacgagtgctgcagcgtgcacagaagcctgggcagacacatcagccaggtgagacacctgaagcacaccccctggccccccaccctgctgcagatggtggagaccctgtacaacaacggcgccaacagcatctgggagcacagcctgctggaccccgccagcatcatgagcggcagaagaaaggccaacccccaggacaaggtgcaccccaacaaggccgagttcatcagagccaagtaccagatgctggccttcgtgcacagactgccctgcagagacgacgacagcgtgaccgccaaggacctgagcaagcagctgcacagcagcgtgagaaccggcaacctggagacctgcctgagactgctgagcctgggcgcccaggccaacttcttccaccccgagaagggcaacacccccctgcacgtggccagcaaggccggccagatcctgcaggccgagctgctggccgtgtacggcgccgaccccggcacccaggacagcagcggcaagacccccgtggactacgccagacagggcggccaccacgagctggccgagagactggtggagatccagtacgagctgaccgacagactggccttctacctgtgcggcagaaagcccgaccacaagaacggccagcacttcatcatcccccagatggccgacagcagcctggacctgagcgagctggccaaggccgccaagaagaagctgcagagcctgagcaaccacctgttcgaggagctggccatggacgtgtacgacgaggtggacagaagagagaccgacgccgtgtggctggccacccagaaccacagcgccctggtgaccgagaccaccgtggtgcccttcctgcccgtgaaccccgagtacagcagcaccagaaaccagggcagacagaagctggccagattcaacgcccacgagttcgccaccctggtgatcgacatcctgagcgacgccaagagaagacagcagggcagcagcctgagcggcagcaaggacaacgtggagctgatcctgaagaccatcaacaaccagcacagcgtggagagccaggacaacgaccagcccgactacgacagcgtggccagcgacgaggacaccgacctggagaccaccgccagcaagaccaacagacagaagagcctggacagcgacctgagcgacggccccgtgaccgtgcaggagttcatggaggtgaagaacgccctggtggccagcgaggccaagatccagcagctgatgaaggtgaacaacaacctgagcgacgagctgagaatcatgcagaagaagctgcagaccctgcagagcgagaacagcaacctgagaaagcaggccaccaccaacgtgtaccaggtgcagaccggcagcgagtacaccgacaccagcaaccacagcagcctgaagagaagacccagcgccagaggcagcagacccatgagcatgtacgagaccggcagcggccagaagccctacctgcccatgggcgaggccagcagacccgaggagagcagaatgagactgcagcccttccccgcccacgccagcagactggagaagcagaacagcacccccgagagcgactacgacaacacccccaacgacatggagcccgacggcatgggcagcagcagaaagggcagacagagaagcatggtgtggcccggcgacggcctggtgcccgacaccgccgagccccacgtggcccccagccccaccctgcccagcaccgaggacgtgatcagaaagaccgagcagatcaccaagaacatccaggagctgctgagagccgcccaggagaacaagcacgacagctacatcccctgcagcgagagaatccacgtggccgtgaccgagatggccgccctgttccccaagaagcccaagagcgacatggtgagaaccagcctgagactgctgaccagcagcgcctacagactgcagagcgagtgcaagaagaccctgcccggcgaccccggcagccccaccgacgtgcagctggtgacccagcaggtgatccagtgcgcctacgacatcgccaaggccgccaagcagctggtgaccatcaccaccaaggagaacaacaactag

SEQ ID NO: 8135 - DNA, 2046 bp, Artificial Sequence
  Description of Artificial Sequence: Synthetic coding sequence
atgagcaagagactgagaagcagcgaggtgtgcgccgactgcagcggccccgaccccagctgggccagcgtgaacagaggcaccttcctgtgcgacgagtgctgcagcgtgcacagaagcctgggcagacacatcagccaggtgagacacctgaagcacaccccctggccccccaccctgctgcagatggtggagaccctgtacaacaacggcgccaacagcatctgggagcacagcctgctggaccccgccagcatcatgagcggcagaagaaaggccaacccccaggacaaggtgcaccccaacaaggccgagttcatcagagccaagtaccagatgctggccttcgtgcacagactgccctgcagagacgacgacagcgtgaccgccaaggacctgagcaagcagctgcacagcagcgtgagaaccggcaacctggagacctgcctgagactgctgagcctgggcgcccaggccaacttcttccaccccgagaagggcaacacccccctgcacgtggccagcaaggccggccagatcctgcaggccgagctgctggccgtgtacggcgccgaccccggcacccaggacagcagcggcaagacccccgtggactacgccagacagggcggccaccacgagctggccgagagactggtggagatccagtacgagctgaccgacagactggccttctacctgtgcggcagaaagcccgaccacaagaacggccagcacttcatcatcccccagatggccgacagaagactgagcctggacctgagcgagctggccaaggccgccaagaagaagctgcagagcctgagcaaccacctgttcgaggagctggccatggacgtgtacgacgaggtggacagaagagagaccgacgccgtgtggctggccacccagaaccacagcgccctggtgaccgagaccaccgtggtgcccttcctgcccgtgaaccccgagtacagcagcaccagaaaccagggcagacagaagctggccagattcaacgcccacgagttcgccaccctggtgatcgacatcctgagcgacgccaagagaagacagcagggcagcagcctgagcggcagcaaggacaacgtggagctgatcctgaagaccatcaacaaccagcacagcgtggagagccaggacaacgaccagcccgactacgacagcgtggccagcgacgaggacaccgacctggagaccaccgccagcaagaccaacagacagaagctgcagaccctgcagagcgagaacagcaacctgagaaagcaggccaccaccaacgtgtaccaggtgcagaccggcagcgagtacaccgacaccagcaaccacagcagcctgaagagaagacccagcgccagaggcagcagacccatgagcatgtacgagaccggcagcggccagaagccctacctgcccatgggcgaggccagcagacccgaggagagcagaatgagactgcagcccttccccgcccacgccagcagactggagaagcagaacagcacccccgagagcgactacgacaacacccccaacgacatggagcccgacggcatgggcagcagcagaaagggcagacagagaagcatggtgtggcccggcgacggcctggtgcccgacaccgccgagccccacgtggcccccagccccaccctgcccagcaccgaggacgtgatcagaaagaccgagcagatcaccaagaacatccaggagctgctgagagccgcccaggagaacaagcacgacagctacatcccctgcagcgagagaatccacgtggccgtgaccgagatggccgccctgttccccaagaagcccaagagcgacatggtgagaaccagcctgagactgctgaccagcagcgcctacagactgcagagcgagtgcaagaagaccctgcccggcgaccccggcagccccaccgacgtgcagctggtgacccagcaggtgatccagtgcgcctacgacatcgccaaggccgccaagcagctggtgaccatcaccaccaaggagaacaacaactag

SEQ ID NO: 8136 - DNA, 1806 bp, Artificial Sequence
  Description of Artificial Sequence: Synthetic coding sequence
atggtggagaccctgtacaacaacggcgccaacagcatctgggagcacagcctgctggaccccgccagcatcatgagcggcagaagaaaggccaacccccaggacaaggtgcaccccaacaaggccgagttcatcagagccaagtaccagatgctggccttcgtgcacagactgccctgcagagacgacgacagcgtgaccgccaaggacctgagcaagcagctgcacagcagcgtgagaaccggcaacctggagacctgcctgagactgctgagcctgggcgcccaggccaacttcttccaccccgagaagggcaacacccccctgcacgtggccagcaaggccggccagatcctgcaggccgagctgctggccgtgtacggcgccgaccccggcacccaggacagcagcggcaagacccccgtggactacgccagacagggcggccaccacgagctggccgagagactggtggagatccagtacgagctgaccgacagactggccttctacctgtgcggcagaaagcccgaccacaagaacggccagcacttcatcatcccccagatggccgacagcagcctggacctgagcgagctggccaaggccgccaagaagaagctgcagagcctgagcaaccacctgttcgaggagctggccatggacgtgtacgacgaggtggacagaagagagaccgacgccgtgtggctggccacccagaaccacagcgccctggtgaccgagaccaccgtggtgcccttcctgcccgtgaaccccgagtacagcagcaccagaaaccagggcagacagaagctggccagattcaacgcccacgagttcgccaccctggtgatcgacatcctgagcgacgccaagagaagacagcagggcagcagcctgagcggcagcaaggacaacgtggagctgatcctgaagaccatcaacaaccagcacagcgtggagagccaggacaacgaccagcccgactacgacagcgtggccagcgacgaggacaccgacctggagaccaccgccagcaagaccaacagacagaagagcctggacagcgacctgagcgacggccccgtgaccgtgcaggagttcatggaggtgaagaacgccctggtggccagcgaggccaagatccagcagctgatgaaggtgaacaacaacctgagcgacgagctgagaatcatgcagaagaagctgcagaccctgcagagcgagaacagcaacctgagaaagcaggccaccaccaacgtgtaccaggtgcagaccggcagcgagtacaccgacaccagcaaccacagcagcctgaagagaagacccagcgccagaggcagcagacccatgagcatgtacgagaccggcagcggccagaagccctacctgcccatgggcgaggccagcagacccgaggagagcagaatgagactgcagcccttccccgcccacgccagcagactggagaagcagaacagcacccccgagagcgactacgacaacacccccaacgacatggagcccgacggcatgggcagcagcagaaagggcagacagagaagcatggtgtggcccggcgacggcctggtgcccgacaccgccgagccccacgtggcccccagccccaccctgcccagcaccgaggacgtgatcagaaagaccgagcagatcaccaagaacatccaggagctgctgagagccgcccaggagaacaagcacgacagctacatcccctgcagcgagagaatccacgtggccgtgaccgagatggccgccctgttccccaaggagacccaggtgtag

SEQ ID NO: 8137 - DNA, 1416 bp, Artificial Sequence
  Description of Artificial Sequence: Synthetic coding sequence
atgagcaagagactgagaagcagcgaggtgtgcgccgactgcagcggccccgaccccagctgggccagcgtgaacagaggcaccttcctgtgcgacgagtgctgcagcgtgcacagaagcctgggcagacacatcagccaggtgagacacctgaagcacaccccctggccccccaccctgctgcagatggtggagaccctgtacaacaacggcgccaacagcatctgggagcacagcctgctggaccccgccagcatcatgagcggcagaagaaaggccaacccccaggacaaggtgcaccccaacaaggccgagttcatcagagccaagtaccagatgctggccttcgtgcacagactgccctgcagagacgacgacagcgtgaccgccaaggacctgagcaagcagctgcacagcagcgtgagaaccggcaacctggagacctgcctgagactgctgagcctgggcgcccaggccaacttcttccaccccgagaagggcaacacccccctgcacgtggccagcaaggccggccagatcctgcaggccgagctgctggccgtgtacggcgccgaccccggcacccaggacagcagcggcaagacccccgtggactacgccagacagggcggccaccacgagctggccgagagactggtggagatccagtacgagctgaccgacagactggccttctacctgtgcggcagaaagcccgaccacaagaacggccagcacttcatcatcccccagatggccgacagcagcctggacctgagcgagctggccaaggccgccaagaagaagctgcagagcctgagcaaccacctgttcgaggagctggccatggacgtgtacgacgaggtggacagaagagagaccgacgccgtgtggctggccacccagaaccacagcgccctggtgaccgagaccaccgtggtgcccttcctgcccgtgaaccccgagtacagcagcaccagaaaccagggcagacagaagctggccagattcaacgcccacgagttcgccaccctggtgatcgacatcctgagcgacgccaagagaagacagcagggcagcagcctgagcggcagcaaggacaacgtggagctgatcctgaagaccatcaacaaccagcacagcgtggagagccaggacaacgaccagcccgactacgacagcgtggccagcgacgaggacaccgacctggagaccaccgccagcaagaccaacagacagaagagcctggacagcgacctgagcgacggccccgtgaccgtgcaggagttcatggaggtgaagaacgccctggtggccagcgaggccaagatccagcagctgatgaaggtgaacaacaacctgagcgacgagctgagaatcatgcagaagaagctgctgggcaaggacgccaactag

SEQ ID NO: 8138 - DNA, 1896 bp, Artificial Sequence
  Description of Artificial Sequence: Synthetic coding sequence
atgagcaagagactgagaagcagcgaggtgtgcgccgactgcagcggccccgaccccagctgggccagcgtgaacagaggcaccttcctgtgcgacgagtgctgcagcgtgcacagaagcctgggcagacacatcagccaggtgagacacctgaagcacaccccctggccccccaccctgctgcagatggtggagaccctgtacaacaacggcgccaacagcatctgggagcacagcctgctggaccccgccagcatcatgagcggcagaagaaaggccaacccccaggacaaggtgcaccccaacaaggccgagttcatcagagccaagtaccagatgctggccttcgtgcacagactgccctgcagagacgacgacagcgtgaccgccaaggacctgagcaagcagctgcacagcagcgtgagaaccggcaacctggagacctgcctgagactgctgagcctgggcgcccaggccaacttcttccaccccgagaagggcaacacccccctgcacgtggccagcaaggccggccagatcctgcaggccgagctgctggccgtgtacggcgccgaccccggcacccaggacagcagcggcaagacccccgtggactacgccagacagggcggccaccacgagctggccgagagactggtggagatccagtacgagctgaccgacagactggccttctacctgtgcggcagaaagcccgaccacaagaacggccagcacttcatcatcccccagatggccgacagcagcctggacctgagcgagctggccaaggccgccaagaagaagctgcagagcctgagcaaccacctgttcgaggagctggccatggacgtgtacgacgaggtggacagaagagagaccgacgccgtgtggctggccacccagaaccacagcgccctggtgaccgagaccaccgtggtgcccttcctgcccgtgaaccccgagtacagcagcaccagaaaccagggcagacagaagctggccagattcaacgcccacgagttcgccaccctggtgatcgacatcctgagcgacgccaagagaagacagcagggcagcagcctgagcggcagcaaggacaacgtggagctgatcctgaagaccatcaacaaccagcacagcgtggagagccaggacaacgaccagcccgactacgacagcgtggccagcgacgaggacaccgacctggagaccaccgccagcaagaccaacagacagaagagcctggacagcgacctgagcgacggccccgtgaccgtgcaggagttcatggaggtgaagaacgccctggtggccagcgaggccaagatccagcagctgatgaaggccagcagactggagaagcagaacagcacccccgagagcgactacgacaacacccccaacgacatggagcccgacggcatgggcagcagcagaaagggcagacagagaagcatggtgtggcccggcgacggcctggtgcccgacaccgccgagccccacgtggcccccagccccaccctgcccagcaccgaggacgtgatcagaaagaccgagcagatcaccaagaacatccaggagctgctgagagccgcccaggagaacaagcacgacagctacatcccctgcagcgagagaatccacgtggccgtgaccgagatggccgccctgttccccaagaagcccaagagcgacatggtgagaaccagcctgagactgctgaccagcagcgcctacagactgcagagcgagtgcaagaagaccctgcccggcgaccccggcagccccaccgacgtgcagctggtgacccagcaggtgatccagtgcgcctacgacatcgccaaggccgccaagcagctggtgaccatcaccaccaaggagaacaacaactag

SEQ ID NO: 8139 - DNA, 1233 bp, Artificial Sequence
  Description of Artificial Sequence: Synthetic coding sequence
atgagcctggtggacctgggcaagagactgctggaggccgccagaaagggccaggacgacgaggtgagaaccctgatggccaacggcgcccccttcaccaccgactggctgggcaccagccccctgcacctggccgcccagtacggccactacagcaccgccgaggtgctgctgagagccggcgtgagcagagacgccagaaccaaggtggacagaacccccctgcacatggccgccgccgacggccacgcccacatcgtggagctgctggtgagaaacggcgccgacgtgaacgccaaggacatgctgaagatgaccgccctgcactgggccaccgagagacaccacagagacgtggtggagctgctgatcaagtacggcgccgacgtgcacgccttcagcaagttcgacaagagcgccttcgacatcgccctggagaagaacaacgccgagatcctggtgatcctgcaggaggccatgcagaaccaggtgaacgtgaaccccgagagagccaaccccgtgaccgaccccgtgagcatggccgcccccttcatcttcaccagcggcgaggtggtgaacctggccagcctgatcagcagcaccaacaccaagaccaccagcgccaacaccgaggagatcatcgagggcaacagcgtggacagcagcatccagcaggtgatgggcagcggcggccagagagtgatcaccatcgtgaccgacggcgtgcccctgggcaacatccagaccagcatccccaccggcggcatcggccagcccttcatcgtgaccgtgcaggacggccagcaggtgctgaccgtgcccgccggcaaggtggccgaggagaccgtgatcaaggaggaggaggaggagaagctgcccctgaccaagaagcccagaatcggcgagaagaccaacagcgtggaggagagcaaggagggcaacgagagagagctgctgcagcagcagctgcaggaggccaacagaagagcccaggagtacagacaccagctgctgaagaaggagcaggaggccgagcagtacagactgaagctggaggccatcgccagacagcagcccaacggcgtggacttcaccatggtggaggaggtggccgaggtggacgccgtggtggtgaccgagggcgagctggaggagagagagaccaaggtgaccggcagcgccggcaccaccgagccccacaccagagtgagcatggccaccgtgagcagctag

SEQ ID NO: 8140 - DNA, 1233 bp, Artificial Sequence; identical to SEQ ID NO: 8139
  Description of Artificial Sequence: Synthetic coding sequence

SEQ ID NO: 8141 - DNA, 1347 bp, Artificial Sequence
  Description of Artificial Sequence: Synthetic coding sequence
atgagcctggtggacctgggcaagagactgctggaggccgccagaaagggccaggacgacgaggtgagaaccctgatggccaacggcgcccccttcaccaccgactggctgggcaccagccccctgcacctggccgcccagtacggccactacagcaccgccgaggtgctgctgagagccggcgtgagcagagacgccagaaccaaggtggacagaacccccctgcacatggccgccgccgacggccacgcccacatcgtggagctgctggtgagaaacggcgccgacgtgaacgccaaggacatgctgaagatgaccgccctgcactgggccaccgagagacaccacagagacgtggtggagctgctgatcaagtacggcgccgacgtgcacgccttcagcaagttcgacaagagcgccttcgacatcgccctggagaagaacaacgccgagatcctggtgatcctgcaggaggccatgcagaaccaggtgaacgtgaaccccgagagagccaaccccgtgaccgaccccgtgagcatggccgcccccttcatcttcaccagcggcgaggtggtgaacctggccagcctgatcagcagcaccaacaccaagaccaccagcggcgacccccacgccagcaccgtgcagttcagcaacagcaccaccagcgtgctggccaccctggccgccctggccgaggccagcgtgcccctgagcaacagccacagagccaccgccaacaccgaggagatcatcgagggcaacagcgtggacagcagcatccagcaggtgatgggcagcggcggccagagagtgatcaccatcgtgaccgacggcgtgcccctgggcaacatccagaccagcatccccaccggcggcatcggccagcccttcatcgtgaccgtgcaggacggccagcaggtgctgaccgtgcccgccggcaaggtggccgaggagaccgtgatcaaggaggaggaggaggagaagctgcccctgaccaagaagcccagaatcggcgagaagaccaacagcgtggaggagagcaaggagggcaacgagagagagctgctgcagcagcagctgcaggaggccaacagaagagcccaggagtacagacaccagctgctgaagaaggagcaggaggccgagcagtacagactgaagctggaggccatcgccagacagcagcccaacggcgtggacttcaccatggtggaggaggtggccgaggtggacgccgtggtggtgaccgagggcgagctggaggagagagagaccaaggtgaccggcagcgccggcaccaccgagccccacaccagagtgagcatggccaccgtgagcagctag

SEQ ID NO: 8142 - DNA, 1188 bp, Artificial Sequence
  Description of Artificial Sequence: Synthetic coding sequence
atgagcctggtggacctgggcaagagactgctggaggccgccagaaagggccaggacgacgaggtgagaaccctgatggccaacggcgcccccttcaccaccgactggttcagcaagctgagagtgagctgcggctacatcggcgacaactgcaagctgggcaccagccccctgcacctggccgcccagtacggccactacagcaccgccgaggtgctgctgagagccggcgtgagcagagacgccagaaccaaggtggacagaacccccctgcacatggccgccgccgacggccacgcccacatcgtggagctgctggtgagaaacggcgccgacgtgaacgccaaggacatgctgaagatgaccgccctgcactgggccaccgagagacaccacagagacgtggtggagctgctgatcaagtacggcgccgacgtgcacgccttcagcaagttcgacaagagcgccttcgacatcgccctggagaagaacaacgccgagatcctggtgatcctgcaggaggccatgcagaaccaggtgaacgtgaaccccgagagagccaaccccgtgaccgaccccgtgagcatggccgcccccttcatcttcaccagcggcgaggtggtgaacctggccagcctgatcagcagcaccaacaccaagaccaccagcggcgacccccacgccagcaccgtgcagttcagcaacagcaccaccagcgtgctggccaccctggccgccctggccgaggccagcgtgcccctgagcaacagccacagagccaccgccaacaccgaggagaccgtgatcaaggaggaggaggaggagaagctgcccctgaccaagaagcccagaatcggcgagaagaccaacagcgtggaggagagcaaggagggcaacgagagagagctgctgcagcagcagctgcaggaggccaacagaagagcccaggagtacagacaccagctgctgaagaaggagcaggaggccgagcagtacagactgaagctggaggccatcgccagacagcagcccaacggcgtggacttcaccatggtggaggaggtggccgaggtggacgccgtggtggtgaccgagggcgagctggaggagagagagaccaaggtgaccggcagcgccggcaccaccgagccccacaccagagtgagcatggccaccgtgagcagctag

SEQ ID NO: 8143 - DNA, 1827 bp, Artificial Sequence
  Description of Artificial Sequence: Synthetic coding sequence
atgaccgaggaggcctgcagaaccagaagccagaagagagccctggagagagaccccaccgaggacgacgtggagagcaagaagatcaagatggagagaggcctgctggccagcgacctgaacaccgacggcgacatgagagtgacccccgagcccggcgccggccccacccagggcctgctgagagccaccgaggccaccgccatggccatgggcagaggcgagggcctggtgggcgacggccccgtggacatgagaaccagccacagcgacatgaagagcgagagaagaccccccagccccgacgtgatcgtgctgagcgacaacgagcagcccagcagccccagagtgaacggcctgaccaccgtggccctgaaggagaccagcaccgaggccctgatgaagagcagccccgaggagagagagagaatgatcaagcagctgaaggaggagctgagactggaggaggccaagctggtgctgctgaagaagctgagacagagccagatccagaaggaggccaccgcccagaagcccaccggcagcgtgggcagcaccgtgaccacccccccccccctggtgagaggcacccagaacatccccgccggcaagcccagcctgcagaccagcagcgccagaatgcccggcagcgtgatccccccccccctggtgagaggcggccagcaggccagcagcaagctgggcccccaggccagcagccaggtggtgatgccccccctggtgagaggcgcccagcagatccacagcatcagacagcacagcagcaccggccccccccccctgctgctggcccccagagccagcgtgcccagcgtgcagatccagggccagagaatcatccagcagggcctgatcagagtggccaacgtgcccaacaccagcctgctggtgaacatcccccagcccacccccgccagcctgaagggcaccaccgccaccagcgcccaggccaacagcacccccaccagcgtggccagcgtggtgaccagcgccgagagccccgccagcagacaggccgccgccaagctggccctgagaaagcagctggagaagaccctgctggagatccccccccccaagccccccgcccccgagatgaacttcctgcccagcgccgccaacaacgagttcatctacctggtgggcctggaggaggtggtgcagaacctgctggagacccagggcagaatgagcgccgccaccgtgctgagcagagagccctacatgtgcgcccagtgcaagaccgacttcacctgcagatggagagaggagaagagcggcgccatcatgtgcgagaactgcatgaccaccaaccagaagaaggccctgaaggtggagcacaccagcagactgaaggccgccttcgtgaaggccctgcagcaggagcaggagatcgagcagagactgctgcagcagggcaccgcccccgcccaggccaaggccgagcccaccgccgccccccaccccgtgctgaagcaggccagcagccagctgagcagaggcagcgccaccacccccagaggcgtgctgcacaccttcagccccagccccaagctgcagaacagcgccagcgccaccgccctggtgagcagaaccggcagacacagcgagagaaccgtgagcgccggcaagggcagcgccaccagcaactggaagaagacccccctgagcaccggcggcaccctggccttcgtgagccccagcctggccgtgcacaagagcagcagcgccgtggacagacagagagagtacctgctggacatgatcccccccagaagcatcccccagagcgccacctggaagtag

SEQ ID NO: 8144 - DNA, 1902 bp, Artificial Sequence
  Description of Artificial Sequence: Synthetic coding sequence
atgaccgaggaggcctgcagaaccagaagccagaagagagccctggagagagaccccaccgaggacgacgtggagagcaagaagatcaagatggagagaggcctgctggccagcgacctgaacaccgacggcgacatgagagtgacccccgagcccggcgccggccccacccagggcctgctgagagccaccgaggccaccgccatggccatgggcagaggcgagggcctggtgggcgacggccccgtggacatgagaaccagccacagcgacatgaagagcgagagaagaccccccagccccgacgtgatcgtgctgagcgacaacgagcagcccagcagccccagagtgaacggcctgaccaccgtggccctgaaggagaccagcaccgaggccctgatgaagagcagccccgaggagagagagagaatgatcaagcagctgaaggaggagctgagactggaggaggccaagctggtgctgctgaagaagctgagacagagccagatccagaaggaggccaccgcccagaagcccaccggcagcgtgggcagcaccgtgaccacccccccccccctggtgagaggcacccagaacatccccgccggcaagcccagcctgcagaccagcagcgccagaatgcccggcagcgtgatccccccccccctggtgagaggcggccagcaggccagcagcaagctgggcccccaggccagcagccaggtggtgatgccccccctggtgagaggcgcccagcagatccacagcatcagacagcacagcagcaccggccccccccccctgctgctggcccccagagccagcgtgcccagcgtgcagatccagggccagagaatcatccagcagggcctgatcagagtggccaacgtgcccaacaccagcctgctggtgaacatcccccagcccacccccgccagcctgaagggcaccaccgccaccagcgcccaggccaacagcacccccaccagcgtggccagcgtggtgaccagcgccgagagccccgccagcagacaggccgccgccaagctggccctgagaaagcagctggagaagaccctgctggagatccccccccccaagccccccgcccccgagatgaacttcctgcccagcgccgccaacaacgagttcatctacctggtgggcctggaggaggtggtgcagaacctgctggagacccagggcagaatgagcgccgccaccgtgctgagcagagagccctacatgtgcgcccagtgcaagaccgacttcacctgcagatggagagaggagaagagcggcgccatcatgtgcgagaactgcatgaccaccaaccagaagaaggccctgaaggtggagcacaccagcagactgaaggccgccttcgtgaaggccctgcagcaggagcaggagatcgagcagagactgctgcagcagggcaccgcccccgcccaggccaaggccgagcccaccgccgccccccaccccgtgctgaagcaggtgatcaagcccagaagaaagctggccttcagaagcggcgaggccagagactggagcaacggcgccgtgctgcaggccagcagccagctgagcagaggcagcgccaccacccccagaggcgtgctgcacaccttcagccccagccccaagctgcagaacagcgccagcgccaccgccctggtgagcagaaccggcagacacagcgagagaaccgtgagcgccggcaagggcagcgccaccagcaactggaagaagacccccctgagcaccggcggcaccctggccttcgtgagccccagcctggccgtgcacaagagcagcagcgccgtggacagacagagagagtacctgctggacatgatcccccccagaagcatcccccagagcgccacctggaagtag

SEQ ID NO: 8145 - DNA, 1902 bp, Artificial Sequence; identical to SEQ ID NO: 8144
  Description of Artificial Sequence: Synthetic coding sequence

SEQ ID NO: 8146 - DNA, 534 bp, Artificial Sequence
  Description of Artificial Sequence: Synthetic coding sequence
atgaccgaggaggcctgcagaaccagaagccagaagagagccctggagagagaccccaccgaggacgacgtggagagcaagaagatcaagatggagagaggcctgctggccagcgacctgaacaccgacggcgacatgagagtgacccccgagcccggcgccggccccacccagggcctgctgagagccaccgaggccaccgccatggccatgggcagaggcgagggcctggtgggcgacggccccgtggacatgagaaccagccacagcgacatgaagagcgagagaagaccccccagccccgacgtgatcgtgctgagcgacaacgagcagcccagcagccccagagtgaacggcctgaccaccgtggccctgaaggagaccagcaccgaggccctgatgaagagcagccccgaggagagagagagaatgatcaagcagctgaaggaggagctgagactggaggaggccaagctggtgctgctgaagaagctgagacagagccagatccagaaggaggccaccgcccagtag

SEQ ID NO: 8147 - DNA, 381 bp, Artificial Sequence
  Description of Artificial Sequence: Synthetic coding sequence
atgaccgaggaggcctgcagaaccagaagccagaagagagccctggagagagaccccaccgaggacgacgtggagagcaagaagatcaagatggagagaggcctgctggccagcgacctgaacaccgacggcgacatgagagtgacccccgagcccggcgccggccccacccagggcctgctgagagccaccgaggccaccgccatggccatgggcagaggcgagggcctggtgggcgacggccccgtggacatgagaaccagccacagcgacatgaagagcgagagaagaccccccagccccgacgtgatcgtgctgagcgacaacgagcagcccagcagccccagagtgaacggcctgaccaccgtggccctgaagtag

SEQ ID NO: 8148 - DNA, 1311 bp, Artificial Sequence
  Description of Artificial Sequence: Synthetic coding sequence
atgatcaagcagctgaaggaggagctgagactggaggaggccaagctggtgctgctgaagaagctgagacagagccagatccagaaggaggccaccgcccagaagaccagcagcgccagaatgcccggcagcgtgatccccccccccctggtgagaggcggccagcaggccagcagcaagctgggcccccaggccagcagccaggtggtgatgccccccctggtgagaggcgcccagcagatccacagcatcagacagcacagcagcaccggccccccccccctgctgctggcccccagagccagcgtgcccagcgtgcagatccagggccagagaatcatccagcagggcctgatcagagtggccaacgtgcccaacaccagcctgctggtgaacatcccccagcccacccccgccagcctgaagggcaccaccgccaccagcgcccaggccaacagcacccccaccagcgtggccagcgtggtgaccagcgccgagagccccgccagcagacaggccgccgccaagctggccctgagaaagcagctggagaagaccctgctggagatccccccccccaagccccccgcccccgagatgaacttcctgcccagcgccgccaacaacgagttcatctacctggtgggcctggaggaggtggtgcagaacctgctggagacccaggccggcagaatgagcgccgccaccgtgctgagcagagagccctacatgtgcgcccagtgcaagaccgacttcacctgcagatggagagaggagaagagcggcgccatcatgtgcgagaactgcatgaccaccaaccagaagaaggccctgaaggtggagcacaccagcagactgaaggccgccttcgtgaaggccctgcagcaggagcaggagatcgagcagagactgctgcagcagggcaccgcccccgcccaggccaaggccgagcccaccgccgccccccaccccgtgctgaagcaggccagcagccagctgagcagaggcagcgccaccacccccagaggcgtgctgcacaccttcagccccagccccaagctgcagaacagcgccagcgccaccgccctggtgagcagaaccggcagacacagcgagagaaccgtgagcgccggcaagggcagcgccaccagcaactggaagaagacccccctgagcaccggcggcaccctggccttcgtgagccccagcctggccgtgcacaagagcagcagcgccgtggacagacagagagagtacctgctggacatgatcccccccagaagcatcccccagagcgccacctggaagtag

SEQ ID NO: 8149 - DNA, 420 bp, Artificial Sequence
  Description of Artificial Sequence: Synthetic coding sequence
atgaccgaggaggcctgcagaaccagaagccagaagagagccctggagagagaccccaccgaggacgacgtggagagcaagaagatcaagatggagagaggcctgctggccagcgacctgaacaccgacggcgacatgagagtgacccccgagcccggcgccggccccacccagggcctgctgagagccaccgaggccaccgccatggccatgggcagaggcgagggcctggtgggcgacggccccgtggacatgagaaccagccacagcgacatgaagagcgagagaagaccccccagccccgacgtgatcgtgctgagcgacaacgagcagcccagcagccccagagtgaacggcctgaccaccgtggccctgaaggagaccagcaccgaggccctgatgaagagcagccccgagtag

SEQ ID NO: 8150 - DNA, 282 bp, Artificial Sequence
  Description of Artificial Sequence: Synthetic coding sequence
atgaccgaggaggcctgcagaaccagaagccagaagagagccctggagagagaccccaccgaggacgacgtggagagcaagaagatcaagatggagagaggcctgctggccagcgacctgaacaccgacggcgacatgagagtgacccccgagcccggcgccggccccacccagggcctgctgagagccaccgaggccaccgccatggccatgggcagaggcgagggcctggtgggcgacggccccgtggacatgagaaccagccacagcgacatgaagtag

SEQ ID NO: 8151 - DNA, 57 bp, Artificial Sequence
  Description of Artificial Sequence: Synthetic coding sequence
atgagcctgtggccctggcccaccggcagaaccagcaccccctaccccgaggcctag

SEQ ID NO: 8152 - DNA, 507 bp, Artificial Sequence
  Description of Artificial Sequence: Synthetic coding sequence
atgaccgaggaggcctgcagaaccagaagccagaagagagccctggagagagaccccaccgaggacgacgtggagagcaagaagatcaagatggagagaggcctgctggccagcgacctgaacaccgacggcgacatgagagtgacccccgagcccggcgccggccccacccagggcctgctgagagccaccgaggccaccgccatggccatgggcagaggcgagggcctggtgggcgacggccccgtggacatgagaaccagccacagcgacatgaagagcgagagaagaccccccagccccgacgtgatcgtgctgagcgacaacgagcagcccagcagccccagagtgaacggcctgaccaccgtggccctgaaggagaccagcaccgaggccctgatgaagagcagccccgaggagagagagagaatgatcaagcagctgaaggaggagctgagactggaggaggccaagctggtgctgctgaagaagctgagacagagctag

SEQ ID NO: 8153 - DNA, 789 bp, Artificial Sequence
  Description of Artificial Sequence: Synthetic coding sequence
atgaacttcctgcccagcgccgccaacaacgagttcatctacctggtgggcctggaggaggtggtgcagaacctgctggagacccaggccggcagaatgagcgccgccaccgtgctgagcagagagccctacatgtgcgcccagtgcaagaccgacttcacctgcagatggagagaggagaagagcggcgccatcatgtgcgagaactgcatgaccaccaaccagaagaaggccctgaaggtggagcacaccagcagactgaaggccgccttcgtgaaggccctgcagcaggagcaggagatcgagcagagactgctgcagcagggcaccgcccccgcccaggccaaggccgagcccaccgccgccccccaccccgtgctgaagcaggtgatcaagcccagaagaaagctggccttcagaagcggcgaggccagagactggagcaacggcgccgtgctgcaggccagcagccagctgagcagaggcagcgccaccacccccagaggcgtgctgcacaccttcagccccagccccaagctgcagaacagcgccagcgccaccgccctggtgagcagaaccggcagacacagcgagagaaccgtgagcgccggcaagggcagcgccaccagcaactggaagaagacccccctgagcaccggcggcaccctggccttcgtgagccccagcctggccgtgcacaagagcagcagcgccgtggacagacagagagagtacctgctggacatgatcccccccagaagcatcccccagagcgccacctggaagtag

SEQ ID NO: 8154 - DNA, 1782 bp, Artificial Sequence
  Description of Artificial Sequence: Synthetic coding sequence
atggacagaatgaccgaggacgccctgagactgaacctgctgaagagaagcctggaccccgccgacgagagagacgacgtgctggccaagagactgaagatggagggccacgaggccatggagagactgaagatgctggccctgctgaagagaaaggacctggccaacctggaggtgccccacgagctgcccaccaagcaggacggcagcggcgtgaagggctacgaggagaagctgaacggcaacctgagaccccacggcgacaacagaaccgccggcagacccggcaaggagaacatcaacgacgagcccgtggacatgagcgccagaagaagcgagcccgagagaggcagactgacccccagccccgacatcatcgtgctgagcgacaacgaggccagcagccccagaagcagcagcagaatggaggagagactgaaggccgccaacctggagatgttcaagggcaagggcatcgaggagagacagcagctgatcaagcagctgagagacgagctgagactggaggaggccagactggtgctgctgaagaagctgagacagagccagctgcagaaggagaacgtggtgcagaagacccccgtggtgcagaacgccgccagcatcgtgcagcccagccccgcccacgtgggccagcagggcctgagcaagctgcccagcagacccggcgcccagggcgtggagccccagaacctgagaaccctgcagggccacagcgtgatcagaagcgccaccaacaccaccctgccccacatgctgatgagccagagagtgatcgcccccaaccccgcccagctgcagggccagagaggcccccccaagcccggcctggtgagaaccaccacccccaacatgaaccccgccatcaactaccagccccagagcagcagcagcgtgccctgccagagaaccaccagcagcgccatctacatgaacctggccagccacatccagcccggcaccgtgaacagagtgagcagccccctgcccagccccagcgccatgaccgacgccgccaacagccaggccgccgccaagctggccctgagaaagcagctggagaagaccctgctggagatccccccccccaagccccccgcccccctgctgcacttcctgcccagcgccgccaacagcgagttcatctacatggtgggcctggaggaggtggtgcagagcgtgatcgacagccagggcaagagctgcgccagcctgctgagagtggagcccttcgtgtgcgcccagtgcagaaccgacttcaccccccactggaagcaggagaagaacggcaagatcctgtgcgagcagtgcatgaccagcaaccagaagaaggccctgaaggccgagcacaccaacagactgaagaacgccttcgtgaaggccctgcagcaggagcaggagatcgagcagagactgcagcagcaggccgccctgagccccaccaccgcccccgccgtgagcagcgtgagcaagcaggagaccatcatgagacaccacaccctgagacaggccccccagccccagagcagcctgcagagaggcatccccaccagcgccagaagcatgctgagcaacttcgcccaggccccccagctgagcgtgcccggcggcctgctgggcatgcccggcgtgaacatcgcctacctgaacaccggcatcggcggccacaagggccccagcctggccgacagacagagagagtacctgctggacatgatcccccccagaagcatcagccagagcatcagcggccagaagtag

SEQ ID NO: 8155 - DNA, 1425 bp, Artificial Sequence
  Description of Artificial Sequence: Synthetic coding sequence
atggcccagcacgacttcgtgcccgcctggctgaacttcagcaccccccagagcgccaagagccccaccgccaccttcgagaagcacggcgagcacctgcccagaggcgagggcagattcggcgtgagcagaagaagacacaacagcagcgacggcttcttcaacaacggccccctgagaaccgccggcgacagctggcaccagcccagcctgttcagacacgacagcgtggacagcggcgtgagcaagggcgcctacgccggcatcaccggcaaccccagcggctggcacagcagcagcagaggccacgacggcatgagccagagaagcggcggcggcaccggcaaccacagacactggaacggcagcttccacagcagaaagggctgcgccttccaggagaagccccccatggagatcagagaggagaagaaggaggacaaggtggagaagctgcagttcgaggaggaggacttccccagcctgaaccccgaggccggcaagcagcaccagccctgcagacccatcggcacccccagcggcgtgtgggagaacccccccagcgccaagcagcccagcaagatgctggtgatcaagaaggtgagcaaggaggaccccgccgccgccttcagcgccgccttcaccagccccggcagccaccacgccaacggcaacaagctgagcagcgtggtgcccagcgtgtacaagaacctggtgcccaagcccgtgcccccccccagcaagcccaacgcctggaaggccaacagaatggagcacaagagcggcagcctgagcagcagcagagagagcgccttcaccagccccatcagcgtgaccaagcccgtggtgctggccagcggcgccgccctgagcagccccaaggagagccccagcagcaccaccccccccatcgagatcagcagcagcagactgaccaagctgaccagaagaaccaccgacagaaagagcgagttcctgaagaccctgaaggacgacagaaacggcgacttcagcgagaacagagactgcgacaagctggaggacctggaggacaacagcacccccgagcccaaggagaacggcgaggagggctgccaccagaacggcctggccctgcccgtggtggaggagggcgaggtgctgagccacagcctggaggccgagcacagactgctgaaggccatgggctggcaggagtaccccgagaacgacgagaactgcctgcccctgaccgaggacgagctgaaggagttccacatgaagaccgagcagctgagaagaaacggcttcggcaagaacggcttcctgcagagcagaagcagcagcctgttcagcccctggagaagcacctgcaaggccgagttcgaggacagcgacaccgagaccagcagcagcgagaccagcgacgacgacgcctggaagtag

SEQ ID NO: 8156 - DNA, 1425 bp, Artificial Sequence; identical to SEQ ID NO: 8155
  Description of Artificial Sequence: Synthetic coding sequence

SEQ ID NO: 8157 - DNA, 2448 bp, Artificial Sequence
  Description of Artificial Sequence: Synthetic coding sequence
atgttcagaaaggccagaagagtgaacgtgagaaagagaaacgacagcgaggaggaggagagagagagagacgaggagcaggagcccccccccctgctgcccccccccggcaccggcgaggaggccggccccggcggcggcgacagagcccccggcggcgagagcctgctgggccccggccccagcccccccagcgccctgacccccggcctgggcgccgaggccggcggcggcttccccggcggcgccgagcccggcaacggcctgaagcccagaaagagacccagagagaacaaggaggtgcccagagccagcctgctgagcttccaggacgaggaggaggagaacgaggaggtgttcaaggtgaagaagagcagctacagcaagaagatcgtgaagctgctgaagaaggagtacaaggaggacctggagaagagcaagatcaagaccgagctgaacagcagcgccgagagcgagcagcccctggacaagaccggccacgtgaaggacaccaaccaggaggacggcgtgatcatcagcgagcacggcgaggacgagatggacatggagagcgagaaggaggaggagaagcccaagaccggcggcgccttcagcaacgccctgagcagcctgaacgtgctgagacccggcgagatccccgacgccgccttcatccacgccgccagaaagaagagacagatggccagagagctgggcgacttcaccccccacgacaacgagcccggcaagggcagactggtgagagaggacgagaacgacgccagcgacgacgaggacgacgacgagaagagaagaatcgtgttcagcgtgaaggagaagagccagagacagaagatcgccgaggagatcggcatcgagggcagcgacgacgacgccctggtgaccggcgagcaggacgaggagctgagcagatgggagcaggagcagatcagaaagggcatcaacatcccccaggtgcaggccagccagcccgccgaggtgaacatgtactaccagaacacctaccagaccatgccctacggcagcagctacggcatcccctacagctacaccgcctacggcagcagcgacgccaagagccagaagaccgacaacaccgtgcccttcaagacccccagcaacgagatgacccccgtgaccatcgacctggtgaagaagcagctgaaggacagactggacagcatgaaggagctgcacaagaccaacagacagcagcacgagaagcacctgcagagcagagtggacagcaccagagccatcgagagactggagggcagcagcggcggcatcggcgagagatacaagttcctgcaggagatgagaggctacgtgcaggacctgctggagtgcttcagcgagaaggtgcccctgatcaacgagctggagagcgccatccaccagctgtacaagcagagagccagcagactggtgcagagaagacaggacgacatcaaggacgagagcagcgagttcagcagccacagcaacaaggccctgatggcccccaacctggacagcttcggcagagacagagccctgtaccaggagcacgccaagagaagaatcgccgagagagaggccagaagaaccagaagaagacaggccagagagcagaccggcaagatggccgaccacctggagggcctgagcagcgacgacgaggagaccagcaccgacatcaccaacttcaacctggagaaggacagaatcagcaaggagagcggcaaggtgttcgaggacgtgctggagagcttctacagcatcgactgcatcaagagccagttcgaggcctggagaagcaagtactacaccagctacaaggacgcctacatcggcctgtgcctgcccaagctgttcaaccccctgatcagactgcagctgctgacctggacccccctggaggccaagtgcagagacttcgagaacatgctgtggttcgagagcctgctgttctacggctgcgaggagagagagcaggagaaggacgacgtggacgtggccctgctgcccaccatcgtggagaaggtgatcctgcccaagctgaccgtgatcgccgagaacatgtgggaccccttcagcaccacccagaccagcagaatggtgggcatcaccctgaagctgatcaacggctaccccagcgtggtgaacgccgagaacaagaacacccaggtgtacctgaaggccctgctgctgagaatgagaagaaccctggacgacgacgtgttcatgcccctgtaccccaagaacgtgctggagaacaagaacagcggcccctacctgttcttccagagacagttctggagcagcgtgaaggtgatcaagccccccttccagagaggcagctgccccatccccagaagaaaggagtgctgcagcgagagacccagaagaatctggaccgacagaccctgcgtggtgttcagctag

SEQ ID NO: 8158 - DNA, 2754 bp, Artificial Sequence
  Description of Artificial Sequence: Synthetic coding sequence
atgttcagaaaggccagaagagtgaacgtgagaaagagaaacgacagcgaggaggaggagagagagagagacgaggagcaggagcccccccccctgctgcccccccccggcaccggcgaggaggccggccccggcggcggcgacagagcccccggcggcgagagcctgctgggccccggccccagcccccccagcgccctgacccccggcctgggcgccgaggccggcggcggcttccccggcggcgccgagcccggcaacggcctgaagcccagaaagagacccagagagaacaaggaggtgcccagagccagcctgctgagcttccaggacgaggaggaggagaacgaggaggtgttcaaggtgaagaagagcagctacagcaagaagatcgtgaagctgctgaagaaggagtacaaggaggacctggagaagagcaagatcaagaccgagctgaacagcagcgccgagagcgagcagcccctggacaagaccggccacgtgaaggacaccaaccaggaggacggcgtgatcatcagcgagcacggcgaggacgagatggacatggagagcgagaaggaggaggagaagcccaagaccggcggcgccttcagcaacgccctgagcagcctgaacgtgctgagacccggcgagatccccgacgccgccttcatccacgccgccagaaagaagagacagatggccagagagctgggcgacttcaccccccacgacaacgagcccggcaagggcagactggtgagagaggacgagaacgacgccagcgacgacgaggacgacgacgagaagagaagaatcgtgttcagcgtgaaggagaagagccagagacagaagatcgccgaggagatcggcatcgagggcagcgacgacgacgccctggtgaccggcgagcaggacgaggagctgagcagatgggagcaggagcagatcagaaagggcatcaacatcccccaggtgcaggccagccagcccgccgaggtgaacatgtactaccagaacacctaccagaccatgccctacggcagcagctacggcatcccctacagctacaccgcctacggcagcagcgacgccaagagccagaagaccgacaacaccgtgcccttcaagacccccagcaacgagatgacccccgtgaccatcgacctggtgaagaagcagctgaaggacagactggacagcatgaaggagctgcacaagaccaacagacagcagcacgagaagcacctgcagagcagagtggacagcaccagagccatcgagagactggagggcagcagcggcggcatcggcgagagatacaagttcctgcaggagatgagaggctacgtgcaggacctgctggagtgcttcagcgagaaggtgcccctgatcaacgagctggagagcgccatccaccagctgtacaagcagagagccagcagactggtgcagagaagacaggacgacatcaaggacgagagcagcgagttcagcagccacagcaacaaggccctgatggcccccaacctggacagcttcggcagagacagagccctgtaccaggagcacgccaagagaagaatcgccgagagagaggccagaagaaccagaagaagacaggccagagagcagaccggcaagatggccgaccacctggagggcctgagcagcgacgacgaggagaccagcaccgacatcaccaacttcaacctggagaaggacagaatcagcaaggagagcggcaaggtgttcgaggacgtgctggagagcttctacagcatcgactgcatcaagagccagttcgaggcctggagaagcaagtactacaccagctacaaggacgcctacatcggcctgtgcctgcccaagctgttcaaccccctgatcagactgcagctgctgacctggacccccctggaggccaagtgcagagacttcgagaacatgctgtggttcgagagcctgctgttctacggctgcgaggagagagagcaggagaaggacgacgtggacgtggccctgctgcccaccatcgtggagaaggtgatcctgcccaagctgaccgtgatcgccgagaacatgtgggaccccttcagcaccacccagaccagcagaatggtgggcatcaccctgaagctgatcaacggctaccccagcgtggtgaacgccgagaacaagaacacccaggtgtacctgaaggccctgctgctgagaatgagaagaaccctggacgacgacgtgttcatgcccctgtaccccaagaacgtgctggagaacaagaacagcggcccctacctgttcttccagagacagttctggagcagcgtgaagctgctgggcaacttcctgcagtggtacggcatcttcagcaacaagaccctgcaggagctgagcatcgacggcctgctgaacagatacatcctgatggccttccagaacagcgagtacggcgacgacagcatcaagaaggcccagaacgtgatcaactgcttccccaagcagtggttcatgaacctgaagggcgagagaaccatcagccagctggagaacttctgcagatacctggtgcacctggccgacaccatctacagaaacagcatcggctgcagcgacgtggagaagagaaacgccagagagaacatcaagcagatcgtgaagctgctggccagcgtgagagccctggaccacgccatgagcgtggccagcgaccacaacgtgaaggagttcaagagcctgatcgagggcaagtag

SEQ ID NO: 8159 - DNA, 2346 bp, Artificial Sequence
  Description of Artificial Sequence: Synthetic coding sequence
atggcccacagacccaagagaaccttcagacagagagccgccgacagcagcgacagcgacggcgccgaggagagccccgccgagcccggcgcccccagagagctgcccgtgcccggcagcgccgaggaggagccccccagcggcggcggcagagcccaggtggccggcctgccccacagagtgagaggccccagaggcagaggcagagtgtgggccagcagcagaagagccaccaaggccgcccccagagccgacgagggcagcgagagcagaaccctggacgtgagcaccgacgaggaggacaagatccaccacagcagcgagagcaaggacgaccagggcctgagcagcgacagcagcagcagcctgggcgagaaggagctgagcagcaccgtgaagatccccgacgccgccttcatccaggccgccagaagaaagagagagctggccagagcccaggacgactacatcagcctggacgtgcagcacaccagcagcatcagcggcatgaagagagagagcgaggacgaccccgagagcgagcccgacgaccacgagaagagaatccccttcaccctgagaccccagaccctgagacagagaatggccgaggagagcatcagcagaaacgaggagaccagcgaggagagccaggaggacgagaagcaggacacctgggagcagcagcagatgagaaaggccgtgaagatcatcgaggagagagacatcgacctgagctgcggcaacggcagcagcaaggtgaagaagttcgacaccagcatcagcttcccccccgtgaacctggagatcatcaagaagcagctgaacaccagactgaccctgctgcaggagacccacagaagccacctgagagagtacgagaagtacgtgcaggacgtgaagagcagcaagagcaccatccagaacctggagagcagcagcaaccaggccctgaactgcaagttctacaagagcatgaagatctacgtggagaacctgatcgactgcctgaacgagaagatcatcaacatccaggagatcgagagcagcatgcacgccctgctgctgaagcaggccatgaccttcatgaagagaagacaggacgagctgaagcacgagagcacctacctgcagcagctgagcagaaaggacgagaccagcaccagcggcaacttcagcgtggacgagaagacccagtggatcctggaggagatcgagagcagaagaaccaagagaagacaggccagagtgctgagcggcaactgcaaccaccaggagggcaccagcagcgacgacgagctgcccagcgccgagatgatcgacttccagaagagccagggcgacatcctgcagaagcagaagaaggtgttcgaggaggtgcaggacgacttctgcaacatccagaacatcctgctgaagttccagcagtggagagagaagttccccgacagctactacgaggccttcatcagcctgtgcatccccaagctgctgaaccccctgatcagagtgcagctgatcgactggaaccccctgaagctggagagcaccggcctgaaggagatgccctggttcaagagcgtggaggagttcatggacagcagcgtggaggacagcaagaaggagagcagcagcgacaagaaggtgctgagcgccatcatcaacaagaccatcatccccagactgaccgacttcgtggagttcctgtgggaccccctgagcaccagccagaccaccagcctgatcacccactgcagagtgatcctggaggagcacagcacctgcgagaacgaggtgagcaagagcagacaggacctgctgaagagcatcgtgagcagaatgaagaaggccgtggaggacgacgtgttcatccccctgtaccccaagagcgccgtggagaacaagaccagcccccacagcaagttccaggagagacagttctggagcggcctgaagctgttcagaaacatcctgctgtggaacggcctgctgaccgacgacaccctgcaggagctgggcctgggcaagctgctgaacagatacctgatcatcgccctgctgaacgccacccccggccccgacgtggtgaagaagtgcaaccaggtggccgcctgcctgcccgagaagtggttcgagaacagcgccatgagaaccagcatcccccagctggagaacttcatccagttcctgctgcagagcgcccacaagctgagcagaagcgagttcagagacgaggtggaggagatcatcctgatcctggtgaagatcaaggccctgaaccaggccgagagcttcatcggcgagcaccacctggaccacctgaagagcctgatcaaggaggactag

SEQ ID NO: 8160 - DNA, 2232 bp, Artificial Sequence
  Description of Artificial Sequence: Synthetic coding sequence
atggcccacagacccaagagaaccttcagacagagagccgccgacagcagcgacagcgacggcgccgaggagagccccgccgagcccggcgcccccagagagctgcccgtgcccggcagcgccgaggaggagccccccagcggcggcggcagagcccaggtggccggcctgccccacagagtgagaggccccagaggcagaggcagagtgtgggccagcagcagaagagccaccaaggccgcccccagagccgacgagggcagcgagagcagaaccctggacgtgagcaccgacgaggaggacaagatccaccacagcagcgagagcaaggacgaccagggcctgagcagcgacagcagcagcagcctgggcgagaaggagctgagcagcaccgtgaagatccccgacgccgccttcatccaggccgccagaagaaagagagagctggccagagcccaggacgactacatcagcctggacgtgcagcacaccagcagcatcagcgtgagcagaaacgaggagaccagcgaggagagccaggaggacgagaagcaggacacctgggagcagcagcagatgagaaaggccgtgaagatcatcgaggagagagacatcgacctgagctgcggcaacggcagcagcaaggtgaagaagttcgacaccagcatcagcttcccccccgtgaacctggagatcatcaagaagcagctgaacaccagactgaccctgctgcaggagacccacagaagccacctgagagagtacgagaagtacgtgcaggacgtgaagagcagcaagagcaccatccagaacctggagagcagcagcaaccaggccctgaactgcaagttctacaagagcatgaagatctacgtggagaacctgatcgactgcctgaacgagaagatcatcaacatccaggagatcgagagcagcatgcacgccctgctgctgaagcaggccatgaccttcatgaagagaagacaggacgagctgaagcacgagagcacctacctgcagcagctgagcagaaaggacgagaccagcaccagcggcaacttcagcgtggacgagaagacccagtggatcctggaggagatcgagagcagaagaaccaagagaagacaggccagagtgctgagcggcaactgcaaccaccaggagggcaccagcagcgacgacgagctgcccagcgccgagatgatcgacttccagaagagccagggcgacatcctgcagaagcagaagaaggtgttcgaggaggtgcaggacgacttctgcaacatccagaacatcctgctgaagttccagcagtggagagagaagttccccgacagctactacgaggccttcatcagcctgtgcatccccaagctgctgaaccccctgatcagagtgcagctgatcgactggaaccccctgaagctggagagcaccggcctgaaggagatgccctggttcaagagcgtggaggagttcatggacagcagcgtggaggacagcaagaaggagagcagcagcgacaagaaggtgctgagcgccatcatcaacaagaccatcatccccagactgaccgacttcgtggagttcctgtgggaccccctgagcaccagccagaccaccagcctgatcacccactgcagagtgatcctggaggagcacagcacctgcgagaacgaggtgagcaagagcagacaggacctgctgaagagcatcgtgagcagaatgaagaaggccgtggaggacgacgtgttcatccccctgtaccccaagagcgccgtggagaacaagaccagcccccacagcaagttccaggagagacagttctggagcggcctgaagctgttcagaaacatcctgctgtggaacggcctgctgaccgacgacaccctgcaggagctgggcctgggcaagctgctgaacagatacctgatcatcgccctgctgaacgccacccccggccccgacgtggtgaagaagtgcaaccaggtggccgcctgcctgcccgagaagtggttcgagaacagcgccatgagaaccagcatcccccagctggagaacttcatccagttcctgctgcagagcgcccacaagctgagcagaagcgagttcagagacgaggtggaggagatcatcctgatcctggtgaagatcaaggccctgaaccaggccgagagcttcatcggcgagcaccacctggaccacctgaagagcctgatcaaggaggactag

SEQ ID NO: 8161 - DNA, 765 bp, Artificial Sequence
  Description of Artificial Sequence: Synthetic coding sequence
atggcccacagacccaagagaaccttcagacagagagccgccgacagcagcgacagcgacggcgccgaggagagccccgccgagcccggcgcccccagagagctgcccgtgcccggcagcgccgaggaggagccccccagcggcggcggcagagcccaggtggccggcctgccccacagagtgagaggccccagaggcagaggcagagtgtgggccagcagcagaagagccaccaaggccgcccccagagccgacgagggcagcgagagcagaaccctggacgtgagcaccgacgaggaggacaagatccaccacagcagcgagagcaaggacgaccagggcctgagcagcgacagcagcagcagcctgggcgagaaggagctgagcagcaccgtgaagatccccgacgccgccttcatccaggccgccagaagaaagagagagctggccagagcccaggacgactacatcagcctggacgtgcagcacaccagcagcatcagcggcatgaagagagagagcgaggacgaccccgagagcgagcccgacgaccacgagaagagaatccccttcaccctgagaccccagaccctgagacagagaatggccgaggagagcatcagcagaaacgaggagaccagcgaggagagccaggaggacgagaagcaggacacctgggagcagcagcagatgagaaaggccgtgaagatcatcgagatcaacatcaccaccggcaacagccccctgacccccgagggcgtgtag

SEQ ID NO: 8162 - DNA, 504 bp, Artificial Sequence
  Description of Artificial Sequence: Synthetic coding sequence
atgagcgagtggatgaagaagggccccctggagtggcaggactacatctacaaggaggtgagagtgaccgccagcgagaagaacgagtacaagggctgggtgctgaccaccgaccccgtgagcgccaacatcgtgctggtgaacttcctggaggacggcagcatgagcgtgaccggcatcatgggccacgccgtgcagaccgtggagaccatgaacgagggcgaccacagagtgagagagaagctgatgcacctgttcaccagcggcgactgcaaggcctacagccccgaggacctggaggagagaaagaacagcctgaagaagtggctggagaagaaccacatccccatcaccgagcagggcgacgcccccagaaccctgtgcgtggccggcgtgctgaccatcgaccccccctacggccccgagaactgcagcagcagcaacgagatcatcctgagcagagtgcaggacctgatcgagggccacctgaccgccagccagtag

SEQ ID NO: 8163 - DNA, 336 bp, Artificial Sequence
  Description of Artificial Sequence: Synthetic coding sequence
atgagcgagtggatgaagaagggccccctggagtggcaggactacatctacaaggaggtgagagtgaccgccagcgagaagaacgagtacaagggctgggtgctgaccaccgaccccgtgagcgccaaggtgctgctgagccccagactggagtgcagcggcgagatcagcgccctgtgcaacctgcacctggccggcagcagcgacagccccgccctggccagcagagtggccggcaccaccggcatctgccaccacgtgtggctgatcttcgtgttcttcgtggagaccggcctgagacacgtggcccagtactgcccctgcgagctgccctag

SEQ ID NO: 8164 - DNA, 330 bp, Artificial Sequence
  Description of Artificial Sequence: Synthetic coding sequence
atggcctaccagctgtacagaaacaccaccctgggcaacagcctgcaggagagcctggacgagctgatccagagccagcagatcaccccccagctggccctgcaggtgctgctgcagttcgacaaggccatcaacgccgccctggcccagagagtgagaaacagagtgaacttcagaggcagcctgaacacctacagattctgcgacaacgtgtggaccttcgtgctgaacgacgtggagttcagagaggtgaccgagctgatcaaggtggacaaggtgaagatcgtggcctgcgacggcaagaacaccggcagcaacaccaccgagtag

SEQ ID NO: 8165 - DNA, 330 bp, Artificial Sequence; identical to SEQ ID NO: 8164
  Description of Artificial Sequence: Synthetic coding sequence

SEQ ID NO: 8166 - DNA, 330 bp, Artificial Sequence; identical to SEQ ID NO: 8164
  Description of Artificial Sequence: Synthetic coding sequence

SEQ ID NO: 8167 - DNA, 1320 bp, Artificial Sequence
  Description of Artificial Sequence: Synthetic coding sequence
atggccgaccccgacgtgctgaccgaggtgcccgccgccctgaagagactggccaagtacgtgatcagaggcttctacggcatcgagcacgccctggccctggacatcctgatcagaaacagctgcgtgaaggaggaggacatgctggagctgctgaagttcgacagaaagcagctgagaagcgtgctgaacaacctgaagggcgacaagttcatcaagtgcagaatgagagtggagaccgccgccgacggcaagaccaccagacacaactactacttcatcaactacagaaccctggtgaacgtggtgaagtacaagctggaccacatgagaagaagaatcgagaccgacgagagagacagcaccaacagagccagcttcaagtgccccgtgtgcagcagcaccttcaccgacctggaggccaaccagctgttcgaccccatgaccggcaccttcagatgcaccttctgccacaccgaggtggaggaggacgagagcgccatgcccaagaaggacgccagaaccctgctggccagattcaacgagcagatcgagcccatctacgccctgctgagagagaccgaggacgtgaacctggcctacgagatcctggagcccgagcccaccgagatccccgccctgaagcagagcaaggaccacgccgccaccaccgccggcgccgccagcctggccggcggccaccacagagaggcctgggccaccaagggccccagctacgaggacctgtacacccagaacgtggtgatcaacatggacgaccaggaggacctgcacagagccagcctggagggcaagagcgccaaggagagacccatctggctgagagagagcaccgtgcagggcgcctacggcagcgaggacatgaaggagggcggcatcgacatggacgccttccaggagagagaggagggccacgccggccccgacgacaacgaggaggtgatgagagccctgctgatccacgagaagaagaccagcagcgccatggccggcagcgtgggcgccgccgcccccgtgaccgccgccaacggcagcgacagcgagagcgagaccagcgagagcgacgacgacagcccccccagacccgccgccgtggccgtgcacaagagagaggaggacgaggaggaggacgacgagttcgaggaggtggccgacgaccccatcgtgatggtggccggcagacccttcagctacagcgaggtgagccagagacccgagctggtggcccagatgacccccgaggagaaggaggcctacatcgccatgggccagagaatgttcgaggacctgttcgagtag

SEQ ID NO: 8168 - DNA, 150 bp, Artificial Sequence
  Description of Artificial Sequence: Synthetic coding sequence
atggccgaccccgacgtgctgaccgaggtgcccgccgccctgaagagactggccaagtacgtgatcagaggcttctacggcatcgagcacgccctggccctggacatcctgatcagaaacagctgcgtgaaggaggaggacatgctgtag

SEQ ID NO: 8169 - DNA, 369 bp, Artificial Sequence
  Description of Artificial Sequence: Synthetic coding sequence
atggccgaccccgacgtgctgaccgaggtgcccgccgccctgaagagactggccaagtacgtgatcagaggcttctacggcatcgagcacgccctggccctggacatcctgatcagaaacagctgcgtgaaggaggaggacatgctggagctgctgaagttcgacagaaagcagctgagaagcgtgctgaacaacctgaagggcgacaagttcatcaagtgcagaatgagagtggagaccgccgccgacggcaagaccaccagacacaactactacttcatcaactacagaaccctggtgaacgtggtgaagtacaagctggaccacatgagaagaagaatcgagaccgacgagagagacagcacctag

SEQ ID NO: 8170 - DNA, 1188 bp, Artificial Sequence
  Description of Artificial Sequence: Synthetic coding sequence
atggacgaggagcccgagagaaccaagagatgggagggcggctacgagagaacctgggagatcctgaaggaggacgagagcggcagcctgaaggccaccatcgaggacatcctgttcaaggccaagagaaagagagtgttcgagcaccacggccaggtgagactgggcatgatgagacacctgtacgtggtggtggacggcagcagaaccatggaggaccaggacctgaagcccaacagactgacctgcaccctgaagctgctggagtacttcgtggaggagtacttcgaccagaaccccatcagccagatcggcatcatcgtgaccaagagcaagagagccgagaagctgaccgagctgagcggcaaccccagaaagcacatcaccagcctgaaggaggccgtggacatgacctgccacggcgagcccagcctgtacaacagcctgagcatggccatgcagaccctgaagcacatgcccggccacaccagcagagaggtgctgatcatcttcagcagcctgaccacctgcgaccccagcaacatctacgacctgatcaagaccctgaaggccgccaagatcagagtgagcgtgatcggcctgagcgccgaggtgagagtgtgcaccgtgctggccagagagaccggcggcacctaccacgtgatcctggacgagagccactacaaggagctgctgacccaccacctgagccccccccccgccagcagcagcagcgagtgcagcctgatcagaatgggcttcccccagcacaccatcgccagcctgagcgaccaggacgccaagcccagcttcagcatggcccacctggacggcaacaccgagcccggcctgaccctgggcggctacttctgcccccagtgcagagccaagtactgcgagctgcccgtggagtgcaagatctgcggcctgaccctggtgagcgccccccacctggccagaagctaccaccacctgttccccctggacgccttccaggagatccccctggaggagtacaacggcgagagattctgctacggctgccagggcgagctgaaggaccagcacgtgtacgtgtgcgccgtgtgccagaacgtgttctgcgtggactgcgacgtgttcgtgcacgacagcctgcactgctgccccggctgcatccacaagatccccgcccccagcggcgtgtag

SEQ ID NO: 8171 - DNA, 1017 bp, Artificial Sequence
  Description of Artificial Sequence: Synthetic coding sequence
atgagacacctgtacgtggtggtggacggcagcagaaccatggaggaccaggacctgaagcccaacagactgacctgcaccctgaagctgctggagtacttcgtggaggagtacttcgaccagaaccccatcagccagatcggcatcatcgtgaccaagagcaagagagccgagaagctgaccgagctgagcggcaaccccagaaagcacatcaccagcctgaaggaggccgtggacatgacctgccacggcgagcccagcctgtacaacagcctgagcatggccatgcagaccctgaagcacatgcccggccacaccagcagagaggtgctgatcatcttcagcagcctgaccacctgcgaccccagcaacatctacgacctgatcaagaccctgaaggccgccaagatcagagtgagcgtgatcggcctgagcgccgaggtgagagtgtgcaccgtgctggccagagagaccggcggcacctaccacgtgatcctggacgagagccactacaaggagctgctgacccaccacctgagccccccccccgccagcagcagcagcgagtgcagcctgatcagaatgggcttcccccagcacaccatcgccagcctgagcgaccaggacgccaagcccagcttcagcatggcccacctggacggcaacaccgagcccggcctgaccctgggcggctacttctgcccccagtgcagagccaagtactgcgagctgcccgtggagtgcaagatctgcggcctgaccctggtgagcgccccccacctggccagaagctaccaccacctgttccccctggacgccttccaggagatccccctggaggagtacaacggcgagagattctgctacggctgccagggcgagctgaaggaccagcacgtgtacgtgtgcgccgtgtgccagaacgtgttctgcgtggactgcgacgtgttcgtgcacgacagcctgcactgctgccccggctgcatccacaagatccccgcccccagcggcgtgtag

SEQ ID NO: 8172 - DNA, 1188 bp, Artificial Sequence; identical to SEQ ID NO: 8170
  Description of Artificial Sequence: Synthetic coding sequence

SEQ ID NO: 8173 - DNA, 606 bp, Artificial Sequence
  Description of Artificial Sequence: Synthetic coding sequence
atgaccgagaaggcccccgagccccacgtggaggaggacgacgacgacgagctggacagcaagctgaactacaagccccccccccagaagagcctgaaggagctgcaggagatggacaaggacgacgagagcctgatcaagtacaagaagaccctgctgggcgacggccccgtggtgaccgaccccaaggcccccaacgtggtggtgaccagactgaccctggtgtgcgagagcgcccccggccccatcaccatggacctgaccggcgacctggaggccctgaagaaggagaccatcgtgctgaaggagggcagcgagtacagagtgaagatccacttcaaggtgaacagagacatcgtgagcggcctgaagtacgtgcagcacacctacagaaccggcgtgaaggtggacaaggccaccttcatggtgggcagctacggccccagacccgaggagtacgagttcctgacccccgtggaggaggcccccaagggcatgctggccagaggcacctaccacaacaagagcttcttcaccgacgacgacaagcaggaccacctgagctgggagtggaacctgagcatcaagaaggagtggaccgagtag

SEQ ID NO: 8174 - DNA, 777 bp, Artificial Sequence
  Description of Artificial Sequence: Synthetic coding sequence
atgaacagaagcaacaagctggccgtgatcgccagccacatccaggagagcagattcctgtaccccggcaagaacggcagactgggcgacttcttcggcgaccccggcaacccccccgagttcaaccccagcggcagcaaggacggcaagtacgagctgctgaccagcgccaacgaggtgatcgtggaggagatcaaggacctgatgaccaagagcgacatcaagggccagcacaccgagaccctgctggccggcagcctggccaaggccctgtgctacatccacagaatgaacaaggaggtgaaggacaaccaggagatgaagagcagaatcctggtgatcaaggccgccgaggacagcgccctgcagtacatgaacttcatgaacgtgatcttcgccgcccagaagcagaacatcctgatcgacgcctgcgtgctggacagcgacagcggcctgctgcagcaggcctgcgacatcaccggcggcctgtacctgaaggtgccccagatgcccagcctgctgcagtacctgctgtgggtgttcctgcccgaccaggaccagagaagccagctgatcctgcccccccccgtgcacgtggactacagagccgcctgcttctgccacagaaacctgatcgagatcggctacgtgtgcagcgtgtgcctgagcatcttctgcaacttcagccccatctgcaccacctgcgagaccgccttcaagatcagcctgccccccgtgctgaaggccaagaagaagaagctgaaggtgagcgcctag

SEQ ID NO: 8175 - DNA, 927 bp, Artificial Sequence
  Description of Artificial Sequence: Synthetic coding sequence
atggtgagcgacgaggacgagctgaacctgctggtgatcgtggtggacgccaaccccatctggtggggcaagcaggccctgaaggagagccagttcaccctgagcaagtgcatcgacgccgtgatggtgctgggcaacagccacctgttcatgaacagaagcaacaagctggccgtgatcgccagccacatccaggagagcagattcctgtaccccggcaagaacggcagactgggcgacttcttcggcgaccccggcaacccccccgagttcaaccccagcggcagcaaggacggcaagtacgagctgctgaccagcgccaacgaggtgatcgtggaggagatcaaggacctgatgaccaagagcgacatcaagggccagcacaccgagaccctgctggccggcagcctggccaaggccctgtgctacatccacagaatgaacaaggaggtgaaggacaaccaggagatgaagagcagaatcctggtgatcaaggccgccgaggacagcgccctgcagtacatgaacttcatgaacgtgatcttcgccgcccagaagcagaacatcctgatcgacgcctgcgtgctggacagcgacagcggcctgctgcagcaggcctgcgacatcaccggcggcctgtacctgaaggtgccccagatgcccagcctgctgcagtacctgctgtgggtgttcctgcccgaccaggaccagagaagccagctgatcctgcccccccccgtgcacgtggactacagagccgcctgcttctgccacagaaacctgatcgagatcggctacgtgtgcagcgtgtgcctgagcatcttctgcaacttcagccccatctgcaccacctgcgagaccgccttcaagatcagcctgccccccgtgctgaaggccaagaagaagaagctgaaggtgagcgcctag

SEQ ID NO: 8176 - DNA, 6330 bp, Artificial Sequence
  Description of Artificial Sequence: Synthetic coding sequence
atggacgccctggagagcctgctggacgaggtggccctggagggcctggacggcctgtgcctgcccgccctgtggagcagactggagaccagagtgccccccttccccctgcccctggagccctgcacccaggagttcctgtggagagccctggccacccaccccggcatcagcttctacgaggagcccagagagagacccgacctgcagctgcaggacagatacgaggagatcgacctggagaccggcatcctggagagcagaagagaccccgtggccctggaggacgtgtaccccatccacatgatcctggagaacaaggacggcatccagggcagctgcagatacttcaaggagagaaagaacatcaccaacgacatcagaaccaagagcctgcagcccagatgcaccatggtggaggccttcgacagatggggcaagaagctgatcatcgtggccagccaggccatgagatacagagccctgatcggccaggagggcgaccccgacctgaagctgcccgacttcagctactgcatcctggagagactgggcagaagcagatggcagggcgagctgcagagagacctgcacaccaccgccttcaaggtggacgccggcaagctgcactaccacagaaagatcctgaacaagaacggcctgatcaccatgcagagccacgtgatcagactgcccaccggcgcccagcagcacagcatcctgctgctgctgaacagattccacgtggacagaagaagcaagtacgacatcctgatggagaagctgagcgtgatgctgagcaccagaaccaaccacatcgagaccctgggcaagctgagagaggagctgggcctgtgcgagagaaccttcaagagactgtaccagtacatgctgaacgccggcctggccaaggtggtgagcctgagactgcaggagatccaccccgagtgcggcccctgcaagaccaagaagggcaccgacgtgatggtgagatgcctgaagctgctgaaggagttcaagagaaacgaccacgacgacgacgaggacgaggaggtgatcagcaagaccgtgccccccgtggacatcgtgttcgagagagacatgctgacccagacctacgacctgatcgagagaagaggcaccaagggcatcagccaggccgagatcagagtggccatgaacgtgggcaagctggaggccagaatgctgtgcagactgctgcagagattcaaggtggtgaagggcttcatggaggacgagggcagacagagaaccaccaagtacatcagctgcgtgttcgccgaggagagcgacctgagcagacagtaccagagagagaaggccagaagcgagctgctgaccaccgtgagcctggccagcatgcaggaggagagcctgctgcccgagggcgaggacaccttcctgagcgagagcgacagcgaggaggagagaagcagcagcaagagaagaggcagaggcagccagaaggacaccagagccagcgccaacctgagacccaagacccagccccaccacagcacccccaccaagggcggctggaaggtggtgaacctgcaccccctgaagaagcagccccccagcttccccggcgccgccgaggagagagcctgccagagcctggccagcagagacagcctgctggacaccagcagcgtgagcgagcccaacgtgagcttcgtgagccactgcgccgacagcaacagcggcgacatcgccgtgatcgaggaggtgagaatggagaaccccaaggagagcagcagcagcctgaagaccggcagacacagcagcggccaggacaagccccacgagacctacagactgctgaagagaagaaacctgatcatcgaggccgtgaccaacctgagactgatcgagagcctgttcaccatccagaagatgatcatggaccaggagaagcaggagggcgtgagcaccaagtgctgcaagaagagcatcgtgagactggtgagaaacctgagcgaggagggcctgctgagactgtacagaaccaccgtgatccaggacggcatcaagaagaaggtggacctggtggtgcaccccagcatggaccagaacgaccccctggtgagaagcgccatcgagcaggtgagattcagaatcagcaacagcagcaccgccaacagagtgaagaccagccagccccccgtgccccagggcgaggccgaggaggacagccagggcaaggagggccccagcggcagcggcgacagccagctgagcgccagcagcagaagcgagagcggcagaatgaagaagagcgacaacaagatgggcatcacccccctgagaaactaccaccccatcgtggtgcccggcctgggcagaagcctgggcttcctgcccaagatgcccagactgagagtggtgcacatgttcctgtggtacctgatctacggccaccccgccagcaacaccgtggagaagcccagcttcatcagcgagagaagaaccatcaagcaggagagcggcagagccggcgtgagacccagcagcagcggcagcgcctgggaggcctgcagcgaggcccccagcaagggcagccaggacggcgtgacctgggaggccgaggtggagctggccaccgagaccgtgtacgtggacgacgccagctggatgagatacatcccccccatccccgtgcacagagacttcggcttcggctgggccctggtgagcgacatcctgctgtgcctgcccctgagcatcttcatccagatcgtgcaggtgagctacaaggtggacaacctggaggagttcctgaacgaccccctgaagaagcacaccctgatcagattcctgcccagacccatcagacagcagctgctgtacaagagaagatacatcttcagcgtggtggagaacctgcagagactgtgctacatgggcctgctgcagttcggccccaccgagaagttccaggacaaggaccaggtgttcatcttcctgaagaagaacgccgtgatcgtggacaccaccatctgcgacccccactacaacctggccagaagcagcagacccttcgagagaagactgtacgtgctgaacagcatgcaggacgtggagaactactggttcgacctgcagtgcgtgtgcctgaacacccccctgggcgtggtgagatgccccagagtgagaaagaacagcagcaccgaccagggcagcgacgaggagggcagcctgcagaaggagcaggagagcgccatggacaagcacaacctggagagaaagtgcgccatgctggagtacaccaccggcagcagagaggtggtggacgagggcctgatccccggcgacggcctgggcgccgccggcctggacagcagcttctacggccacctgaagagaaactggatctggaccagctacatcatcaaccaggccaagaaggagaacaccgccgccgagaacggcctgaccgtgagactgcagaccttcctgagcaagagacccatgcccctgagcgccagaggcaacagcagactgaacatctggggcgaggccagagtgggcagcgagctgtgcgccggctgggaggagcagttcgaggtggacagagagcccagcctggacagaaacagaagagtgagaggcggcaagagccagaagagaaagagactgaagaaggaccccggcaagaagatcaagagaaagaagaagggcgagttccccggcgagaagagcaagagactgagataccacgacgaggccgaccagagcgccctgcagagaatgaccagactgagagtgacctggagcatgcaggaggacggcctgctggtgctgtgcagaatcgccagcaacgtgctgaacaccaaggtgaagggccccttcgtgacctggcaggtggtgagagacatcctgcacgccaccttcgaggagagcctggacaagaccagccacagcgtgggcagaagagccagatacatcgtgaagaacccccaggcctacctgaactacaaggtgtgcctggccgaggtgtaccaggacaaggccctggtgggcgacttcatgaacagaagaggcgactacgacgaccccaaggtgtgcgccaacgagttcaaggagttcgtggagaagctgaaggagaagttcagcagcgccctgagaaacagcaacctggagatccccgacaccctgcaggagctgttcgccagatacagagtgctggccatcggcgacgagaaggaccagaccagaaaggaggacgagctgaacagcgtggacgacatccacttcctggtgctgcagaacctgatccagagcaccctggccctgagcgacagccagatgaagagctaccagagcttccagaccttcagactgtacagagagtacaaggaccacgtgctggtgaaggccttcatggagtgccagaagagaagcctggtgaacagaagaagagtgaaccacaccctgggccccaagaagaacagagccctgcccttcgtgcccatgagctaccagctgagccagacctactacagaatcttcacctggagattccccagcaccatctgcaccgagagcttccagttcctggacagaatgagagccgccggcaagctggaccagcccgacagattcagcttcaaggaccaggacaacaacgagcccaccaacgacatggtggccttcagcctggacggccccggcggcaactgcgtggccgtgctgaccctgttcagcctgggcctgatcagcgtggacgtgagaatccccgagcagatcatcgtggtggacagcagcatggtggagaacgaggtgatcaagagcctgggcaaggacggcagcctggaggacgacgaggacgaggaggacgacctggacgagggcgtgggcggcaagagaagaagcatggaggtgaagcccgcccaggccagccacaccaactacctgctgatgagaggctactacagccccggcatcgtgagcaccagaaacctgaaccccaacgacagcatcgtggtgaacagctgccagatgaagttccagctgagatgcacccccgtgcccgccagactgagacccgccgccgcccccctggaggagctgaccatgggcaccagctgcctgcccgacaccttcaccaagctgatcaacccccaggagaacacctgcagcctggaggagttcgtgctgcagctggagctgagcggctacagccccgaggacctgaccgccgccctggagatcctggaggccatcatcgccaccggctgcttcggcatcgacaaggaggagctgagaagaagattcagcgccctggagaaggccggcggcggcagaaccagaaccttcgccgactgcatccaggccctgctggagcagcaccaggtgctggaggtgggcggcaacaccgccagactggtggccatgggcagcgcctggccctggctgctgcacagcgtgagactgaaggacagagaggacgccgacatccagagagaggacccccaggccagacccctggagggcagcagcagcgaggacagcccccccgagggccaggccccccccagccacagccccagaggcaccaagagaagagccagctgggccagcgagaacggcgagaccgacgccgagggcacccagatgacccccgccaagagacccgccctgcaggacagcaacctggcccccagcctgggccccggcgccgaggacggcgccgaggcccaggcccccagccccccccccgccctggaggacaccgccgccgccggcgccgcccaggaggaccaggagggcgtgggcgagttcagcagccccggccaggagcagctgagcggccaggcccagccccccgagggcagcgaggaccccagaggcttcaccgagagcttcggcgccgccaacatcagccaggccgccagagagagagactgcgagagcgtgtgcttcatcggcagaccctggagagtggtggacggccacctgaacctgcccgtgtgcaagggcatgatggaggccatgctgtaccacatcatgaccagacccggcatccccgagagcagcctgctgagacactaccagggcgtgctgcagcccgtggccgtgctggagctgctgcagggcctggagagcctgggctgcatcagaaagagatggctgagaaagcccagacccgtgagcctgttcagcacccccgtggtggaggaggtggaggtgcccagcagcctggacgagagccccatggccttctacgagcccaccctggactgcaccctgagactgggcagagtgttcccccacgaggtgaactggaacaagtggatccacctgtag

SEQ ID NO: 8177 - DNA, 5064 bp, Artificial Sequence
  Description of Artificial Sequence: Synthetic coding sequence
atggacgccctggagagcctgctggacgaggtggccctggagggcctggacggcctgtgcctgcccgccctgtggagcagactggagaccagagtgccccccttccccctgcccctggagccctgcacccaggagttcctgtggagagccctggccacccaccccggcatcagcttctacgaggagcccagagagagacccgacctgcagctgcaggacagatacgaggagatcgacctggagaccggcatcctggagagcagaagagaccccgtggccctggaggacgtgtaccccatccacatgatcctggagaacaaggacggcatccagggcagctgcagatacttcaaggagagaaagaacatcaccaacgacatcagaaccaagagcctgcagcccagatgcaccatggtggaggccttcgacagatggggcaagaagctgatcatctgcctgcccggccacgccgtgcagggcctggacagacccggcggcggcagcagacccgaggccgccagactgctgctgctgcaccccggcaccgccagacccgtgcagcagggcgagctgcagagagacctgcacaccaccgccttcaaggtggacgccggcaagctgcactaccacagaaagatcctgaacaagaacggcctgatcaccatgcagagccacgtgatcagactgcccaccggcgcccagcagcacagcatcctgctgctgctgaacagattccacgtggacagaagaagcaagtacgacatcctgatggagaagctgagcgtgatgctgagcaccagaaccaaccacatcgagaccctgggcaagctgagagaggagctgggcctgtgcgagagaaccttcaagagactgtaccagtacatgctgaacgccggcctggccaaggtggtgagcctgagactgcaggagatccaccccgagtgcggcccctgcaagaccaagaagggcaccgacgtgatggtgagatgcctgaagctgctgaaggagttcaagagaaacgaccacgacgacgacgaggacgaggaggtgatcagcaagaccgtgccccccgtggacatcgtgttcgagagagacatgctgacccagacctacgacctgatcgagagaagaggcaccaagggcatcagccaggccgagatcagagtggccatgaacgtgggcaagctggaggccagaatgctgtgcagactgctgcagagattcaaggtggtgaagggcttcatggaggacgagggcagacagagaaccaccaagtacatcagctgcgtgttcgccgaggagagcgacctgagcagacagtaccagagagagaaggccagaagcgagctgctgaccaccgtgagcctggccagcatgcaggaggagagcctgctgcccgagggcgaggacaccttcctgagcgagagcgacagcgaggaggagagaagcagcagcaagagaagaggcagaggcagccagaaggacaccagagccagcgccaacctgagacccaagacccagccccaccacagcacccccaccaagggcggctggaaggtggtgaacctgcaccccctgaagaagcagccccccagcttccccggcgccgccgaggagagagcctgccagagcctggccagcagagacagcctgctggacaccagcagcgtgagcgagcccaacgtgagcttcgtgagccactgcgccgacagcaacagcggcgacatcgccgtgatcgaggaggtgagaatggagaaccccaaggagagcagcagcagcctgaagaccggcagacacagcagcggccaggacaagccccacgagacctacagactgctgaagagaagaaacctgatcatcgaggccgtgaccaacctgagactgatcgagagcctgttcaccatccagaagatgatcatggaccaggagaagcaggagggcgtgagcaccaagtgctgcaagaagagcatcgtgagactggtgagaaacctgagcgaggagggcctgctgagactgtacagaaccaccgtgatccaggacggcatcaagaagaaggtggacctggtggtgcaccccagcatggaccagaacgaccccctggtgagaagcgccatcgagcaggtgagattcagaatcagcaacagcagcaccgccaacagagtgaagaccagccagccccccgtgccccagggcgaggccgaggaggacagccagggcaaggagggccccagcggcagcggcgacagccagctgagcgccagcagcagaagcgagagcggcagaatgaagaagagcgacaacaagatgggcatcacccccctgagaaactaccaccccatcgtggtgcccggcctgggcagaagcctgggcttcctgcccaagatgcccagactgagagtggtgcacatgttcctgtggtacctgatctacggccaccccgccagcaacaccgtggagaagcccagcttcatcagcgagagaagaaccatcaagcaggagagcggcagagccggcgtgagacccagcagcagcggcagcgcctgggaggcctgcagcgaggcccccagcaagggcagccaggacggcgtgacctgggaggccgaggtggagctggccaccgagaccgtgtacgtggacgacgccagctggatgagatacatcccccccatccccgtgcacagagacttcggcttcggctgggccctggtgagcgacatcctgctgtgcctgcccctgagcatcttcatccagatcgtgcaggtgagctacaaggtggacaacctggaggagttcctgaacgaccccctgaagaagcacaccctgatcagattcctgcccagacccatcagacagcagctgctgtacaagagaagatacatcttcagcgtggtggagaacctgcagagactgtgctacatgggcctgctgcagttcggccccaccgagaagttccaggacaaggaccaggtgttcatcttcctgaagaagaacgccgtgatcgtggacaccaccatctgcgacccccactacaacctggccagaagcagcagacccttcgagagaagactgtacgtgctgaacagcatgcaggacgtggagaactactggttcgacctgcagtgcgtgtgcctgaacacccccctgggcgtggtgagatgccccagagtgagaaagaacagcagcaccgaccagggcagcgacgaggagggcagcctgcagaaggagcaggagagcgccatggacaagcacaacctggagagaaagtgcgccatgctggagtacaccaccggcagcagagaggtggtggacgagggcctgatccccggcgacggcctgggcgccggcagcatccccgccagcaccgacaccagcagcgccaccggcagcggccccgccaccagcagcaccagacccaagagaagaaccctgccccagagaatggacaccgtgagactgcagaccttcctgagcaagagacccatgcccctgagcgccagaggcaacagcagactgaacatctggggcgaggccagagtgggcagcgagctgtgcgccggctgggaggagcagttcgaggtggacagagagcccagcctggacagaaacagaagagtgagaggcggcaagagccagaagagaaagagactgaagaaggaccccggcaagaagatcaagagaaagaagaagggcgagttccccggcgagaagagcaagagactgagataccacgacgaggccgaccagagcgccctgcagagaatgaccagactgagagtgacctggagcatgcaggaggacggcctgctggtgctgtgcagaatcgccagcaacgtgctgaacaccaaggtgaagggccccttcgtgacctggcaggtggtgagagacatcctgcacgccaccttcgaggagagcctggacaagaccagccacagcgtgggcagaagagccagatacatcgtgaagaacccccaggcctacctgaactacaaggtgtgcctggccgaggtgtaccaggacaaggccctggtgggcgacttcatgaacagaagaggcgactacgacgaccccaaggtgtgcgccaacgagttcaaggagttcgtggagaagctgaaggagaagttcagcagcgccctgagaaacagcaacctggagatccccgacaccctgcaggagctgttcgccagatacagagtgctggccatcggcgacgagaaggaccagaccagaaaggaggacgagctgaacagcgtggacgacatccacttcctggtgctgcagaacctgatccagagcaccctggccctgagcgacagccagatgaagagctaccagagcttccagaccttcagactgtacagagagtacaaggaccacgtgctggtgaaggccttcatggagtgccagaagagaagcctggtgaacagaagaagagtgaaccacaccctgggccccaagaagaacagagccctgcccttcgtgcccatgagctaccagctgagccagacctactacagaatcttcacctggagattccccagcaccatctgcaccgagagcttccagttcctggacagaatgagagccgccggcaagctggaccagcccgacagattcagcttcaaggaccaggacaacaacgagcccaccaacgacatggtggccttcagcctggacggccccggcggcaactgcgtggccgtgctgaccctgttcagcctgggcctgatcagcgtggacgtgagaatccccgagcagatcatcgtggtggacagcagcatggtggagaacgaggtgatcaagagcctgggcaaggacggcagcctggaggacgacgaggacgaggaggacgacctggacgagggcgtgggcggcaagagaagaagcatggaggtgaagcccgcccaggccagccacaccaactacctgctgatgagaggctactacagccccggcatcgtgagcaccagaaacctgaaccccaacgacagcatcgtggtgaacagctgccagatgaagttccagctgagatgcacccccgtgcccgccagactgagacccgcctag

SEQ ID NO: 8178 - DNA, 2736 bp, Artificial Sequence
  Description of Artificial Sequence: Synthetic coding sequence
atggacacctgcggcgtgggctacgtggccctgggcgaggccggccccgtgggcaacatgaccgtggtggacagccccggccaggaggtgctgaaccagctggacgtgaagaccagcagcgagatgaccagcgccgaggccagcgtggagatgagcctgcccacccccctgcccggcttcgaggacagccccgaccagagaagactgccccccgagcaggagagcctgagcagactggagcagcccgacctgagcagcgagatgagcaaggtgagcaagcccagagccagcaagcccggcagaaagagaggcggcagaaccagaaagggccccaagagaccccagcagcccaacccccccagcgcccccctggtgcccggcctgctggaccagagcaaccccctgagcacccccatgcccaagaagagaggcagaaagagcaaggccgagctgctgctgctgaagctgagcaaggacctggacagacccgagagccagagccccaagagaccccccgaggacttcgagacccccagcggcgagagacccagaagaagagccgcccaggtggccctgctgtacctgcaggagctggccgaggagctgagcaccgccctgcccgcccccgtgagctgccccgagggccccaaggtgagcagccccaccaagcccaagaagatcagacagcccgccgcctgccccggcggcgaggaggtggacggcgcccccagagacgaggacttcttcctgcaggtggaggccgaggacgtggaggagagcgagggccccagcgagagcagcagcgagcccgagcccgtggtgcccagaagcacccccagaggcagcaccagcggcaagcagaagccccactgcagaggcatggcccccaacggcctgcccaaccacatcatggcccccgtgtggaagtgcctgcacctgaccaaggacttcagagagcagaagcacagctactgggagttcgccgagtggatccccctggcctggaagtggcacctgctgagcgagctggaggccgccccctacctgccccaggaggagaagagccccctgttcagcgtgcagagagagggcctgcccgaggacggcaccctgtacagaatcaacagattcagcagcatcaccgcccaccccgagagatgggacgtgagcttcttcaccggcggccccctgtgggccctggactggtgccccgtgcccgagggcgccggcgccagccagtacgtggccctgttcagcagccccgacatgaacgagacccaccccctgagccagctgcacagcggccccggcctgctgcagctgtggggcctgggcaccctgcagcaggagagctgccccggcaacagagcccacttcgtgtacggcatcgcctgcgacaacggctgcatctgggacctgaagttctgccccagcggcgcctgggagctgcccggcacccccagaaaggcccccctgctgcccagactgggcctgctggccctggcctgcagcgacggcaaggtgctgctgttcagcctgccccaccccgaggccctgctggcccagcagccccccgacgccgtgaagcccgccatctacaaggtgcagtgcgtggccaccctgcaggtgggcagcatgcaggccaccgaccccagcgagtgcggccagtgcctgagcctggcctggatgcccaccagaccccaccagcacctggccgccggctactacaacggcatggtggtgttctggaacctgcccaccaacagccccctgcagagaatcagactgagcgacggcagcctgaagctgtaccccttccagtgcttcctggcccacgaccaggccgtgagaaccctgcagtggtgcaaggccaacagccacttcctggtgagcgccggcagcgacagaaagatcaagttctgggacctgagaagaccctacgagcccatcaacagcatcaagagattcctgagcaccgagctggcctggctgctgccctacaacggcgtgaccgtggcccaggacaactgctacgccagctacggcctgtgcggcatccactacatcgacgccggctacctgggcttcaaggcctacttcaccgcccccagaaagggcaccgtgtggagcctgagcggcagcgactggctgggcaccatcgccgccggcgacatcagcggcgagctgatcgccgccatcctgcccgacatggccctgaaccccatcaacgtgaagagacccgtggagagaagattccccatctacaaggccgacctgatcccctaccaggacagccccgagggccccgaccacagcagcgccagcagcggcgtgcccaacccccccaaggccagaacctacaccgagaccgtgaaccaccactacctgctgttccaggacaccgacctgggcagcttccacgacctgctgagaagagagcccatgctgagaatgcaggagggcgagggccacagccagctgtgcctggacagactgcagctggaggccatccacaaggtgagattcagccccaacctggacagctacggctggctggtgagcggcggccagagcggcctggtgagaatccacttcgtgagaggcctggccagccccctgggccacagaatgcagctggagagcagagcccacttcaacgccatgttccagcccagcagccccaccagaagacccggcttcagccccaccagccacagactgctgcccaccccctag

SEQ ID NO: 8179 - DNA, 2736 bp, Artificial Sequence; identical to SEQ ID NO: 8178
  Description of Artificial Sequence: Synthetic coding sequence

SEQ ID NO: 8180 - DNA, 225 bp, Artificial Sequence
  Description of Artificial Sequence: Synthetic coding sequence
atggacacctgcggcgtgggctacgtggccctgggcgaggccggccccgtgggcaacatgaccgtggtggacagccccggccaggaggtgctgaaccagctggacgtgaagaccagcagcgagatgaccagcgccgaggccagcgtggagatgagcctgcccacccccctgcccggcttcgaggacagccccgaccagagaagactgccccccgagcaggagtag

SEQ ID NO: 8181 - DNA, 408 bp, Artificial Sequence
  Description of Artificial Sequence: Synthetic coding sequence
atggacacctgcggcgtgggctacgtggccctgggcgaggccggccccgtgggcaacatgaccgtggtggacagccccggccaggaggtgctgaaccagctggacgtgaagaccagcagcgagatgaccagcgccgaggccagcgtggagatgagcctgcccacccccctgcccggcttcgaggacagccccgaccagagaagactgccccccgagcaggagagcctgagcagactggagcagcccgacctgagcagcgagatgagcaaggtgagcaagcccagagccagcaagcccggcagaaagagaggcggcagaaccagaaagggccccaagagaccccagcagcccaacccccccagcgcccccctggtgcccggcctgctggaccagagcaaccccctgtag

SEQ ID NO: 8182 - DNA, 2661 bp, Artificial Sequence
  Description of Artificial Sequence: Synthetic coding sequence
atgagcggcttcagccccgagctgatcgactacctggagggcaagatcagcttcgaggagttcgagagaagaagagaggagagaaagaccagagagaagaagagcctgcaggagaagggcaagctgagcgccgaggagaaccccgacgacagcgaggtgcccagcagcagcggcatcaacagcaccaagagccaggacaaggacgtgaacgagggcgagaccagcgacggcgtgagaaagagcgtgcacaaggtgttcgccagcatgctgggcgagaacgaggacgacgaggaggaggaggaggaggaggaggaggaggaggaggaggaggagacccccgagcagcccaccgccggcgacgtgttcgtgctggagatggtgctgaacagagagaccaagaagatgatgaaggagaagagacccagaagcaagctgcccagagccctgagaggcctgatgggcgaggccaacatcagattcgccagaggcgagagagaggaggccatcctgatgtgcatggagatcatcagacaggcccccctggcctacgagcccttcagcaccctggccatgatctacgaggaccagggcgacatggagaagagcctgcagttcgagctgatcgccgcccacctgaaccccagcgacaccgaggagtgggtgagactggccgagatgagcctggagcaggacaacatcaagcaggccatcttctgctacaccaaggccctgaagtacgagcccaccaacgtgagatacctgtgggagagaagcagcctgtacgagcagatgggcgaccacaagatggccatggacggctacagaagaatcctgaacctgctgagccccagcgacggcgagagattcatgcagctggccagagacatggccaagagctactacgaggccaacgacgtgaccagcgccatcaacatcatcgacgaggccttcagcaagcaccagggcctggtgagcatggaggacgtgaacatcgccgccgagctgtacatcagcaacaagcagtacgacaaggccctggagatcatcaccgacttcagcggcatcgtgctggagaagaagaccagcgaggagggcaccagcgaggagaacaaggcccccgagaacgtgacctgcaccatccccgacggcgtgcccatcgacatcaccgtgaagctgatggtgtgcctggtgcacctgaacatcctggagcccctgaaccccctgctgaccaccctggtggagcagaaccccgaggacatgggcgacctgtacctggacgtggccgaggccttcctggacgtgggcgagtacaacagcgccctgcccctgctgagcgccctggtgtgcagcgagagatacaacctggccgtggtgtggctgagacacgccgagtgcctgaaggccctgggctacatggagagagccgccgagagctacggcaaggtggtggacctggcccccctgcacctggacgccagaatcagcctgagcaccctgcagcagcagctgggccagcccgagaaggccctggaggccctggagcccatgtacgaccccgacaccctggcccaggacgccaacgccgcccagcaggagctgaagctgctgctgcacagaagcaccctgctgttcagccagggcaagatgtacggctacgtggacaccctgctgaccatgctggccatgctgctgaaggtggccatgaacagagcccaggtgtgcctgatcagcagcagcaagagcggcgagagacacctgtacctgatcaaggtgagcagagacaagatcagcgacagcaacgaccaggagagcgccaactgcgacgccaaggccatcttcgccgtgctgaccagcgtgctgaccaaggacgactggtggaacctgctgctgaaggccatctacagcctgtgcgacctgagcagattccaggaggccgagctgctggtggacagcagcctggagtactacagcttctacgacgacagacagaagagaaaggagctggagtacttcggcctgagcgccgccatcctggacaagaacttcagaaaggcctacaactacatcagaatcatggtgatggagaacgtgaacaagccccagctgtggaacatcttcaaccaggtgaccatgcacagccaggacgtgagacaccacagattctgcctgagactgatgctgaagaaccccgagaaccacgccctgtgcgtgctgaacggccacaacgccttcgtgagcggcagcttcaagcacgccctgggccagtacgtgcaggccttcagaacccaccccgacgagcccctgtacagcttctgcatcggcctgaccttcatccacatggccagccagaagtacgtgctgagaagacacgccctgatcgtgcagggcttcagcttcctgaacagatacctgagcctgagaggcccctgccaggagagcttctacaacctgggcagaggcctgcaccagctgggcctgatccacctggccatccactactaccagaaggccctggagctgccccccctggtggtggagggcatcgagctggaccagctggacctgagaagagacatcgcctacaacctgagcctgatctaccagagcagcggcaacaccggcatggcccagaccctgctgtacacctactgcagcatctag

SEQ ID NO: 8183 - DNA, 1242 bp, Artificial Sequence
  Description of Artificial Sequence: Synthetic coding sequence
atgagcggcttcagccccgagctgatcgactacctggagggcaagatcagcttcgaggagttcgagagaagaagagaggagagaaagaccagagagaagaagagcctgcaggagaagggcaagctgagcgccgaggagaaccccgacgacagcgaggtgcccagcagcagcggcatcaacagcaccaagagccaggacaaggacgtgaacgagggcgagaccagcgacggcgtgagaaagagcgtgcacaaggtgttcgccagcatgctgggcgagaacgaggacgacgaggaggaggaggaggaggaggaggaggaggaggaggaggaggagacccccgagcagcccaccgccggcgacgtgttcgtgctggagatggtgctgaacagagagaccaagaagatgatgaaggagaagagacccagaagcaagctgcccagagccctgagaggcctgatgggcgaggccaacatcagattcgccagaggcgagagagaggaggccatcctgatgtgcatggagatcatcagacaggcccccctggcctacgagcccttcagcaccctggccatgatctacgaggaccagggcgacatggagaagagcctgcagttcgagctgatcgccgcccacctgaaccccagcgacaccgaggagtgggtgagactggccgagatgagcctggagcaggacaacatcaagcaggccatcttctgctacaccaaggccctgaagtacgagcccaccaacgtgagatacctgtgggagagaagcagcctgtacgagcagatgggcgaccacaagatggccatggacggctacagaagaatcctgaacctgctgagccccagcgacggcgagagattcatgcagctggccagagacatggccaagagctactacgaggccaacgacgtgaccagcgccatcaacatcatcgacgaggccttcagcaagcaccagggcctggtgagcatggaggacgtgaacatcgccgccgagctgtacatcagcaacaagcagtacgacaaggccctggagatcatcaccgacttcagcggcatcgtgctggagaagaagaccagcgaggagggcaccagcgaggagaacaaggcccccgagaacgtgacctgcaccatccccgacggcgtgcccatcgacatcaccgtgaagctgatggtgtgcctggtgcacctgaacatcctggagcccctgaacgtgtgcaacaagatctgcacctag

SEQ ID NO: 8184 - DNA, 2469 bp, Artificial Sequence
  Description of Artificial Sequence: Synthetic coding sequence
atgaacaccgccgaccaggccagagtgggccccgccgacgacggccccgcccccagcggcgaggaggagggcgagggcggcggcgaggccggcggcaaggagcccgccgccgacgccgcccccggccccagcgccgccttcagactgatggtgaccagaagagagcccgccgtgaagctgcagtacgccgtgagcggcctggagcccctggcctggagcgaggaccacagagtgagcgtgagcaccgccagaagcatcgccgtgctggagctgatctgcgacgtgcacaaccccggccaggacctggtgatccacagaaccagcgtgcccgcccccctgaacagctgcctgctgaaggtgggcagcaagaccgaggtggccgagtgcaaggagaagttcgccgccagcaaggaccccaccgtgagccagaccttcatgctggacagagtgttcaaccccgagggcaaggccctgccccccatgagaggcttcaagtacaccagctggagccccatgggctgcgacgccaacggcagatgcctgctggccgccctgaccatggacaacagactgaccatccaggccaacctgaacagactgcagtgggtgcagctggtggacctgaccgagatctacggcgagagactgtacgagaccagctacagactgagcaagaacgaggcccccgagggcaacctgggcgacttcgccgagttccagagaagacacagcatgcagacccccgtgagaatggagtggagcggcatctgcaccacccagcaggtgaagcacaacaacgagtgcagagacgtgggcagcgtgctgctggccgtgctgttcgagaacggcaacatcgccgtgtggcagttccagctgcccttcgtgggcaaggagagcatcagcagctgcaacaccatcgagagcggcatcaccagccccagcgtgctgttctggtgggagtacgagcacaacaacagaaagatgagcggcctgatcgtgggcagcgccttcggccccatcaagatcctgcccgtgaacctgaaggccgtgaagggctacttcaccctgagacagcccgtgatcctgtggaaggagatggaccagctgcccgtgcacagcatcaagtgcgtgcccctgtaccacccctaccagaagtgcagctgcagcctggtggtggccgccagaggcagctacgtgttctggtgcctgctgctgatcagcaaggccggcctgaacgtgcacaacagccacgtgaccggcctgcacagcctgcccatcgtgagcatgaccgccgacaagcagaacggcaccgtgtacacctgcagcagcgacggcaaggtgagacagctgatccccatcttcaccgacgtggccctgaagttcgagcaccagctgatcaagctgagcgacgtgttcggcagcgtgagaacccacggcatcgccgtgagcccctgcggcgcctacctggccatcatcaccaccgagggcatgatcaacggcctgcaccccgtgaacaagaactaccaggtgcagttcgtgaccctgaagaccttcgaggaggccgccgcccagctgctggagagcagcgtgcagaacctgttcaagcaggtggacctgatcgacctggtgagatggaagatcctgaaggacaagcacatcccccagttcctgcaggaggccctggagaagaagatcgagagcagcggcgtgacctacttctggagattcaagctgttcctgctgagaatcctgtaccagagcatgcagaagacccccagcgaggccctgtggaagcccacccacgaggacagcaagatcctgctggtggacagccccggcatgggcaacgccgacgacgagcagcaggaggagggcaccagcagcaagcaggtggtgaagcagggcctgcaggagagaagcaaggagggcgacgtggaggagcccaccgacgacagcctgcccaccaccggcgacgccggcggcagagagcccatggaggagaagctgctggagatccagggcaagatcgaggccgtggagatgcacctgaccagagagcacatgaagagagtgctgggcgaggtgtacctgcacacctggatcaccgagaacaccagcatccccaccagaggcctgtgcaacttcctgatgagcgacgaggagtacgacgacagaaccgccagagtgctgatcggccacatcagcaagaagatgaacaagcagaccttccccgagcactgcagcctgtgcaaggagatcctgcccttcaccgacagaaagcaggccgtgtgcagcaacggccacatctggctgagatgcttcctgacctaccagagctgccagagcctgatctacagaagatgcctgctgcacgacagcatcgccagacaccccgcccccgaggaccccgactggatcaagagactgctgcagagcccctgccccttctgcgacagccccgtgttctag

SEQ ID NO: 8185 - DNA, 1374 bp, Artificial Sequence
  Description of Artificial Sequence: Synthetic coding sequence
atggccgccgaggccgccgacctgggcctgggcgccgccgtgcccgtggagctgagaagagagagaagaatggtgtgcgtggagtaccccggcgtggtgagagacgtggccaagatgctgcccaccctgggcggcgaggagggcgtgagcagaatctacgccgaccccaccaagagactggagctgtacttcagacccaaggacccctactgccaccccgtgtgcgccaacagattcagcaccagcagcctgctgctgagaatcagaaagagaaccagaagacagaagggcgtgctgggcaccgaggcccacagcgaggtgaccttcgacatggagatcctgggcatcatcagcaccatctacaagttccagggcatgagcgacttccagtacctggccgtgcacaccgaggccggcggcaagcacaccagcatgtacgacaaggtgctgatgctgagacccgagaaggaggccttcttccaccaggagctgcccctgtacatccccccccccatcttcagcagactggacgcccccgtggactacttctacagacccgagacccagcacagagagggctacaacaacccccccatcagcggcgagaacctgatcggcctgagcagagccagaagaccccacaacgccatcttcgtgaacttcgaggacgaggaggtgcccaagcacctgtggatcagattcggctacgaccccagaaagaaccccgacgccaagatctaccaggtgctggacttcagaatcagatgcggcatgaagcacggctacgcccccagcgacctgcccgtgaaggccaagagaagcacctacaactacagcctgcccatcaccgtgaagaagaccagcagccagctggtgaccatgcacgacctgaagcagggcctgggccccagcggcaccagcggcgccagaaagcccgccagcagcaagtacaagctgaaggtgagcctgcagaccctgagagacagcgtgtacatcttcagagagggcgccctgcccccctacagacagatgttctaccagctgtgcgacctgaacgtggaggagctgcagaagatcatccacagaaacgacggcgccgagaacagctgcaccgagagagacggctggtgcctgcccaagaccagcgacgagctgagagacaccatgagcctgatgatcagacagaccatcagaagcaagagacccgccctgttcagcagcagcgccaaggccgacggcggcaaggagcagctgacctacgagagcggcgaggacgaggaggacgaggaggaggaggaggaggaggaggaggacttcaagcccagcgacggcagcgagaacgagatggagaccgagatcctggactacgtgtag

SEQ ID NO: 8186 - DNA, 834 bp, Artificial Sequence
  Description of Artificial Sequence: Synthetic coding sequence
atgctgagacccgagaaggaggccttcttccaccaggagctgcccctgtacatccccccccccatcttcagcagactggacgcccccgtggactacttctacagacccgagacccagcacagagagggctacaacaacccccccatcagcggcgagaacctgatcggcctgagcagagccagaagaccccacaacgccatcttcgtgaacttcgaggacgaggaggtgcccaagcagcccctggaggccgccgcccagacctggagaagagtgtgcaccaaccccgtggacagaaaggtggaggaggagctgagaaagctgttcgacatcagacccatctggagcagaaacgccgtgaaggccaacatcagcgtgcaccccgacaagctgaaggtgctgctgcccttcatcgcctactacatgatcaccggcccctggagaagcctgtggatcagattcggctacgaccccagaaagaaccccgacgccaagatctaccaggtgctggacttcagaatcagatgcggcatgaagcacggctacgcccccagcgacctgcccgtgaaggccaagagaagcacctacaactacagcctgcccatcaccgtgaagaagaccagcagccagctggtgaccatgcacgacctgaagcagggcctgggccccagcggcaccagcggcgccagaaagcccgccagcagcaagtacaagctgaaggtgagcctgcagaccaccagcggcgaggaggtggtgaccagcctgagagaggtgtggcaccagcagctgcacgtggtggtgctgctggagcccttcggcagcctgggcccccactag

SEQ ID NO: 8187 - DNA, 1239 bp, Artificial Sequence
  Description of Artificial Sequence: Synthetic coding sequence
atgagcgacttccagtacctggccgtgcacaccgaggccggcggcaagcacaccagcatgtacgacaaggtgctgatgctgagacccgagaaggaggccttcttccaccaggagctgcccctgtacatccccccccccatcttcagcagactggacgcccccgtggactacttctacagacccgagacccagcacagagagggctacaacaacccccccatcagcggcgagaacctgatcggcctgagcagagccagaagaccccacaacgccatcttcgtgaacttcgaggacgaggaggtgcccaagcagcccctggaggccgccgcccagacctggagaagagtgtgcaccaaccccgtggacagaaaggtggaggaggagctgagaaagctgttcgacatcagacccatctggagcagaaacgccgtgaaggccaacatcagcgtgcaccccgacaagctgaaggtgctgctgcccttcatcgcctactacatgatcaccggcccctggagaagcctgtggatcagattcggctacgaccccagaaagaaccccgacgccaagatctaccaggtgctggacttcagaatcagatgcggcatgaagcacggctacgcccccagcgacctgcccgtgaaggccaagagaagcacctacaactacagcctgcccatcaccgtgaagaagaccagcagccagctggtgaccatgcacgacctgaagcagggcctgggccccagcggcaccagcggcgccagaaagcccgccagcagcaagtacaagctgaaggtgagcctgcagaccctgagagtgagaaccagagtgcagagccccagagccgtgtgcgtgggcgacatctggagaagaggcggcgacaagagccagggcagcctggcccccgccgccgcctgcggctgccccagcagagccctgtgggagcccggcccccccctgagccacgtgaccacccccggcatgatcggcatcggccacacccaggaggacagagccagagccggccacgtgggctgcagctgcggcagaagcctgaccggcagcagattcagacagtgcggctgccccgccggcgtgggcggcttccagagctgcagccacatccaggcccccgccagcagaagcaccgccctgggcgaggccgagaagggcgccagcagaaccgtggagagccccgccgagggcgtgggcggcagagacgagtgcagcagagacggctag

SEQ ID NO: 8188 - DNA, 1560 bp, Artificial Sequence
  Description of Artificial Sequence: Synthetic coding sequence
atggccgccgaggccgccgacctgggcctgggcgccgccgtgcccgtggagctgagaagagagagaagaatggtgtgcgtggagtaccccggcgtggtgagagacgtggccaagatgctgcccaccctgggcggcgaggagggcgtgagcagaatctacgccgaccccaccaagagactggagctgtacttcagacccaaggacccctactgccaccccgtgtgcgccaacagattcagcaccagcagcctgctgctgagaatcagaaagagaaccagaagacagaagggcgtgctgggcaccgaggcccacagcgaggtgaccttcgacatggagatcctgggcatcatcagcaccatctacaagttccagggcatgagcgacttccagtacctggccgtgcacaccgaggccggcggcaagcacaccagcatgtacgacaaggtgctgatgctgagacccgagaaggaggccttcttccaccaggagctgcccctgtacatccccccccccatcttcagcagactggacgcccccgtggactacttctacagacccgagacccagcacagagagggctacaacaacccccccatcagcggcgagaacctgatcggcctgagcagagccagaagaccccacaacgccatcttcgtgaacttcgaggacgaggaggtgcccaagcagcccctggaggccgccgcccagacctggagaagagtgtgcaccaaccccgtggacagaaaggtggaggaggagctgagaaagctgttcgacatcagacccatctggagcagaaacgccgtgaaggccaacatcagcgtgcaccccgacaagctgaaggtgctgctgcccttcatcgcctactacatgatcaccggcccctggagaagcctgtggatcagattcggctacgaccccagaaagaaccccgacgccaagatctaccaggtgctggacttcagaatcagatgcggcatgaagcacggctacgcccccagcgacctgcccgtgaaggccaagagaagcacctacaactacagcctgcccatcaccgtgaagaagaccagcagccagctggtgaccatgcacgacctgaagcagggcctgggccccagcggcaccagcggcgccagaaagcccgccagcagcaagtacaagctgaaggacagcgtgtacatcttcagagagggcgccctgcccccctacagacagatgttctaccagctgtgcgacctgaacgtggaggagctgcagaagatcatccacagaaacgacggcgccgagaacagctgcaccgagagagacggctggtgcctgcccaagaccagcgacgagctgagagacaccatgagcctgatgatcagacagaccatcagaagcaagagacccgccctgttcagcagcagcgccaaggccgacggcggcaaggagcagctgacctacgagagcggcgaggacgaggaggacgaggaggaggaggaggaggaggaggaggacttcaagcccagcgacggcagcgagaacgagatggagaccgagatcctggactacgtgtag

SEQ ID NO: 8189 - DNA, 1533 bp, Artificial Sequence
  Description of Artificial Sequence: Synthetic coding sequence
atggccgccgaggccgccgacctgggcctgggcgccgccgtgcccgtggagctgagaagagagagaagaatggtgtgcgtggagtaccccggcgtggtgagagacgtggccaagatgctgcccaccctgggcggcgaggagggcgtgagcagaatctacgccgacccccccaaggacccctactgccaccccgtgtgcgccaacagattcagcaccagcagcctgctgctgagaatcagaaagagaaccagaagacagaagggcgtgctgggcaccgaggcccacagcgaggtgaccttcgacatggagatcctgggcatcatcagcaccatctacaagttccagggcatgagcgacttccagtacctggccgtgcacaccgaggccggcggcaagcacaccagcatgtacgacaaggtgctgatgctgagacccgagaaggaggccttcttccaccaggagctgcccctgtacatccccccccccatcttcagcagactggacgcccccgtggactacttctacagacccgagacccagcacagagagggctacaacaacccccccatcagcggcgagaacctgatcggcctgagcagagccagaagaccccacaacgccatcttcgtgaacttcgaggacgaggaggtgcccaagcagcccctggaggccgccgcccagacctggagaagagtgtgcaccaaccccgtggacagaaaggtggaggaggagctgagaaagctgttcgacatcagacccatctggagcagaaacgccgtgaaggccaacatcagcgtgcaccccgacaagctgaaggtgctgctgcccttcatcgcctactacatgatcaccggcccctggagaagcctgtggatcagattcggctacgaccccagaaagaaccccgacgccaagatctaccaggtgctggacttcagaatcagatgcggcatgaagcacggctacgcccccagcgacctgcccgtgaaggccaagagaagcacctacaactacagcctgcccatcaccgtgaagaagaccagcagccagctggtgaccatgcacgacctgaagcagggcctgggccccagcggcaccagcggcgccagaaagcccgccagcagcaagtacaagctgaaggacagcgtgtacatcttcagagagggcgccctgcccccctacagacagatgttctaccagctgtgcgacctgaacgtggaggagctgcagaagatcatccacagaaacgacggcgccgagaacagctgcaccgagagagacggctggtgcctgcccaagaccagcgacgagctgagagacaccatgagcctgatgatcagacagaccatcagaagcaagagacccgccctgttcagcagcagcgccaaggccgacggcggcaaggagcagctgacctacgagagcggcgaggacgaggaggacgaggaggaggaggaggaggaggaggaggacttcaagcccagcgacggcagcgagaacgagatggagaccgagatcctggactacgtgtag

SEQ ID NO: 8190 - DNA, 1581 bp, Artificial Sequence
  Description of Artificial Sequence: Synthetic coding sequence
atggccgccgaggccgccgacctgggcctgggcgccgccgtgcccgtggagctgagaagagagagaagaatggtgtgcgtggagtaccccggcgtggtgagagacgtggccaagatgctgcccaccctgggcggcgaggagggcgtgagcagaatctacgccgaccccaccaagagactggagctgtacttcagacccaaggacccctactgccaccccgtgtgcgccaacagattcagcaccagcagcctgctgctgagaatcagaaagagaaccagaagacagaagggcgtgctgggcaccgaggcccacagcgaggtgaccttcgacatggagatcctgggcatcatcagcaccatctacaagttccagggcatgagcgacttccagtacctggccgtgcacaccgaggccggcggcaagcacaccagcatgtacgacaaggtgctgatgctgagacccgagaaggaggccttcttccaccaggagctgcccctgtacatccccccccccatcttcagcagactggacgcccccgtggactacttctacagacccgagacccagcacagagagggctacaacaacccccccatcagcggcgagaacctgatcggcctgagcagagccagaagaccccacaacgccatcttcgtgaacttcgaggacgaggaggtgcccaagcagcccctggaggccgccgcccagacctggagaagagtgtgcaccaaccccgtggacagaaaggtggaggaggagctgagaaagctgttcgacatcagacccatctggagcagaaacgccgtgaaggccaacatcagcgtgcaccccgacaagctgaaggtgctgctgcccttcatcgcctactacatgatcaccggcccctggagaagcctgtggatcagattcggctacgaccccagaaagaaccccgacgccaagatctaccaggtgctggacttcagaatcagatgcggcatgaagcacggctacgcccccagcgacctgcccgtgaaggccaagagaagcacctacaactacagcctgcccatcaccgtgaagaagaccagcagccagctggtgaccatgcacgacctgaagcagggcctgggccccagcggcaccagcggcgccagaaagcccgccagcagcaagtacaagctgaaggtgagcctgcagaccctgagagacagcgtgtacatcttcagagagggcgccctgcccccctacagacagatgttctaccagctgtgcgacctgaacgtggaggagctgcagaagatcatccacagaaacgacggcgccgagaacagctgcaccgagagagacggctggtgcctgcccaagaccagcgacgagctgagagacaccatgagcctgatgatcagacagaccatcagaagcaagagacccgccctgttcagcagcagcgccaaggccgacggcggcaaggagcagctgacctacgagagcggcgaggacgaggaggacgaggaggaggaggaggaggaggaggaggacttcaagcccagcgacggcagcgagaacgagatggagaccgagatcctggactacgtgtag

SEQ ID NO: 8191 - DNA, 597 bp, Artificial Sequence
  Description of Artificial Sequence: Synthetic coding sequence
tgacccctggaggccgccgcccagacctggagaagagtgtgcaccaaccccgtggacagaaaggtggaggaggagctgagaaagctgttcgacatcagacccatctggagcagaaacgccgtgaaggccaacatcagcgtgcaccccgacaagctgaaggtgctgctgcccttcatcgcctactacatgatcaccggcccctggagaagcctgtggatcagattcggctacgaccccagaaagaaccccgacgccaagatctaccaggtgctggacttcagaatcagatgcggcatgaagcacggctacgcccccagcgacctgcccgtgaaggccaagagaagcacctacaactacagcctgcccatcaccgtgaagaagaccagcagccagctggtgaccatgcacgacctgaagcagggcctgggccccagcggcaccagcggcgccagaaagcccgccagcagcaagtacaagctgaaggtgagcctgcagaccagcggcgaggaggtggtgaccagcctgagagaggtgtggcaccagcagctgcacgtggtggtgctgctggagcccttcggcagcctgggcccccactag

SEQ ID NO: 8192 - DNA, 273 bp, Artificial Sequence
  Description of Artificial Sequence: Synthetic coding sequence
tgaatcagatgcggcatgaagcacggctacgcccccagcgacctgcccgtgaaggccaagagaagcacctacaactacagcctgcccatcaccgtgaagaagaccagcagccagctggtgaccatgcacgacctgaagcagggcctgggccccagcggcaccagcggcgccagaaagcccgccagcagcaagtacaagctgaaggtgggcgcccccggcggccaggagtggagaggcggcctgcccagctggggcagagccccctgcggctag

SEQ ID NO: 8193 - DNA, 675 bp, Artificial Sequence
  Description of Artificial Sequence: Synthetic coding sequence
atgagcgacttccagtacctggccgtgcacaccgaggccggcggcaagcacaccagcatgtacgacaaggtgctgatgctgagacccgagaaggaggccttcttccaccaggagctgcccctgtacatccccccccccatcttcagcagactggacgcccccgtggactacttctacagacccgagacccagcacagagagggctacaacaacccccccatcagcggcgagaacctgatcggcctgagcagagccagaagaccccacaacgccatcttcgtgaacttcgaggacgaggaggtgcccaagcagcccctggaggccgccgcccagacctggagaagagtgtgcaccaaccccgtggacagaaaggtggaggaggagctgagaaagctgttcgacatcagacccatctggagcagaaacgccgtgaaggccaacatcagcgtgcaccccgacaagctgaaggtgctgctgcccttcatcgcctactacatgatcaccggcccctggagaagcctgtggatcagattcggctacgaccccagaaagaaccccgacgccaagatctaccaggtgctggacttcagaatcagatgcggcatgaagcacggctacgcccccagcgacctgcccgtgaaggccaagagaagcacctacaactacagcctgtag

SEQ ID NO: 8194 - DNA, 735 bp, Artificial Sequence
  Description of Artificial Sequence: Synthetic coding sequence
atgaccagagccatctacgccgaccccaccaagagactggagctgtacttcagacccaaggacccctactgccaccccgtgtgcgccaacagattcagcaccagcagcctgctgctgagaatcagaaagagaaccagaagacagaagggcgtgctgggcaccgaggcccacagcgaggtgaccttcgacatggagatcctgggcatcatcagcaccatctacaagttccagggcatgagcgacttccagtacctggccgtgcacaccgaggccggcggcaagcacaccagcatgtacgacaaggtgctgatgctgagacccgagaaggaggccttcttccaccaggagctgcccctgtacatccccccccccatcttcagcagactggacgcccccgtggactacttctacagacccgagacccagcacagagagggctacaacaacccccccatcagcggcgagaacctgatcggcctgagcagagccagaagaccccacaacgccatcttcgtgaacttcgaggacgaggaggtgcccaagcagcccctggaggccgccgcccagacctggagaagagtgtgcaccaaccccgtggacagaaaggtggaggaggagctgagaaagctgttcgacatcagacccatctggagcagaaacgccgtgaaggccaacatcagcgtgcaccccgacaagctgaaggtgctgctgcccttcatcgcctactacatgtag

SEQ ID NO: 8195 - DNA, 1548 bp, Artificial Sequence
  Description of Artificial Sequence: Synthetic coding sequence
atgggcagcctgagcagcagagtgctgagacagcccagacccgccctggcccagcaggcccagggcgccagagccggcggcagcgccagaagacccgacaccggcgacgacgccgccggccacggcttctgctactgcgccggcagccacaagagaaagagaagcagcggcagcttctgctactgccaccccgacagcgagaccgacgaggacgaggaggagggcgacgagcagcagagactgctgaacacccccagaagaaagaagctgaagagcaccagcaagtacatctaccagaccctgttcctgaacggcgagaacagcgacatcaagatctgcgccctgggcgaggagtggagcctgcacaagatctacctgtgccagagcggctacttcagcagcatgttcagcggcagctggaaggagagcagcatgaacatcatcgagctggagatccccgaccagaacatcgacgtggaggccctgcaggtggccttcggcagcctgtacagagacgacgtgctgatcaagcccagcagagtggtggccatcctggccgccgcctgcctgctgcagctggacggcctgatccagcagtgcggcgagaccatgaaggagaccgtgaacgtgaagaccgtgtgcggctactacaccagcgccggcacctacggcctggacagcgtgaagaagaagtgcctggagtggctgctgaacaacctgatgacccaccagaacgtggagctgttcaaggagctgagcatcaacgtgatgaagcagctgatcggcagcagcaacctgttcgtgatgcaggtggagatggacatctacaccgccctgaagaagtggatgttcctgcagctggtgcccagctggaacggcagcctgaagcagctgctgaccgagaccgacgtgtggttcagcaagcagagaaaggacttcgagggcatggccttcctggagaccgagcagggcaagcccttcgtgagcgtgttcagacacctgagactgcagtacatcatcagcgacctggccagcgccagaatcatcgagcaggacgccgtggtgcccagcgagtggctgagcagcgtgtacaagcagcagtggttcgccatgctgagagccgagcaggacagcgaggtgggcccccaggagatcaacaaggaggagctggagggcaacagcatgagatgcggcagaaagctggccaaggacggcgagtactgctggagatggaccggcttcaacttcggcttcgacctgctggtgacctacaccaacagatacatcatcttcaagagaaacaccctgaaccagccctgcagcggcagcgtgagcctgcagcccagaagaagcatcgccttcagactgagactggccagcttcgacagcagcggcaagctgatctgcagcagaaccaccggctaccagatcctgaccctggagaaggaccaggagcaggtggtgatgaacctggacagcagactgctgatcttccccctgtacatctgctgcaacttcctgtacatcagccccgagaagaagaactag

SEQ ID NO: 8196 - DNA, 1311 bp, Artificial Sequence
  Description of Artificial Sequence: Synthetic coding sequence
atggagcccgacgacttcgacagcgaggacaaggagatcctgagctgggacatcaacgacgtgaagctgccccagaacgtgaagaagaccgactggttccaggagtggcccgacagctacgccaagcacatctacagcagcgaggacaagaacgcccagagacacctgagcagctgggccatgagaaacaccaacaaccacaacagcagaatcctgaagaagagctgcctgggcgtggtggtgtgcggcagagactgcctggccgaggagggcagaaagatctacctgagacccgccatctgcgacaaggccagacagaagcagcagagaaagagatgccccaactgcgacggccccctgaagctgatcccctgcagaggccacggcggcttccccgtgaccaacttctggagacacgacggcagattcatcttcttccagagcaagggcgagcacgaccaccccaagcccgagaccaagctggaggccgaggccagaagagccatgaagaaggtgaacaccgcccccagcagcgtgagcctgagcctgaagggcagcaccgagaccagaagcctgcccggcgagacccagagccagggcagcctgcccctgacctggagcttccaggagggcgtgcagctgcccggcagctacagcggccacctgatcgccaacaccccccagcagaacagcctgaacgactgcttcagcttcagcaagagctacggcctgggcggcatcaccgacctgaccgaccagaccagcaccgtggaccccatgaagctgtacgagaagagaaagctgagcagcagcagaacctacagcagcggcgacctgctgccccccagcgccagcggcgtgtacagcgaccacggcgacctgcaggcctggagcaagaacgccgccctgggcagaaaccacctggccgacaactgctacagcaactaccccttccccctgaccagctggccctgcagcttcagccccagccagaacagcagcgagcccttctaccagcagctgcccctggagccccccgccgccaagaccggctgcccccccctgtggcccaaccccgccggcaacctgtacgaggagaaggtgcacgtggacttcaacagctacgtgcagagccccgcctaccacagcccccaggaggaccccttcctgttcacctacgccagccacccccaccagcagtacagcctgcccagcaagagcagcaagtgggacttcgaggaggagatgacctacctgggcctggaccactgcaacaacgacatgctgctgaacctgtgccccctgagatag

SEQ ID NO: 8197 - DNA, 1521 bp, Artificial Sequence
  Description of Artificial Sequence: Synthetic coding sequence
atgcccgccgccgccgtgcaggaggccgtgggcgtgtgcagctacggcatgcagctgagctgggacatcaacgacccccagatgccccaggagctggccctgttcgaccagttcagagagtggcccgacggctacgtgagattcatctacagcagcgacgagaagaaggcccagagacacctgagcggctgggccatgagaaacaccaacaaccacaacggccacatcctgaagaagagctgcctgggcgtggtggtgtgcacccaggcctgcaccctgcccgacggcagcagactgcagctgagacccgccatctgcgacaaggccagactgaagcagcagaagaaggcctgccccaactgccacagcgccctggagctgatcccctgcagaggccacagcggctaccccgtgaccaacttctggagactggacggcaacgccatcttcttccaggccaagggcgtgcacgaccaccccagacccgagagcaagagcgagaccgaggccagaagaagcgccatcaagagacagatggccagcttctaccagccccagaagaagagaatcagagagagcgaggccgaggagaaccaggacagcagcggccacttcagcaacatcccccccctggagaaccccgaggacttcgacatcgtgaccgagaccagcttccccatccccggccagccctgccccagcttccccaagagcgacgtgtacaaggccacctgcgacctggccaccttccagggcgacaagatgccccccttccagaagtacagcagccccagaatctacctgcccagacccccctgcagctacgagctggccaaccccggctacaccaacagcagcccctaccccaccctgtacaaggacagcaccagcatccccaacgacaccgactgggtgcacctgaacaccctgcagtgcaacgtgaacagctacagcagctacgagagaagcttcgacttcaccaacaagcagcacggctggaagcccgccctgggcaagcccagcctggtggagagaaccaaccacggccagttccaggccatggccaccagaccctactacaaccccgagctgccctgcagatacctgaccacccccccccccggcgcccccgccctgcagaccgtgatcaccaccaccaccaaggtgagctaccaggcctaccagccccccgccatgaagtacagcgacagcgtgagagaggtgaagagcctgagcagctgcaactacgcccccgaggacaccggcatgagcgtgtaccccgagccctggggcccccccgtgaccgtgaccagagccgccagccccagcggccccccccccatgaagatcgccggcgactgcagagccatcagacccaccgtggccatcccccacgagcccgtgagcagcagaaccgacgaggccgagacctgggacgtgtgcctgagcggcctgggcagcgccgtgagctacagcgacagagtgggccccttcttcacctacaacaacgaggacttctag

SEQ ID NO: 8198 - DNA, 1863 bp, Artificial Sequence
  Description of Artificial Sequence: Synthetic coding sequence
atggccgaggccagaaccagcctgagcgcccactgcagaggccccctggccaccggcctgcaccccgacctggacctgcccggcagaagcctggccacccccgcccccagctgctacctgctgggcagcgagcccagcagcggcctgggcctgcagcccgagacccacctgcccgagggcagcctgaagagatgctgcgtgctgggcctgccccccaccagccccgccagcagcagcccctgcgccagcagcgacgtgaccagcatcatcagaagcagccagaccagcctggtgacctgcgtgaacggcctgagaagcccccccctgaccggcgacctgggcggccccagcaagagagccagacccggccccgccagcaccgacagccacgagggcagcctgcagctggaggcctgcagaaaggccagcttcctgaagcaggagcccgccgacgagttcagcgagctgttcggcccccaccagcagggcctgccccccccctaccccctgagccagctgccccccggccccagcctgggcggcctgggcctgggcctggccggcagagtggtggccggcagacaggcctgcagatgggtggactgctgcgccgcctacgagcagcaggaggagctggtgagacacatcgagaagagccacatcgaccagagaaagggcgaggacttcacctgcttctgggccggctgcgtgagaagatacaagcccttcaacgccagatacaagctgctgatccacatgagagtgcacagcggcgagaagcccaacaagtgcatgttcgagggctgcagcaaggccttcagcagactggagaacctgaagatccacctgagaagccacaccggcgagaagccctacctgtgccagcaccccggctgccagaaggccttcagcaacagcagcgacagagccaagcaccagagaacccacctggacaccaagccctacgcctgccagatccccggctgcagcaagagatacaccgaccccagcagcctgagaaagcacgtgaaggcccacagcgccaaggagcagcaggtgagaaagaagctgcacgccggccccgacaccgaggccgacgtgctgaccgagtgcctggtgctgcagcagctgcacaccagcacccagctggccgccagcgacggcaagggcggctgcggcctgggccaggagctgctgcccggcgtgtaccccggcagcatcaccccccacaacggcctggccagcggcctgctgccccccgcccacgacgtgcccagcagacaccaccccctggacgccaccaccagcagccaccaccacctgagccccctgcccatggccgagagcaccagagacggcctgggccccggcctgctgagccccatcgtgagccccctgaagggcctgggccccccccccctgccccccagcagccagagccacagccccggcggccagcccttccccaccctgcccagcaagcccagctacccccccttccagagccccccccccccccccctgcccagcccccagggctaccagggcagcttccacagcatccagagctgcttcccctacggcgactgctacagaatggccgagcccgccgccggcggcgacggcctggtgggcgagacccacggcttcaaccccctgagacccaacggctaccacagcctgagcacccccctgcccgccaccggctacgaggccctggccgaggccagctgccccaccgccctgccccagcagcccagcgaggacgtggtgagcagcggccccgaggactgcggcttcttccccaacggcgccttcgaccactgcctgggccacatccccagcatctacaccgacacctag

SEQ ID NO: 8199 - DNA, 1662 bp, Artificial Sequence
  Description of Artificial Sequence: Synthetic coding sequence
atggccgccgtgagcctgagactgggcgacctggtgtggggcaagctgggcagataccccccctggcccggcaagatcgtgaacccccccaaggacctgaagaagcccagaggcaagaagtgcttcttcgtgaagttcttcggcaccgaggaccacgcctggatcaaggtggagcagctgaagccctaccacgcccacaaggaggagatgatcaagatcaacaagggcaagagattccagcaggccgtggacgccgtggaggagttcctgagaagagccaagggcaaggaccagaccagcagccacaacagcagcgacgacaagaacagaagaaacagcagcgaggagagaagcagacccaacagcggcgacgagaagagaaagctgagcctgagcgagggcaaggtgaagaagaacatgggcgagggcaagaagagagtgagcagcggcagcagcgagagaggcagcaagagccccctgaagagagcccaggagcagagccccagaaagagaggcagaccccccaaggacgagaaggacctgaccatccccgagagcagcaccgtgaagggcatgatggccggccccatggccgccttcaagtggcagcccaccgccagcgagcccgtgaaggacgccgacccccacttccaccacttcctgctgagccagaccgagaagcccgccgtgtgctaccaggccatcaccaagaagctgaagatctgcgaggaggagaccggcagcaccagcatccaggccgccgacagcaccgccgtgaacggcagcatcacccccaccgacaagaagatcggcttcctgggcctgggcctgatgggcagcggcatcgtgagcaacctgctgaagatgggccacaccgtgaccgtgtggaacagaaccgccgagaagtgcgacctgttcatccaggagggcgccagactgggcagaacccccgccgaggtggtgagcacctgcgacatcaccttcgcctgcgtgagcgaccccaaggccgccaaggacctggtgctgggccccagcggcgtgctgcagggcatcagacccggcaagtgctacgtggacatgagcaccgtggacgccgacaccgtgaccgagctggcccaggtgatcgtgagcagaggcggcagattcctggaggcccccgtgagcggcaaccagcagctgagcaacgacggcatgctggtgatcctggccgccggcgacagaggcctgtacgaggactgcagcagctgcttccaggccatgggcaagaccagcttcttcctgggcgaggtgggcaacgccgccaagatgatgctgatcgtgaacatggtgcagggcagcttcatggccaccatcgccgagggcctgaccctggcccacgtgaccggccagagccagcagaccctgctggacatcctgaaccagggccagctggccagcatcttcctggaccagaagtgccagaacatcctgcagggcaacttcaagcccgacttctacctgaagtacatccagaaggacctgagactggccatcgccctgggcgacgccgtgaaccaccccacccccatggccgccgccgccaacgaggtgtacaagagagccaaggccctggaccagagcgacaacgacatgagcgccgtgtacagagcctacatccactag

SEQ ID NO: 8200 - DNA, 1611 bp, Artificial Sequence
  Description of Artificial Sequence: Synthetic coding sequence
atggccgccgtgagcctgagactgggcgacctggtgtggggcaagctgggcagataccccccctggcccggcaagatcgtgaacccccccaaggacctgaagaagcccagaggcaagaagtgcttcttcgtgaagttcttcggcaccgaggaccacgcctggatcaaggtggagcagctgaagccctaccacgcccacaaggaggagatgatcaagatcaacaagggcaagagattccagcaggccgtggacgccgtggaggagttcctgagaagagccaagggcaaggaccagaccagcagccacaacagcagcgacgacaagaacagaagaaacagcagcgaggagagaagcagacccaacagcggcgacgagaagagaaagctgagcctgagcgagggcaaggtgaagaagaacatgggcgagggcaagaagagagtgagcagcggcagcagcgagagaggcagcaagagccccctgaagagagcccaggagcagagccccagaaagagaggcagaccccccaaggacgagaaggacctgaccatccccgagagcagcaccgtgaagggcatgatggccggccccatggccgccttcaagtggcagcccaccgccagcgagcccgtgaaggacgccgacccccacttccaccacttcctgctgagccagaccgagaaggagaccggcagcaccagcatccaggccgccgacagcaccgccgtgaacggcagcatcacccccaccgacaagaagatcggcttcctgggcctgggcctgatgggcagcggcatcgtgagcaacctgctgaagatgggccacaccgtgaccgtgtggaacagaaccgccgagaagtgcgacctgttcatccaggagggcgccagactgggcagaacccccgccgaggtggtgagcacctgcgacatcaccttcgcctgcgtgagcgaccccaaggccgccaaggacctggtgctgggccccagcggcgtgctgcagggcatcagacccggcaagtgctacgtggacatgagcaccgtggacgccgacaccgtgaccgagctggcccaggtgatcgtgagcagaggcggcagattcctggaggcccccgtgagcggcaaccagcagctgagcaacgacggcatgctggtgatcctggccgccggcgacagaggcctgtacgaggactgcagcagctgcttccaggccatgggcaagaccagcttcttcctgggcgaggtgggcaacgccgccaagatgatgctgatcgtgaacatggtgcagggcagcttcatggccaccatcgccgagggcctgaccctggcccacgtgaccggccagagccagcagaccctgctggacatcctgaaccagggccagctggccagcatcttcctggaccagaagtgccagaacatcctgcagggcaacttcaagcccgacttctacctgaagtacatccagaaggacctgagactggccatcgccctgggcgacgccgtgaaccaccccacccccatggccgccgccgccaacgaggtgtacaagagagccaaggccctggaccagagcgacaacgacatgagcgccgtgtacagagcctacatccactag

SEQ ID NO: 8201 - DNA, 1419 bp, Artificial Sequence
  Description of Artificial Sequence: Synthetic coding sequence
atggccgccgtgagcctgagactgggcgacctggtgtggggcaagctgggcagataccccccctggcccggcaagatcgtgaacccccccaaggacctgaagaagcccagaggcaagaagtgcttcttcgtgaagttcttcggcaccgaggaccacgcctggatcaaggtggagcagctgaagccctaccacgcccacaaggaggagatgatcaagatcaacaagggcaagagattccagcaggccgtggacgccgtggaggagttcctgagaagagccaagggcaaggaccaggacctgaccatccccgagagcagcaccgtgaagggcatgatggccggccccatggccgccttcaagtggcagcccaccgccagcgagcccgtgaaggacgccgacccccacttccaccacttcctgctgagccagaccgagaagcccgccgtgtgctaccaggccatcaccaagaagctgaagatctgcgaggaggagaccggcagcaccagcatccaggccgccgacagcaccgccgtgaacggcagcatcacccccaccgacaagaagatcggcttcctgggcctgggcctgatgggcagcggcatcgtgagcaacctgctgaagatgggccacaccgtgaccgtgtggaacagaaccgccgagaagtgcgacctgttcatccaggagggcgccagactgggcagaacccccgccgaggtggtgagcacctgcgacatcaccttcgcctgcgtgagcgaccccaaggccgccaaggacctggtgctgggccccagcggcgtgctgcagggcatcagacccggcaagtgctacgtggacatgagcaccgtggacgccgacaccgtgaccgagctggcccaggtgatcgtgagcagaggcggcagattcctggaggcccccgtgagcggcaaccagcagctgagcaacgacggcatgctggtgatcctggccgccggcgacagaggcctgtacgaggactgcagcagctgcttccaggccatgggcaagaccagcttcttcctgggcgaggtgggcaacgccgccaagatgatgctgatcgtgaacatggtgcagggcagcttcatggccaccatcgccgagggcctgaccctggcccacgtgaccggccagagccagcagaccctgctggacatcctgaaccagggccagctggccagcatcttcctggaccagaagtgccagaacatcctgcagggcaacttcaagcccgacttctacctgaagtacatccagaaggacctgagactggccatcgccctgggcgacgccgtgaaccaccccacccccatggccgccgccgccaacgaggtgtacaagagagccaaggccctggaccagagcgacaacgacatgagcgccgtgtacagagcctacatccactag

SEQ ID NO: 8202 - DNA, 6723 bp, Artificial Sequence
  Description of Artificial Sequence: Synthetic coding sequence
atgctgccctgcaagaagagaagaaccaccgtgaccgagagcctgcagcacaagggcaaccaggaggagaacaacgtggacctggagagcgccgtgaagcccgagagcgaccaggtgaaggacctgagcagcgtgagcctgagctgggaccccagccacggcagagtggccggcttcgaggtgcagagcctgcaggacgccggcaaccagctgggcatggaggacaccagcctgagcagcggcatgctgacccagaacaccaacgtgcccatcctggagggcgtggacgtggccatcagccagggcatcaccctgcccagcctggagagcttccaccccctgaacatccacatcggcaagggcaagctgcacgccaccggcagcaagagaggcaagaagatgaccctgagacccggccccgtgacccaggaggacagatgcgaccacctgaccctgaaggagcccttcagcggcgagcccagcgaggaggtgaaggaggagggcggcaagccccagatgaacagcgagggcgagatccccagcctgcccagcggcagccagagcgccaagcccgtgagccagcccagaaagagcacccagcccgacgtgtgcgccagcccccaggagaagcccctgagaaccctgttccaccagcccgaggaggagatcgaggacggcggcctgttcatccccatggaggagcaggacaacgaggagagcgagaagagaagaaagaagaagaagggcaccaagagaaagagagacggcagaggccaggagggcaccctggcctacgacctgaagctggacgacatgctggacagaaccctggaggacggcgccaagcagcacaacctgaccgccgtgaacgtgagaaacatcctgcacgaggtgatcaccaacgagcacgtggtggccatgatgaaggccgccatcagcgagaccgaggacatgcccatgttcgagcccaagatgaccagaagcaagctgaaggaggtggtggagaagggcgtggtgatccccacctggaacatcagccccatcaagaaggccaacgagatcaagcccccccagttcgtggacatccacctggaggaggacgacagcagcgacgaggagtaccagcccgacgacgaggaggaggacgagaccgccgaggagagcctgctggagagcgacgtggagagcaccgccagcagccccagaggcgccaagaagagcagactgagacagagcagcgagatgaccgagaccgacgaggagagcggcatcctgagcgaggccgagaaggtgaccacccccgccatcagacacatcagcgccgaggtggtgcccatgggccccccccccccccccaagcccaagcagaccagagacagcaccttcatggagaagctgcacgccgtggacgaggagctggccagcagccccgtgtgcatggacagcttccagcccatggacgacagcctgatcgccttcagaaccagaagcaagatgcccctgaaggacgtgcccctgggccagctggaggccgagctgcaggcccccgacatcacccccgacatgtacgaccccaacaccgccgacgacgaggactggaagatgtggctgggcggcctgatgaacgacgacgtgggcaacgaggacgaggccgacgacgacgacgaccccgagtacaacttcctggaggacctggacgagcccgacaccgaggacttcagaaccgacagagccgtgagaatcaccaagaaggaggtgaacgagctgatggaggagctgttcgagaccttccaggacgagatgggcttcagcaacatggaggacgacggccccgaggaggaggagtgcgtggccgagcccagacccaacttcaacaccccccaggccctgagattcgaggagcccctggccaacctgctgaacgagcagcacagaaccgtgaaggagctgttcgagcagctgaagatgaagaagagcagcgccaagcagctgcaggaggtggagaaggtgaagccccagagcgagaaggtgcaccagaccctgatcctggaccccgcccagagaaagagactgcagcagcagatgcagcagcacgtgcagctgctgacccagatccacctgctggccacctgcaaccccaacctgaaccccgaggccaccaccaccagaatcttcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcgtgttcaccaaggccgaggacaacctgctggccctgggcctgaagcacttcgagggcaccgagttccccaaccccctgatcagcaagtacctgctgacctgcaagaccgcccaccagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggccagcctgcccagcatccaggaggagctgagacacatggccgacggcgccagagaggtgggcaacatgaccggcaccaccgagatcaacagcgacagaagcctggagaaggacaacctggagctgggcagcgagagcagataccccctgctgctgcccaagggcgtggtgctgaagctgaagcccgtggccaccagattccccagaaaggcctggagacagaagagaagcagcgtgctgaagcccctgctgatccagcccagccccagcctgcagcccagcttcaaccccggcaagacccccgccagaagcacccacagcgaggccccccccagcaagatggtgctgagaatcccccaccccatccagcccgccaccgtgctgcagaccgtgcccggcgtgccccccctgggcgtgagcggcggcgagagcttcgagagccccgccgccctgcccgccgtgccccccgaggccagaaccagcttccccctgagcgagagccagaccctgctgagcagcgcccccgtgcccaaggtgatgctgcccagcctggcccccagcaagttcagaaagccctacgtgagaagaagacccagcaagagaagaggcgtgaaggccagcccctgcatgaagcccgcccccgtgatccaccaccccgccagcgtgatcttcaccgtgcccgccaccaccgtgaagatcgtgagcctgggcggcggctgcaacatgatccagcccgtgaacgccgccgtggcccagagcccccagaccatccccatcaccaccctgctggtgaaccccaccagcttcccctgccccctgaaccagagcctggtggccagcagcgtgagccccctgatcgtgagcggcaacagcgtgaacctgcccatccccagcacccccgaggacaaggcccacgtgaacgtggacatcgcctgcgccgtggccgacggcgagaacgccttccagggcctggagcccaagctggagccccaggagctgagccccctgagcgccaccgtgttccccaaggtggagcacagccccggcccccccctggccgacgccgagtgccaggagggcctgagcgagaacagcgcctgcagatggaccgtggtgaagaccgaggagggcagacaggccctggagcccctgccccagggcatccaggagagcctgaacaaccccacccccggcgacctggaggagatcgtgaagatggagcccgaggaggccagagaggagatcagcggcagccccgagagagacatctgcgacgacatcaaggtggagcacgccgtggagctggacaccggcgcccccagcgaggagctgagcagcgccggcgaggtgaccaagcagaccgtgctgcagaaggaggaggagagaagccagcccaccaagacccccagcagcagccaggagccccccgacgagggcaccagcggcaccgacgtgaacaagggcagcagcaagaacgccctgagcagcatggaccccgaggtgagactgagcagcccccccggcaagcccgaggacagcagcagcgtggacggccagagcgtgggcacccccgtgggccccgagaccggcggcgagaagaacggccccgaggaggaggaggaggaggacttcgacgacctgacccaggacgaggaggacgagatgagcagcgccagcgaggagagcgtgctgagcgtgcccgagctgcaggagaccatggagaagctgacctggctggccagcgagagaagaatgagccaggagggcgagagcgaggaggagaacagccaggaggagaacagcgagcccgaggaggaggaggaggaggaggccgagggcatggagagcctgcagaaggaggacgagatgaccgacgaggccgtgggcgacagcgccgagaagccccccaccttcgccagccccgagaccgcccccgaggtggagaccagcagaaccccccccggcgagagcatcaaggccgccggcaagggcagaaacaaccacagagccagaaacaagagaggcagcagagccagagccagcaaggacaccagcaagctgctgctgctgtacgacgaggacatcctggagagagaccccctgagagagcagaaggacctggccttcgcccaggcctacctgaccagagtgagagaggccctgcagcacatccccggcaagtacgaggacttcctgcaggtgatctacgagttcgagagcagcacccagagaagaaccgccgtggacctgtacaagagcctgcagatcctgctgcaggactggccccagctgctgaaggacttcgccgccttcctgctgcccgagcaggccctggcctgcggcctgttcgaggagcagcaggccttcgagaagagcagaaagttcctgagacagctggagatctgcttcgccgagaaccccagccaccaccagaagatcatcaaggtgctgcagggctgcgccgactgcctgccccaggagatcaccgagctgaagacccagatgtggcagctgctgaagggccacgaccacctgcaggacgagttcagcatcttcttcgaccacctgagacccgccgccagcagaatgggcgacttcgaggagatcaactggaccgaggagaaggagtacgagttcgacggcttcgaggaggtggccctgcccgacgtggaggaggaggaggagccccccaagatccccaccgccagcaagaacaagagaaagaaggagatcggcgtgcagaaccacgacaaggagaccgagtggcccgacggcgccaaggactgcgcctgcagctgccacgagggcggccccgacagcaagctgaagaagagcaagagaagaagctgcagccactgcagcagcaaggtgtgcgacagcaagagctacaagagcaaggagccccacgagctggtgggcagcagcccccacagagaggccagccccatgcccggcgccaaggaggccggccagggcaaggacatgatggaggaggaggcccccgaggagagagagagcaccgaggccacccagagcagaaccgtgagaaccaccagaaagggcgagatgcccgtgagcggcctggccgtgggcagcaccctgcccagccccagagaggtgaccgtgaccgagagactgctgctggacggcccccccccccacagccccgagaccccccagttcccccccaccaccggcgccgtgctgtacaccgtgaagagaaaccaggtgggccccgaggtgagaagctgccccaaggccagccccagactgcagaaggagagagagggccagaaggccgtgagcgagagcgaggccctgatgctggtgtgggacgccagcgagaccgagaagctgcccggcaccgtggagccccccgccagcttcctgagccccgtgagcagcaagaccagagacgccggcagaagacacgtgagcggcaagcccgacacccaggagagatggctgcccagcagcagagccagagtgaagaccagagacagaacctgccccgtgcacgagagccccagcggcatcgacaccagcgagaccagccccaaggcccccagaggcggcctggccaaggacagcggcacccaggccaagggccccgagggcgagcagcagcccaaggccgccgaggccaccgtgtgcgccaacaacagcaaggtgagcagcaccggcgagaaggtggtgctgtggaccagagaggccgacagagtgatcctgaccatgtgccaggagcagggcgcccagccccagaccttcaacatcatcagccagcagctgggcaacaagacccccgccgaggtgagccacagattcagagagctgatgcagctgttccacaccgcctgcgaggccagcagcgaggacgaggacgacgccaccagcaccagcaacgccgaccagctgagcgaccacggcgacctgctgagcgaggaggagctggacgagtag

SEQ ID NO: 8203 - DNA, 4590 bp, Artificial Sequence
  Description of Artificial Sequence: Synthetic coding sequence
atgctgccctgcaagaagagaagaaccaccgtgaccgagagcctgcagcacaagggcaaccaggaggagaacaacgtggacctggagagcgccgtgaagcccgagagcgaccaggtgaaggacctgagcagcgtgagcctgagctgggaccccagccacggcagagtggccggcttcgaggtgcagagcctgcaggacgccggcaaccagctgggcatggaggacaccagcctgagcagcggcatgctgacccagaacaccaacgtgcccatcctggagggcgtggacgtggccatcagccagggcatcaccctgcccagcctggagagcttccaccccctgaacatccacatcggcaagggcaagctgcacgccaccggcagcaagagaggcaagaagatgaccctgagacccggccccgtgacccaggaggacagatgcgaccacctgaccctgaaggagcccttcagcggcgagcccagcgaggaggtgaaggaggagggcggcaagccccagatgaacagcgagggcgagatccccagcctgcccagcggcagccagagcgccaagcccgtgagccagcccagaaagagcacccagcccgacgtgtgcgccagcccccaggagaagcccctgagaaccctgttccaccagcccgaggaggagatcgaggacggcggcctgttcatccccatggaggagcaggacaacgaggagagcgagaagagaagaaagaagaagaagggcaccaagagaaagagagacggcagaggccaggagggcaccctggcctacgacctgaagctggacgacatgctggacagaaccctggaggacggcgccaagcagcacaacctgaccgccgtgaacgtgagaaacatcctgcacgaggtgatcaccaacgagcacgtggtggccatgatgaaggccgccatcagcgagaccgaggacatgcccatgttcgagcccaagatgaccagaagcaagctgaaggaggtggtggagaagggcgtggtgatccccacctggaacatcagccccatcaagaaggccaacgagatcaagcccccccagttcgtggacatccacctggaggaggacgacagcagcgacgaggagtaccagcccgacgacgaggaggaggacgagaccgccgaggagagcctgctggagagcgacgtggagagcaccgccagcagccccagaggcgccaagaagagcagactgagacagagcagcgagatgaccgagaccgacgaggagagcggcatcctgagcgaggccgagaaggtgaccacccccgccatcagacacatcagcgccgaggtggtgcccatgggccccccccccccccccaagcccaagcagaccagagacagcaccttcatggagaagctgcacgccgtggacgaggagctggccagcagccccgtgtgcatggacagcttccagcccatggacgacagcctgatcgccttcagaaccagaagcaagatgcccctgaaggacgtgcccctgggccagctggaggccgagctgcaggcccccgacatcacccccgacatgtacgaccccaacaccgccgacgacgaggactggaagatgtggctgggcggcctgatgaacgacgacgtgggcaacgaggacgaggccgacgacgacgacgaccccgagtacaacttcctggaggacctggacgagcccgacaccgaggacttcagaaccgacagagccgtgagaatcaccaagaaggaggtgaacgagctgatggaggagctgttcgagaccttccaggacgagatgggcttcagcaacatggaggacgacggccccgaggaggaggagtgcgtggccgagcccagacccaacttcaacaccccccaggccctgagattcgaggagcccctggccaacctgctgaacgagcagcacagaaccgtgaaggagctgttcgagcagctgaagatgaagaagagcagcgccaagcagctgcaggaggtggagaaggtgaagccccagagcgagaaggtgcaccagaccctgatcctggaccccgcccagagaaagagactgcagcagcagatgcagcagcacgtgcagctgctgacccagatccacctgctggccacctgcaaccccaacctgaaccccgaggccaccaccaccagaatcttcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcgtgttcaccaaggccgaggacaacctgctggccctgggcctgaagcacttcgagggcaccgagttccccaaccccctgatcagcaagtacctgctgacctgcaagaccgcccaccagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggccagcctgcccagcatccaggaggagctgagacacatggccgacggcgccagagaggtgggcaacatgaccggcaccaccgagatcaacagcgacagaagcctggagaaggacaacctggagctgggcagcgagagcagataccccctgctgctgcccaagggcgtggtgctgaagctgaagcccgtggccaccagattccccagaaaggcctggagacagaagagaagcagcgtgctgaagcccctgctgatccagcccagccccagcctgcagcccagcttcaaccccggcaagacccccgccagaagcacccacagcgaggccccccccagcaagatggtgctgagaatcccccaccccatccagcccgccaccgtgctgcagaccgtgcccggcgtgccccccctgggcgtgagcggcggcgagagcttcgagagccccgccgccctgcccgccgtgccccccgaggccagaaccagcttccccctgagcgagagccagaccctgctgagcagcgcccccgtgcccaaggtgatgctgcccagcctggcccccagcaagttcagaaagccctacgtgagaagaagacccagcaagagaagaggcgtgaaggccagcccctgcatgaagcccgcccccgtgatccaccaccccgccagcgtgatcttcaccgtgcccgccaccaccgtgaagatcgtgagcctgggcggcggctgcaacatgatccagcccgtgaacgccgccgtggcccagagcccccagaccatccccatcaccaccctgctggtgaaccccaccagcttcccctgccccctgaaccagagcctggtggccagcagcgtgagccccctgatcgtgagcggcaacagcgtgaacctgcccatccccagcacccccgaggacaaggcccacgtgaacgtggacatcgcctgcgccgtggccgacggcgagaacgccttccagggcctggagcccaagctggagccccaggagctgagccccctgagcgccaccgtgttccccaaggtggagcacagccccggcccccccctggccgacgccgagtgccaggagggcctgagcgagaacagcgcctgcagatggaccgtggtgaagaccgaggagggcagacaggccctggagcccctgccccagggcatccaggagagcctgaacaaccccacccccggcgacctggaggagatcgtgaagatggagcccgaggaggccagagaggagatcagcggcagccccgagagagacatctgcgacgacatcaaggtggagcacgccgtggagctggacaccggcgcccccagcgaggagctgagcagcgccggcgaggtgaccaagcagaccgtgctgcagaaggaggaggagagaagccagcccaccaagacccccagcagcagccaggagccccccgacgagggcaccagcggcaccgacgtgaacaagggcagcagcaagaacgccctgagcagcatggaccccgaggtgagactgagcagcccccccggcaagcccgaggacagcagcagcgtggacggccagagcgtgggcacccccgtgggccccgagaccggcggcgagaagaacggccccgaggaggaggaggaggaggacttcgacgacctgacccaggacgaggaggacgagatgagcagcgccagcgaggagagcgtgctgagcgtgcccgagctgcaggtgagagccggcgagtacagccaggtgttcagaggcctgagcaacatgtaccacctgctgatctgccacctgctggcctgctgcaccatggacagccccaagatcatctgcatctag

SEQ ID NO: 8204 - DNA, 726 bp, Artificial Sequence
  Description of Artificial Sequence: Synthetic coding sequence
atgtacgaccccaacaccgccgacgacgaggactggaagatgtggctgggcggcctgatgaacgacgacgtgggcaacgaggacgaggccgacgacgacgacgaccccgagtacaacttcctggaggacctggacgagcccgacaccgaggacttcagaaccgacagagccgtgagaatcaccaagaaggaggtgaacgagctgatggaggagctgttcgagaccttccaggacgagatgggcttcagcaacatggaggacgacggccccgaggaggaggagtgcgtggccgagcccagacccaacttcaacaccccccaggccctgagattcgaggagcccctggccaacctgctgaacgagcagcacagaaccgtgaaggagctgttcgagcagctgaagatgaagaagagcagcgccaagcagctgcaggaggtggagaaggtgaagccccagagcgagaaggtgcaccagaccctgatcctggaccccgcccagagaaagagactgcagcagcagatgcagcagaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccggcagaagacagatgtgccagctgtag

SEQ ID NO: 8205 - DNA, 6726 bp, Artificial Sequence
  Description of Artificial Sequence: Synthetic coding sequence
atgctgccctgcaagaagagaagaaccaccgtgaccgagagcctgcagcacaagggcaaccaggaggagaacaacgtggacctggagagcgccgtgaagcccgagagcgaccaggtgaaggacctgagcagcgtgagcctgagctgggaccccagccacggcagagtggccggcttcgaggtgcagagcctgcaggacgccggcaaccagctgggcatggaggacaccagcctgagcagcggcatgctgacccagaacaccaacgtgcccatcctggagggcgtggacgtggccatcagccagggcatcaccctgcccagcctggagagcttccaccccctgaacatccacatcggcaagggcaagctgcacgccaccggcagcaagagaggcaagaagatgaccctgagacccggccccgtgacccaggaggacagatgcgaccacctgaccctgaaggagcccttcagcggcgagcccagcgaggaggtgaaggaggagggcggcaagccccagatgaacagcgagggcgagatccccagcctgcccagcggcagccagagcgccaagcccgtgagccagcccagaaagagcacccagcccgacgtgtgcgccagcccccaggagaagcccctgagaaccctgttccaccagcccgaggaggagatcgaggacggcggcctgttcatccccatggaggagcaggacaacgaggagagcgagaagagaagaaagaagaagaagggcaccaagagaaagagagacggcagaggccaggagggcaccctggcctacgacctgaagctggacgacatgctggacagaaccctggaggacggcgccaagcagcacaacctgaccgccgtgaacgtgagaaacatcctgcacgaggtgatcaccaacgagcacgtggtggccatgatgaaggccgccatcagcgagaccgaggacatgcccatgttcgagcccaagatgaccagaagcaagctgaaggaggtggtggagaagggcgtggtgatccccacctggaacatcagccccatcaagaaggccaacgagatcaagcccccccagttcgtggacatccacctggaggaggacgacagcagcgacgaggagtaccagcccgacgacgaggaggaggacgagaccgccgaggagagcctgctggagagcgacgtggagagcaccgccagcagccccagaggcgccaagaagagcagactgagacagagcagcgagatgaccgagaccgacgaggagagcggcatcctgagcgaggccgagaaggtgaccacccccgccatcagacacatcagcgccgaggtggtgcccatgggccccccccccccccccaagcccaagcagaccagagacagcaccttcatggagaagctgcacgccgtggacgaggagctggccagcagccccgtgtgcatggacagcttccagcccatggacgacagcctgatcgccttcagaaccagaagcaagatgcccctgaaggacgtgcccctgggccagctggaggccgagctgcaggcccccgacatcacccccgacatgtacgaccccaacaccgccgacgacgaggactggaagatgtggctgggcggcctgatgaacgacgacgtgggcaacgaggacgaggccgacgacgacgacgaccccgagtacaacttcctggaggacctggacgagcccgacaccgaggacttcagaaccgacagagccgtgagaatcaccaagaaggaggtgaacgagctgatggaggagctgttcgagaccttccaggacgagatgggcttcagcaacatggaggacgacggccccgaggaggaggagtgcgtggccgagcccagacccaacttcaacaccccccaggccctgagattcgaggagcccctggccaacctgctgaacgagcagcacagaaccgtgaaggagctgttcgagcagctgaagatgaagaagagcagcgccaagcagctgcaggaggtggagaaggtgaagccccagagcgagaaggtgcaccagaccctgatcctggaccccgcccagagaaagagactgcagcagcagatgcagcagcacgtgcagctgctgacccagatccacctgctggccacctgcaaccccaacctgaaccccgaggccaccaccaccagaatcttcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcgtgttcaccaaggccgaggacaacctgctggccctgggcctgaagcacttcgagggcaccgagttccccaaccccctgatcagcaagtacctgctgacctgcaagaccgcccaccagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggccagcctgcccagcatccaggaggagctgagacacatggccgacggcgccagagaggtgggcaacatgaccggcaccaccgagatcaacagcgacagaagcctggagaaggacaacctggagctgggcagcgagagcagataccccctgctgctgcccaagggcgtggtgctgaagctgaagcccgtggccaccagattccccagaaaggcctggagacagaagagaagcagcgtgctgaagcccctgctgatccagcccagccccagcctgcagcccagcttcaaccccggcaagacccccgccagaagcacccacagcgaggccccccccagcaagatggtgctgagaatcccccaccccatccagcccgccaccgtgctgcagaccgtgcccggcgtgccccccctgggcgtgagcggcggcgagagcttcgagagccccgccgccctgcccgccgtgccccccgaggccagaaccagcttccccctgagcgagagccagaccctgctgagcagcgcccccgtgcccaaggtgatgctgcccagcctggcccccagcaagttcagaaagccctacgtgagaagaagacccagcaagagaagaggcgtgaaggccagcccctgcatgaagcccgcccccgtgatccaccaccccgccagcgtgatcttcaccgtgcccgccaccaccgtgaagatcgtgagcctgggcggcggctgcaacatgatccagcccgtgaacgccgccgtggcccagagcccccagaccatccccatcaccaccctgctggtgaaccccaccagcttcccctgccccctgaaccagagcctggtggccagcagcgtgagccccctgatcgtgagcggcaacagcgtgaacctgcccatccccagcacccccgaggacaaggcccacgtgaacgtggacatcgcctgcgccgtggccgacggcgagaacgccttccagggcctggagcccaagctggagccccaggagctgagccccctgagcgccaccgtgttccccaaggtggagcacagccccggcccccccctggccgacgccgagtgccaggagggcctgagcgagaacagcgcctgcagatggaccgtggtgaagaccgaggagggcagacaggccctggagcccctgccccagggcatccaggagagcctgaacaaccccacccccggcgacctggaggagatcgtgaagatggagcccgaggaggccagagaggagatcagcggcagccccgagagagacatctgcgacgacatcaaggtggagcacgccgtggagctggacaccggcgcccccagcgaggagctgagcagcgccggcgaggtgaccaagcagaccgtgctgcagaaggaggaggagagaagccagcccaccaagacccccagcagcagccaggagccccccgacgagggcaccagcggcaccgacgtgaacaagggcagcagcaagaacgccctgagcagcatggaccccgaggtgagactgagcagcccccccggcaagcccgaggacagcagcagcgtggacggccagagcgtgggcacccccgtgggccccgagaccggcggcgagaagaacggccccgaggaggaggaggaggaggacttcgacgacctgacccaggacgaggaggacgagatgagcagcgccagcgaggagagcgtgctgagcgtgcccgagctgcaggagaccatggagaagctgacctggctggccagcgagagaagaatgagccaggagggcgagagcgaggaggagaacagccaggaggagaacagcgagcccgaggaggaggaggaggaggaggccgagggcatggagagcctgcagaaggaggacgagatgaccgacgaggccgtgggcgacagcgccgagaagccccccaccttcgccagccccgagaccgcccccgaggtggagaccagcagaaccccccccggcgagagcatcaaggccgccggcaagggcagaaacaaccacagagccagaaacaagagaggcagcagagccagagccagcaaggacaccagcaagctgctgctgctgtacgacgaggacatcctggagagagaccccctgagagagcagaaggacctggccttcgcccaggcctacctgaccagagtgagagaggccctgcagcacatccccggcaagtacgaggacttcctgcaggtgatctacgagttcgagagcagcacccagagaagaaccgccgtggacctgtacaagagcctgcagatcctgctgcaggactggccccagctgctgaaggacttcgccgccttcctgctgcccgagcaggccctggcctgcggcctgttcgaggagcagcaggccttcgagaagagcagaaagttcctgagacagctggagatctgcttcgccgagaaccccagccaccaccagaagatcatcaaggtgctgcagggctgcgccgactgcctgccccaggagatcaccgagctgaagacccagatgtggcagctgctgaagggccacgaccacctgcaggacgagttcagcatcttcttcgaccacctgagacccgccgccagcagaatgggcgacttcgaggagatcaactggaccgaggagaaggagtacgagttcgacggcttcgaggaggtggccctgcccgacgtggaggaggaggaggagccccccaagatccccaccgccagcaagaacaagagaaagaaggagatcggcgtgcagaaccacgacaaggagaccgagtggcccgacggcgccaaggactgcgcctgcagctgccacgagggcggccccgacagcaagctgaagaagagcaagagaagaagctgcagccactgcagcagcaaggtgtgcgacagcaagagctacaagagcaaggagccccacgagctggtgggcagcagcccccacagagaggccagccccatgcccggcgccaaggaggccggccagggcaaggacatgatggaggaggaggcccccgaggagagagagagcaccgaggccacccagagcagaaccgtgagaaccaccagaaagggcgagatgcccgtgagcgccggcctggccgtgggcagcaccctgcccagccccagagaggtgaccgtgaccgagagactgctgctggacggcccccccccccacagccccgagaccccccagttcccccccaccaccggcgccgtgctgtacaccgtgaagagaaaccaggtgggccccgaggtgagaagctgccccaaggccagccccagactgcagaaggagagagagggccagaaggccgtgagcgagagcgaggccctgatgctggtgtgggacgccagcgagaccgagaagctgcccggcaccgtggagccccccgccagcttcctgagccccgtgagcagcaagaccagagacgccggcagaagacacgtgagcggcaagcccgacacccaggagagatggctgcccagcagcagagccagagtgaagaccagagacagaacctgccccgtgcacgagagccccagcggcatcgacaccagcgagaccagccccaaggcccccagaggcggcctggccaaggacagcggcacccaggccaagggccccgagggcgagcagcagcccaaggccgccgaggccaccgtgtgcgccaacaacagcaaggtgagcagcaccggcgagaaggtggtgctgtggaccagagaggccgacagagtgatcctgaccatgtgccaggagcagggcgcccagccccagaccttcaacatcatcagccagcagctgggcaacaagacccccgccgaggtgagccacagattcagagagctgatgcagctgttccacaccgcctgcgaggccagcagcgaggacgaggacgacgccaccagcaccagcaacgccgaccagctgagcgaccacggcgacctgctgagcgaggaggagctggacgagtag

SEQ ID NO: 8206 - DNA, 6723 bp, Artificial Sequence; identical to SEQ ID NO: 8202
  Description of Artificial Sequence: Synthetic coding sequence

SEQ ID NO: 8207 - DNA, 2913 bp, Artificial Sequence
  Description of Artificial Sequence: Synthetic coding sequence
atgctgccctgcaagaagagaagaaccaccgtgaccgagagcctgcagcacaagggcaaccaggaggagaacaacgtggacctggagagcgccgtgaagcccgagagcgaccaggtgaaggacctgagcagcgtgagcctgagctgggaccccagccacggcagagtggccggcttcgaggtgcagagcctgcaggacgccggcaaccagctgggcatggaggacaccagcctgagcagcggcatgctgacccagaacaccaacgtgcccatcctggagggcgtggacgtggccatcagccagggcatcaccctgcccagcctggagagcttccaccccctgaacatccacatcggcaagggcaagctgcacgccaccggcagcaagagaggcaagaagatgaccctgagacccggccccgtgacccaggaggacagatgcgaccacctgaccctgaaggagcccttcagcggcgagcccagcgaggaggtgaaggaggagggcggcaagccccagatgaacagcgagggcgagatccccagcctgcccagcggcagccagagcgccaagcccgtgagccagcccagaaagagcacccagcccgacgtgtgcgccagcccccaggagaagcccctgagaaccctgttccaccagcccgaggaggagatcgaggacggcggcctgttcatccccatggaggagcaggacaacgaggagagcgagaagagaagaaagaagaagaagggcaccaagagaaagagagacggcagaggccaggagggcaccctggcctacgacctgaagctggacgacatgctggacagaaccctggaggacggcgccaagcagcacaacctgaccgccgtgaacgtgagaaacatcctgcacgaggtgatcaccaacgagcacgtggtggccatgatgaaggccgccatcagcgagaccgaggacatgcccatgttcgagcccaagatgaccagaagcaagctgaaggaggtggtggagaagggcgtggtgatccccacctggaacatcagccccatcaagaaggccaacgagatcaagcccccccagttcgtggacatccacctggaggaggacgacagcagcgacgaggagtaccagcccgacgacgaggaggaggacgagaccgccgaggagagcctgctggagagcgacgtggagagcaccgccagcagccccagaggcgccaagaagagcagactgagacagagcagcgagatgaccgagaccgacgaggagagcggcatcctgagcgaggccgagaaggtgaccacccccgccatcagacacatcagcgccgaggtggtgcccatgggccccccccccccccccaagcccaagcagaccagagacagcaccttcatggagaagctgcacgccgtggacgaggagctggccagcagccccgtgtgcatggacagcttccagcccatggacgacagcctgatcgccttcagaaccagaagcaagatgcccctgaaggacgtgcccctgggccagctggaggccgagctgcaggcccccgacatcacccccgacatgtacgaccccaacaccgccgacgacgaggactggaagatgtggctgggcggcctgatgaacgacgacgtgggcaacgaggacgaggccgacgacgacgacgaccccgagtacaacttcctggaggacctggacgagcccgacaccgaggacttcagaaccgacagagccgtgagaatcaccaagaaggaggtgaacgagctgatggaggagctgttcgagaccttccaggacgagatgggcttcagcaacatggaggacgacggccccgaggaggaggagtgcgtggccgagcccagacccaacttcaacaccccccaggccctgagattcgaggagcccctggccaacctgctgaacgagcagcacagaaccgtgaaggagctgttcgagcagctgaagatgaagaagagcagcgccaagcagctgcaggaggtggagaaggtgaagccccagagcgagaaggtgcaccagaccctgatcctggaccccgcccagagaaagagactgcagcagcagatgcagcagcacgtgcagctgctgacccagatccacctgctggccacctgcaaccccaacctgaaccccgaggccaccaccaccagaatcttcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcgtgttcaccaaggccgaggacaacctgctggccctgggcctgaagcacttcgagggcaccgagttccccaaccccctgatcagcaagtacctgctgacctgcaagaccgcccaccagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggccagcctgcccagcatccaggaggagctgagacacatggccgacggcgccagacagagctacagaagaaagagaagaggcgtgagccagctgaagcccctgcacctgctgaagagccccctgatgaaggagccccagggccagatgtag

SEQ ID NO: 8208 - DNA, 618 bp, Artificial Sequence
  Description of Artificial Sequence: Synthetic coding sequence
atggccgccgccgccggcggcgccgccagcagaagaggcgccggcagaccctgccccttcagcatcgagcacatcctgagcagcctgcccgagagaagcctgcccgccagagccgcctgccccccccagcccgccggcagacagagccccgccaagcccgaggagcccggcgcccccgaggccgccccctgcgcctgctgctgctgctgcggccccagagccgccccctgcggcccccccgaggccgccgccggcctgggcgccagactggcctggcccctgagactgggccccgccgtgcccctgagcctgggcgcccccgccggcggcagcggcgccctgcccggcgccgtgggccccggcagccagagaagaaccagaagacacagaaccatcttcagcgaggagcagctgcaggccctggaggccctgttcgtgcagaaccagtaccccgacgtgagcaccagagagagactggccggcagaatcagactgagagaggagagagtggaggtgtggttcaagaacagaagagccaagtggagacaccagaagagagccagcgccagcgccagactgctgcccggcgtgaagaagagccccaagggcagctgctag

SEQ ID NO: 8209 - DNA, 1824 bp, Artificial Sequence
  Description of Artificial Sequence: Synthetic coding sequence
atgtggatgaacagcatcctgcccatcttcctgttcagaagcgtgagactgctgaagaacgaccccgtgaacctgcagaagttcagctacaccagcgaggacgaggcctggaagacctacctggagaaccccctgaccgccgccaccaaggccatgatgagagtgaacggcgacgacgacagcgtggccgccctgagcttcctgtacgactactacatgggccccaaggagaagagaatcctgagcagcagcaccggcggcagaaacgaccagggcaagagatactaccacggcatggagtacgagaccgacctgacccccctggagagccccacccacctgatgaagttcctgaccgagaacgtgagcggcacccccgagtaccccgacctgctgaagaagaacaacctgatgagcctggagggcgccctgcccacccccggcaaggccgcccccctgcccgccggccccagcaagctggaggccggcagcgtggacagctacctgctgcccaccaccgacatgtacgacaacggcagcctgaacagcctgttcgagagcatccacggcgtgccccccacccagagatggcagcccgacagcaccttcaaggacgacccccaggagagcatgctgttccccgacatcctgaagaccagccccgagcccccctgccccgaggactaccccagcctgaagagcgacttcgagtacaccctgggcagccccaaggccatccacatcaagagcggcgagagccccatggcctacctgaacaagggccagttctaccccgtgaccctgagaacccccgccggcggcaagggcctggccctgagcagcaacaaggtgaagagcgtggtgatggtggtgttcgacaacgagaaggtgcccgtggagcagctgagattctggaagcactggcacagcagacagcccaccgccaagcagagagtgatcgacgtggccgactgcaaggagaacttcaacaccgtggagcacatcgaggaggtggcctacaacgccctgagcttcgtgtggaacgtgaacgaggaggccaaggtgttcatcggcgtgaactgcctgagcaccgacttcagcagccagaagggcgtgaagggcgtgcccctgaacctgcagatcgacacctacgactgcggcctgggcaccgagagactggtgcacagagccgtgtgccagatcaagatcttctgcgacaagggcgccgagagaaagatgagagacgacgagagaaagcagttcagaagaaaggtgaagtgccccgacagcagcaacagcggcgtgaagggctgcctgctgagcggcttcagaggcaacgagaccacctacctgagacccgagaccgacctggagaccccccccgtgctgttcatccccaacgtgcacttcagcagcctgcagagaagcggcggcgccgcccccagcgccggccccagcagcagcaacagactgcccctgaagagaacctgcagccccttcaccgaggagttcgagcccctgcccagcaagcaggccaaggagggcgacctgcagagagtgctgctgtacgtgagaagagagaccgaggaggtgttcgacgccctgatgctgaagacccccgacctgaagggcctgagaaacgccatcagcgagaagtacggcttccccgaggagaacatctacaaggtgtacaagaagtgcaagagaggcatcctggtgaacatggacaacaacatcatccagcactacagcaaccacgtggccttcctgctggacatgggcgagctggacggcaagatccagatcatcctgaaggagctgtag

SEQ ID NO: 8210 - DNA, 1530 bp, Artificial Sequence
  Description of Artificial Sequence: Synthetic coding sequence
atggagtacgagaccgacctgacccccctggagagccccacccacctgatgaagttcctgaccgagaacgtgagcggcacccccgagtaccccgacctgctgaagaagaacaacctgatgagcctggagggcgccctgcccacccccggcaaggccgcccccctgcccgccggccccagcaagctggaggccggcagcgtggacagctacctgctgcccaccaccgacatgtacgacaacggcagcctgaacagcctgttcgagagcatccacggcgtgccccccacccagagatggcagcccgacagcaccttcaaggacgacccccaggagagcatgctgttccccgacatcctgaagaccagccccgagcccccctgccccgaggactaccccagcctgaagagcgacttcgagtacaccctgggcagccccaaggccatccacatcaagagcggcgagagccccatggcctacctgaacaagggccagttctaccccgtgaccctgagaacccccgccggcggcaagggcctggccctgagcagcaacaaggtgaagagcgtggtgatggtggtgttcgacaacgagaaggtgcccgtggagcagctgagattctggaagcactggcacagcagacagcccaccgccaagcagagagtgatcgacgtggccgactgcaaggagaacttcaacaccgtggagcacatcgaggaggtggcctacaacgccctgagcttcgtgtggaacgtgaacgaggaggccaaggtgttcatcggcgtgaactgcctgagcaccgacttcagcagccagaagggcgtgaagggcgtgcccctgaacctgcagatcgacacctacgactgcggcctgggcaccgagagactggtgcacagagccgtgtgccagatcaagatcttctgcgacaagggcgccgagagaaagatgagagacgacgagagaaagcagttcagaagaaaggtgaagtgccccgacagcagcaacagcggcgtgaagggctgcctgctgagcggcttcagaggcaacgagaccacctacctgagacccgagaccgacctggagaccccccccgtgctgttcatccccaacgtgcacttcagcagcctgcagagaagcggcggcgccgcccccagcgccggccccagcagcagcaacagactgcccctgaagagaacctgcagccccttcaccgaggagttcgagcccctgcccagcaagcaggccaaggagggcgacctgcagagagtgctgctgtacgtgagaagagagaccgaggaggtgttcgacgccctgatgctgaagacccccgacctgaagggcctgagaaacgccatcagcgagaagtacggcttccccgaggagaacatctacaaggtgtacaagaagtgcaagagaggcatcctggtgaacatggacaacaacatcatccagcactacagcaaccacgtggccttcctgctggacatgggcgagctggacggcaagatccagatcatcctgaaggagctgtag

SEQ ID NO: 8211 - DNA, 1881 bp, Artificial Sequence
  Description of Artificial Sequence: Synthetic coding sequence
atgagcaacgagctggacttcagaagcgtgagactgctgaagaacgaccccgtgaacctgcagaagttcagctacaccagcgaggacgaggcctggaagacctacctggagaaccccctgaccgccgccaccaaggccatgatgagagtgaacggcgacgacgacagcgtggccgccctgagcttcctgtacgactactacatgggccccaaggagaagagaatcctgagcagcagcaccggcggcagaaacgaccagggcaagagatactaccacggcatggagtacgagaccgacctgacccccctggagagccccacccacctgatgaagttcctgaccgagaacgtgagcggcacccccgagtaccccgacctgctgaagaagaacaacctgatgagcctggagggcgccctgcccacccccggcaaggccgcccccctgcccgccggccccagcaagctggaggccggcagcgtggacagctacctgctgcccaccaccgacatgtacgacaacggcagcctgaacagcctgttcgagagcatccacggcgtgccccccacccagagatggcagcccgacagcaccttcaaggacgacccccaggagagcatgctgttccccgacatcctgaagaccagccccgagcccccctgccccgaggactaccccagcctgaagagcgacttcgagtacaccctgggcagccccaaggccatccacatcaagagcggcgagagccccatggcctacctgaacaagggccagttctaccccgtgaccctgagaacccccgccggcggcaagggcctggccctgagcagcaacaaggtgaagagcgtggtgatggtggtgttcgacaacgagaaggtgcccgtggagcagctgagattctggaagcactggcacagcagacagcccaccgccaagcagagagtgatcgacgtggccgactgcaaggagaacttcaacaccgtggagcacatcgaggaggtggcctacaacgccctgagcttcgtgtggaacgtgaacgaggaggccaaggtgttcatcggcgtgaactgcctgagcaccgacttcagcagccagaagggcgtgaagggcgtgcccctgaacctgcagatcgacacctacgactgcggcctgggcaccgagagactggtgcacagagccgtgtgccagatcaagatcttctgcgacaagggcgccgagagaaagatgagagacgacgagagaaagcagttcagaagaaaggtgaagtgccccgacagcagcaacagcggcgtgaagggctgcctgctgagcggcttcagaggcaacgagaccacctacctgagacccgagaccgacctggagaccccccccgtgctgttcatccccaacgtgcacttcagcagcctgcagagaagcggcggcgccgcccccagcgccggccccagcagcagcaacagactgcccctgaagagaacctgcagccccttcaccgaggagttcgagcccctgcccagcaagcaggccaaggagggcgacctgcagagagtgctgctgtacgtgagaagagagaccgaggaggtgttcgacgccctgatgctgaagacccccgacctgaagggcctgagaaacgccatcagcgagaagtacggcttccccgaggagaacatctacaaggtgtacaagaagtgcaagagaggcgagaccagcctgctgcaccccagactgagcagacaccccccccccgactgcctggagtgcagccaccccgtgacccaggtgagaaacatgggcttcggcgacggcttctggagacagagagacctggacagcaaccccagccccaccaccgtgaacagcctgcacttcaccgtgaacagcgagtag

SEQ ID NO: 8212 - DNA, 1671 bp, Artificial Sequence
  Description of Artificial Sequence: Synthetic coding sequence
atgatgagagtgaacggcgacgacgacagcgtggccgccctgagcttcctgtacgactactacatgggccccaaggagaagagaatcctgagcagcagcaccggcggcagaaacgaccagggcaagagatactaccacggcatggagtacgagaccgacctgacccccctggagagccccacccacctgatgaagttcctgaccgagaacgtgagcggcacccccgagtaccccgacctgctgaagaagaacaacctgatgagcctggagggcgccctgcccacccccggcaaggccgcccccctgcccgccggccccagcaagctggaggccggcagcgtggacagctacctgctgcccaccaccgacatgtacgacaacggcagcctgaacagcctgttcgagagcatccacggcgtgccccccacccagagatggcagcccgacagcaccttcaaggacgacccccaggagagcatgctgttccccgacatcctgaagaccagccccgagcccccctgccccgaggactaccccagcctgaagagcgacttcgagtacaccctgggcagccccaaggccatccacatcaagagcggcgagagccccatggcctacctgaacaagggccagttctaccccgtgaccctgagaacccccgccggcggcaagggcctggccctgagcagcaacaaggtgaagagcgtggtgatggtggtgttcgacaacgagaaggtgcccgtggagcagctgagattctggaagcactggcacagcagacagcccaccgccaagcagagagtgatcgacgtggccgactgcaaggagaacttcaacaccgtggagcacatcgaggaggtggcctacaacgccctgagcttcgtgtggaacgtgaacgaggaggccaaggtgttcatcggcgtgaactgcctgagcaccgacttcagcagccagaagggcgtgaagggcgtgcccctgaacctgcagatcgacacctacgactgcggcctgggcaccgagagactggtgcacagagccgtgtgccagatcaagatcttctgcgacaagggcgccgagagaaagatgagagacgacgagagaaagcagttcagaagaaaggtgaagtgccccgacagcagcaacagcggcgtgaagggctgcctgctgagcggcttcagaggcaacgagaccacctacctgagacccgagaccgacctggagaccccccccgtgctgttcatccccaacgtgcacttcagcagcctgcagagaagcggcggcgccgcccccagcgccggccccagcagcagcaacagactgcccctgaagagaacctgcagccccttcaccgaggagttcgagcccctgcccagcaagcaggccaaggagggcgacctgcagagagtgctgctgtacgtgagaagagagaccgaggaggtgttcgacgccctgatgctgaagacccccgacctgaagggcctgagaaacgccatcagcgagaagtacggcttccccgaggagaacatctacaaggtgtacaagaagtgcaagagaggcatcctggtgaacatggacaacaacatcatccagcactacagcaaccacgtggccttcctgctggacatgggcgagctggacggcaagatccagatcatcctgaaggagctgtag

SEQ ID NO: 8213 - DNA, 1809 bp, Artificial Sequence
  Description of Artificial Sequence: Synthetic coding sequence
atgagcaacgagctggacttcagaagcgtgagactgctgaagaacgaccccgtgaacctgcagaagttcagctacaccagcgaggacgaggcctggaagacctacctggagaaccccctgaccgccgccaccaaggccatgatgagagtgaacggcgacgacgacagcgtggccgccctgagcttcctgtacgactactacatgggccccaaggagaagagaatcctgagcagcagcaccggcggcagaaacgaccagggcaagagatactaccacggcatggagtacgagaccgacctgacccccctggagagccccacccacctgatgaagttcctgaccgagaacgtgagcggcacccccgagtaccccgacctgctgaagaagaacaacctgatgagcctggagggcgccctgcccacccccggcaaggccgcccccctgcccgccggccccagcaagctggaggccggcagcgtggacagctacctgctgcccaccaccgacatgtacgacaacggcagcctgaacagcctgttcgagagcatccacggcgtgccccccacccagagatggcagcccgacagcaccttcaaggacgacccccaggagagcatgctgttccccgacatcctgaagaccagccccgagcccccctgccccgaggactaccccagcctgaagagcgacttcgagtacaccctgggcagccccaaggccatccacatcaagagcggcgagagccccatggcctacctgaacaagggccagttctaccccgtgaccctgagaacccccgccggcggcaagggcctggccctgagcagcaacaaggtgaagagcgtggtgatggtggtgttcgacaacgagaaggtgcccgtggagcagctgagattctggaagcactggcacagcagacagcccaccgccaagcagagagtgatcgacgtggccgactgcaaggagaacttcaacaccgtggagcacatcgaggaggtggcctacaacgccctgagcttcgtgtggaacgtgaacgaggaggccaaggtgttcatcggcgtgaactgcctgagcaccgacttcagcagccagaagggcgtgaagggcgtgcccctgaacctgcagatcgacacctacgactgcggcctgggcaccgagagactggtgcacagagccgtgtgccagatcaagatcttctgcgacaagggcgccgagagaaagatgagagacgacgagagaaagcagttcagaagaaaggtgaagtgccccgacagcagcaacagcggcgtgaagggctgcctgctgagcggcttcagaggcaacgagaccacctacctgagacccgagaccgacctggagaccccccccgtgctgttcatccccaacgtgcacttcagcagcctgcagagaagcggcggcgccgcccccagcgccggccccagcagcagcaacagactgcccctgaagagaacctgcagccccttcaccgaggagttcgagcccctgcccagcaagcaggccaaggagggcgacctgcagagagtgctgctgtacgtgagaagagagaccgaggaggtgttcgacgccctgatgctgaagacccccgacctgaagggcctgagaaacgccatcagcgagaagtacggcttccccgaggagaacatctacaaggtgtacaagaagtgcaagagaggcatcctggtgaacatggacaacaacatcatccagcactacagcaaccacgtggccttcctgctggacatgggcgagctggacggcaagatccagatcatcctgaaggagctgtag

SEQ ID NO: 8214 - DNA, 795 bp, Artificial Sequence
  Description of Artificial Sequence: Synthetic coding sequence
atgcccagaagcttcctggtggacagcctggtgctgagagaggccggcgagaagaaggcccccgagggcagccccccccccctgttcccctacgccgtgccccccccccacgccctgcacggcctgagccccggcgcctgccacgccagaaaggccggcctgctgtgcgtgtgccccctgtgcgtgaccgccagccagctgcacggcccccccggcccccccgccctgcccctgctgaaggccagcttcccccccttcggcagccagtactgccacgcccccctgggcagacagcacagcgccgtgagccccggcgtggcccacggccccgccgccgccgccgccgccgccgccctgtaccagaccagctaccccctgcccgaccccagacagttccactgcatcagcgtggacagcagcagcaaccagctgcccagcagcaagagaatgagaaccgccttcaccagcacccagctgctggagctggagagagagttcgccagcaacatgtacctgagcagactgagaagaatcgagatcgccacctacctgaacctgagcgagaagcaggtgaagatctggttccagaacagaagagtgaagcacaagaaggagggcaagggcagcaaccacagaggcggcggcggcggcggcgccggcggcggcggcagcgccccccagggctgcaagtgcgccagcctgagcagcgccaagtgcagcgaggacgacgacgagctgcccatgagccccagcagcagcggcaaggacgacagagacctgaccgtgaccccctag

SEQ ID NO: 8215 - DNA, 915 bp, Artificial Sequence
  Description of Artificial Sequence: Synthetic coding sequence
atgagcagaagcttctacgtggacagcctgatcatcaaggacaccagcagacccgcccccagcctgcccgagccccaccccggccccgacttcttcatccccctgggcatgcccccccccctggtgatgagcgtgagcggccccggctgccccagcagaaagagcggcgccttctgcgtgtgccccctgtgcgtgaccagccacctgcacagcagcagaggcagcgtgggcgccggcagcggcggcgccggcgccggcgtgaccggcgccggcggcagcggcgtggccggcgccgccggcgccctgcccctgctgaagggccagttcagcagcgcccccggcgacgcccagttctgccccagagtgaaccacgcccaccaccaccaccaccccccccagcaccaccaccaccaccaccagccccagcagcccggcagcgccgccgccgccgccgccgccgccgccgccgccgccgccgccgccgccctgggccacccccagcaccacgcccccgtgtgcaccgccaccacctacaacgtggccgaccccagaagattccactgcctgaccatgggcggcagcgacgccagccaggtgcccaacggcaagagaatgagaaccgccttcaccagcacccagctgctggagctggagagagagttcagcagcaacatgtacctgagcagactgagaagaatcgagatcgccacctacctgaacctgagcgagaagcaggtgaagatctggttccagaacagaagagtgaagcacaagaaggagggcaagggcacccagagaaacagccacgccggctgcaagtgcgtgggcagccaggtgcactacgccagaagcgaggacgaggacagcctgagccccgccagcgccaacgacgacaaggagatcagccccctgtag

SEQ ID NO: 8216 - DNA, 2850 bp, Artificial Sequence
  Description of Artificial Sequence: Synthetic coding sequence
atggcccaggtggccgtgagcaccctgcccgtggaggaggagagcagcagcgagaccagaatggtggtgaccttcctggtgagcgccctggagagcatgtgcaaggagctggccaagagcaaggccgaggtggcctgcatcgccgtgtacgagaccgacgtgttcgtggtgggcaccgagagaggctgcgccttcgtgaacgccagaaccgacttccagaaggacttcgccaagtactgcgtggccgagggcctgtgcgaggtgaagcccccctgccccgtgaacggcatgcaggtgcacagcggcgagaccgagatcctgagaaaggccgtggaggactacttctgcttctgctacggcaaggccctgggcaccaccgtgatggtgcccgtgccctacgagaagatgctgagagaccagagcgccgtggtggtgcagggcctgcccgagggcgtggccttccagcaccccgagaactacgacctggccaccctgaagtggatcctggagaacaaggccggcatcagcttcatcatcaacagacccttcctgggccccgagagccagctgggcggccccggcatggtgaccgacgccgagagaagcatcgtgagccccagcgagagctgcggccccatcaacgtgaagaccgagcccatggaggacagcggcatcagcctgaaggccgaggccgtgagcgtgaagaaggagagcgaggaccccaactactaccagtacaacatgcagggcagccaccccagcagcaccagcaacgaggtgatcgagatggagctgcccatggaggacagcacccccctggtgcccagcgaggagcccaacgaggaccccgaggccgaggtgaagatcgagggcaacaccaacagcagcagcgtgaccaacagcgccgccggcgtggaggacctgaacatcgtgcaggtgaccgtgcccgacaacgagaaggagagactgagcagcatcgagaagatcaagcagctgagagagcaggtgaacgacctgttcagcagaaagttcggcgaggccatcggcgtggacttccccgtgaaggtgccctacagaaagatcaccttcaaccccggctgcgtggtgatcgacggcatgccccccggcgtggtgttcaaggcccccggctacctggagatcagcagcatgagaagaatcctggaggccgccgagttcatcaagttcaccgtgatcagacccctgcccggcctggagctgagcaacgtgggcaagagaaagatcgaccaggagggcagagtgttccaggagaagtgggagagagcctacttcttcgtggaggtgcagaacatccccacctgcctgatctgcaagcagagcatgagcgtgagcaaggagtacaacctgagaagacactaccagaccaaccacagcaagcactacgaccagtacatggagagaatgagagacgagaagctgcacgagctgaagaagggcctgagaaagtacctgctgggcctgagcgacaccgagtgccccgagcagaagcaggtgttcgcccaccccagccccacccagaagagccccgtgcagcccgtggaggacctggccggcaacctgtgggagaagctgagagagaagatcagaagcttcgtggcctacagcatcgccatcgacgagatcaccgacatcaacaacaccacccagctggccatcttcatcagaggcgtggacgagaacttcgacgtgagcgaggagctgctggacaccgtgcccatgaccggcaccaagagcggcaacgagatcttcagcagagtggagaagagcctgaagaagttctgcatcgactggagcaagctggtgagcgtggccagcaccggcacccccgccatggtggacgccaacaacggcctggtgaccaagctgaagagcagagtggccaccttctgcaagggcgccgagctgaagagcatctgctgcatcatccaccccgagagcctgtgcgcccagaagctgaagatggaccacgtgatggacgtggtggtgaagagcgtgaactggatctgcagcagaggcctgaaccacagcgagttcaccaccctgctgtacgagctggacagccagtacggcagcctgctgtactacaccgagatcaagtggctgagcagaggcctggtgctgaagagattcttcgagagcctggaggagatcgacagcttcatgagcagcagaggcaagcccctgccccagctgagcagcatcgactggatcagagacctggccttcctggtggacatgaccatgcacctgaacgccctgaacatcagcctgcagggccacagccagatcgtgacccagatgtacgacctgatcagagccttcctggccaagctgtgcctgtgggagacccacctgaccagaaacaacctggcccacttccccaccctgaagctggccagcagaaacgagagcgacggcctgaactacatccccaagatcgccgagctgaagaccgagttccagaagagactgagcgacttcaagctgtacgagagcgagctgaccctgttcagcagccccttcagcaccaagatcgacagcgtgcacgaggagctgcagatggaggtgatcgacctgcagtgcaacaccgtgctgaagaccaagtacgacaaggtgggcatccccgagttctacaagtacctgtggggcagctaccccaagtacaagcaccactgcgccaagatcctgagcatgttcggcagcacctacatctgcgagcagctgttcagcatcatgaagctgagcaagaccaagtactgcagccagctgaaggacagccagtgggacagcgtgctgcacatcgccacctag

SEQ ID NO: 8217 - DNA, 1491 bp, Artificial Sequence
  Description of Artificial Sequence: Synthetic coding sequence
atgagcgtgagcaaggagtacaacctgagaagacactaccagaccaaccacagcaagcactacgaccagtacatggagagaatgagagacgagaagctgcacgagctgaagaagggcctgagaaagtacctgctgggcctgagcgacaccgagtgccccgagcagaagcaggtgttcgcccaccccagccccacccagaagagccccgtgcagcccgtggaggacctggccggcaacctgtgggagaagctgagagagaagatcagaagcttcgtggcctacagcatcgccatcgacgagatcaccgacatcaacaacaccacccagctggccatcttcatcagaggcgtggacgagaacttcgacgtgagcgaggagctgctggacaccgtgcccatgaccggcaccaagagcggcaacgagatcttcagcagagtggagaagagcctgaagaagttctgcatcgactggagcaagctggtgagcgtggccagcaccggcacccccgccatggtggacgccaacaacggcctggtgaccaagctgaagagcagagtggccaccttctgcaagggcgccgagctgaagagcatctgctgcatcatccaccccgagagcctgtgcgcccagaagctgaagatggaccacgtgatggacgtggtggtgaagagcgtgaactggatctgcagcagaggcctgaaccacagcgagttcaccaccctgctgtacgagctggacagccagtacggcagcctgctgtactacaccgagatcaagtggctgagcagaggcctggtgctgaagagattcttcgagagcctggaggagatcgacagcttcatgagcagcagaggcaagcccctgccccagctgagcagcatcgactggatcagagacctggccttcctggtggacatgaccatgcacctgaacgccctgaacatcagcctgcagggccacagccagatcgtgacccagatgtacgacctgatcagagccttcctggccaagctgtgcctgtgggagacccacctgaccagaaacaacctggcccacttccccaccctgaagctggccagcagaaacgagagcgacggcctgaactacatccccaagatcgccgagctgaagaccgagttccagaagagactgagcgacttcaagctgtacgagagcgagctgaccctgttcagcagccccttcagcaccaagatcgacagcgtgcacgaggagctgcagatggaggtgatcgacctgcagtgcaacaccgtgctgaagaccaagtacgacaaggtgggcatccccgagttctacaagtacctgtggggcagctaccccaagtacaagcaccactgcgccaagatcctgagcatgttcggcagcacctacatctgcgagcagctgttcagcatcatgaagctgagcaagaccaagtactgcagccagctgaaggacagccagtgggacagcgtgctgcacatcgccacctag

SEQ ID NO: 8218 - DNA, 681 bp, Artificial Sequence
  Description of Artificial Sequence: Synthetic coding sequence
atggcccaggtggccgtgagcaccctgcccgtggaggaggagagcagcagcgagaccagaatggtggtgaccttcctggtgagcgccctggagagcatgtgcaaggagctggccaagagcaaggccgaggtggcctgcatcgccgtgtacgagaccgacgtgttcgtggtgggcaccgagagaggctgcgccttcgtgaacgccagaaccgacttccagaaggacttcgccaagtactgcgtggccgagggcctgtgcgaggtgaagcccccctgccccgtgaacggcatgcaggtgcacagcggcgagaccgagatcctgagaaaggccgtggaggactacttctgcttctgctacggcaaggccctgggcaccaccgtgatggtgcccgtgccctacgagaagatgctgagagaccagagcgccgtggtggtgcagggcctgcccgagggcgtggccttccagcaccccgagaactacgacctggccaccctgaagtggatcctggagaacaaggccggcatcagcttcatcatcaacagacccttcctgggccccgagagccagctgggcggccccggcatggtgaccgacgccgagagaagcatcgtgagccccagcgagagacacttcaccgagagcagaagctgcctgagccaggagagaatcagaagaagctag

SEQ ID NO: 8219 - DNA, 2850 bp, Artificial Sequence
  Description of Artificial Sequence: Synthetic coding sequence
atggcccaggtggccgtgagcaccctgcccgtggaggaggagagcagcagcgagaccagaatggtggtgaccttcctggtgagcgccctggagagcatgtgcaaggagctggccaagagcaaggccgaggtggcctgcatcgccgtgtacgagaccgacgtgttcgtggtgggcaccgagagaggctgcgccttcgtgaacgccagaaccgacttccagaaggacttcgccaagtactgcgtggccgagggcctgtgcgaggtgaagcccccctgccccgtgaacggcatgcaggtgcacagcggcgagaccgagatcctgagaaaggccgtggaggactacttctgcttctgctacggcaaggccctgggcaccaccgtgatggtgcccgtgccctacgagaagatgctgagagaccagagcgccgtggtggtgcagggcctgcccgagggcgtggccttccagcaccccgagaactacgacctggccaccctgaagtggatcctggagaacaaggccggcatcagcttcatcatcaacagacccttcctgggccccgagagccagctgggcggccccggcatggtgaccgacgccgagagaagcatcgtgagccccagcgagagctgcggccccatcaacgtgaagaccgagcccatggaggacagcggcatcagcctgaaggccgaggccgtgagcgtgaagaaggagagcgaggaccccaactactaccagtacaacatgcagggcagccaccccagcagcaccagcaacgaggtgatcgagatggagctgcccatggaggacagcacccccctggtgcccagcgaggagcccaacgaggaccccgaggccgaggtgaagatcgagggcaacaccaacagcagcagcgtgaccaacagcgccgccggcgtggaggacctgaacatcgtgcaggtgaccgtgcccgacaacgagaaggagagactgagcagcatcgagaagatcaagcagctgagagagcaggtgaacgacctgttcagcagaaagttcggcgaggccatcggcgtggacttccccgtgaaggtgccctacagaaagatcaccttcaaccccggctgcgtggtgatcgacggcatgccccccggcgtggtgttcaaggcccccggctacctggagatcagcagcatgagaagaatcctggaggccgccgagttcatcaagttcaccgtgatcagacccctgcccggcctggagctgagcaacgtgggcaagagaaagatcgaccaggagggcagagtgttccaggagaagtgggagagagcctacttcttcgtggaggtgcagaacatccccacctgcctgatctgcaagcagagcatgagcgtgagcaaggagtacaacctgagaagacactaccagaccaaccacagcaagcactacgaccagtacaccgagagaatgagagacgagaagctgcacgagctgaagaagggcctgagaaagtacctgctgggcagcagcgacaccgagtgccccgagcagaagcaggtgttcgccaaccccagccccacccagaagagccccgtgcagcccgtggaggacctggccggcaacctgtgggagaagctgagagagaagatcagaagcttcgtggcctacagcatcgccatcgacgagatcaccgacatcaacaacaccacccagctggccatcttcatcagaggcgtggacgagaacttcgacgtgagcgaggagctgctggacaccgtgcccatgaccggcaccaagagcggcaacgagatcttcctgagagtggagaagagcctgaagaagttctgcatcaactggagcagactggtgagcgtggccagcaccggcacccccgccatggtggacgccaacaacggcctggtgaccaagctgaagagcagagtggccaccttctgcaagggcgccgagctgaagagcatctgctgcatcatccaccccgagagcctgtgcgcccagaagctgaagatggaccacgtgatggacgtggtggtgaagagcgtgaactggatctgcagcagaggcctgaaccacagcgagttcaccaccctgctgtacgagctggacagccagtacggcagcctgctgtactacaccgagatcaagtggctgagcagaggcctggtgctgaagagattcttcgagagcctggaggagatcgacagcttcatgagcagcagaggcaagcccctgccccagctgagcagcatcgactggatcagagacctggccttcctggtggacatgaccatgcacctgaacgccctgaacatcagcctgcagggccacagccagatcgtgacccagatgtacgacctgatcagagccttcctggccaagctgtgcctgtgggagacccacctgaccagaaacaacctggcccacttccccaccctgaagctggtgagcagaaacgagagcgacggcctgaactacatccccaagatcgccgagctgaagaccgagttccagaagagactgagcgacttcaagctgtacgagagcgagctgaccctgttcagcagccccttcagcaccaagatcgacagcgtgcacgaggagctgcagatggaggtgatcgacctgcagtgcaacaccgtgctgaagaccaagtacgacaaggtgggcatccccgagttctacaagtacctgtggggcagctaccccaagtacaagcaccactgcgccaagatcctgagcatgttcggcagcacctacatctgcgagcagctgttcagcatcatgaagctgagcaagaccaagtactgcagccagctgaaggacagccagtgggacagcgtgctgcacatcgccacctag

SEQ ID NO: 8220 - DNA, 1095 bp, Artificial Sequence
  Description of Artificial Sequence: Synthetic coding sequence
atgaccggcaccaagagcggcaacgagatcttcctgagagtggagaagagcctgaagaagttctgcatcaactggagcagactggtgagcgtggccagcaccggcacccccgccatggtggacgccaacaacggcctggtgaccaagctgaagagcagagtggccaccttctgcaagggcgccgagctgaagagcatctgctgcatcatccaccccgagagcctgtgcgcccagaagctgaagatggaccacgtgatggacgtggtggtgaagagcgtgaactggatctgcagcagaggcctgaaccacagcgagttcaccaccctgctgtacgagctggacagccagtacggcagcctgctgtactacaccgagatcaagtggctgagcagaggcctggtgctgaagagattcttcgagagcctggaggagatcgacagcttcatgagcagcagaggcaagcccctgccccagctgagcagcatcgactggatcagagacctggccttcctggtggacatgaccatgcacctgaacgccctgaacatcagcctgcagggccacagccagatcgtgacccagatgtacgacctgatcagagccttcctggccaagctgtgcctgtgggagacccacctgaccagaaacaacctggcccacttccccaccctgaagctggtgagcagaaacgagagcgacggcctgaactacatccccaagatcgccgagctgaagaccgagttccagaagagactgagcgacttcaagctgtacgagagcgagctgaccctgttcagcagccccttcagcaccaagatcgacagcgtgcacgaggagctgcagatggaggtgatcgacctgcagtgcaacaccgtgctgaagaccaagtacgacaaggtgggcatccccgagttctacaagtacctgtggggcagctaccccaagtacaagcaccactgcgccaagatcctgagcatgttcggcagcacctacatctgcgagcagctgttcagcatcatgaagctgagcaagaccaagtactgcagccagctgaaggacagccagtgggacagcgtgctgcacatcgccacctag

SEQ ID NO: 8221 - DNA, 1491 bp, Artificial Sequence
  Description of Artificial Sequence: Synthetic coding sequence
atgagcgtgagcaaggagtacaacctgagaagacactaccagaccaaccacagcaagcactacgaccagtacaccgagagaatgagagacgagaagctgcacgagctgaagaagggcctgagaaagtacctgctgggcagcagcgacaccgagtgccccgagcagaagcaggtgttcgccaaccccagccccacccagaagagccccgtgcagcccgtggaggacctggccggcaacctgtgggagaagctgagagagaagatcagaagcttcgtggcctacagcatcgccatcgacgagatcaccgacatcaacaacaccacccagctggccatcttcatcagaggcgtggacgagaacttcgacgtgagcgaggagctgctggacaccgtgcccatgaccggcaccaagagcggcaacgagatcttcctgagagtggagaagagcctgaagaagttctgcatcaactggagcagactggtgagcgtggccagcaccggcacccccgccatggtggacgccaacaacggcctggtgaccaagctgaagagcagagtggccaccttctgcaagggcgccgagctgaagagcatctgctgcatcatccaccccgagagcctgtgcgcccagaagctgaagatggaccacgtgatggacgtggtggtgaagagcgtgaactggatctgcagcagaggcctgaaccacagcgagttcaccaccctgctgtacgagctggacagccagtacggcagcctgctgtactacaccgagatcaagtggctgagcagaggcctggtgctgaagagattcttcgagagcctggaggagatcgacagcttcatgagcagcagaggcaagcccctgccccagctgagcagcatcgactggatcagagacctggccttcctggtggacatgaccatgcacctgaacgccctgaacatcagcctgcagggccacagccagatcgtgacccagatgtacgacctgatcagagccttcctggccaagctgtgcctgtgggagacccacctgaccagaaacaacctggcccacttccccaccctgaagctggtgagcagaaacgagagcgacggcctgaactacatccccaagatcgccgagctgaagaccgagttccagaagagactgagcgacttcaagctgtacgagagcgagctgaccctgttcagcagccccttcagcaccaagatcgacagcgtgcacgaggagctgcagatggaggtgatcgacctgcagtgcaacaccgtgctgaagaccaagtacgacaaggtgggcatccccgagttctacaagtacctgtggggcagctaccccaagtacaagcaccactgcgccaagatcctgagcatgttcggcagcacctacatctgcgagcagctgttcagcatcatgaagctgagcaagaccaagtactgcagccagctgaaggacagccagtgggacagcgtgctgcacatcgccacctag

SEQ ID NO: 8222 - DNA, 681 bp, Artificial Sequence; identical to SEQ ID NO: 8218
  Description of Artificial Sequence: Synthetic coding sequence

SEQ ID NO: 8223 - DNA, 768 bp, Artificial Sequence
  Description of Artificial Sequence: Synthetic coding sequence
atggagcaggccctgaccggcgaggcccagagcagatggcccagaagaggcggcagcggcgccatggccgaggcccccggccccagcggcgagagcagaggccacagcgccacccagctgcccgccgagaagaccgtgggcggccccagcagaggctgcagcagcagcgtgctgagagtgagccagctggtgctgcaggccatcagcacccacaagggcctgaccctggccgccctgaagaaggagctgagaaacgccggctacgaggtgagaagaaagagcggcagacacgaggcccccagaggccaggccaaggccaccctgctgagagtgagcggcagcgacgccgccggctacttcagagtgtggaaggtgcccaagcccagaagaaagcccggcagagccagacaggaggagggcaccagagccccctggagaacccccgccgcccccagaagcagcagaagaagaagacagcccctgagaaaggccgccagaaaggccagagaggtgtggagaagaaacgccagagccaaggccaaggccaacgccagagccagaagaaccagaagagccagacccagagccaaggagcccccctgcgccagagccaaggaggaggccggcgccaccgccgccgacgagggcagaggccaggccgtgaaggaggacaccacccccagaagcggcaaggacaagagaagaagcagcaagcccagagaggagaagcaggagcccaagaagcccgcccagagaaccatccagtag

SEQ ID NO: 8224 - DNA, 642 bp, Artificial Sequence
  Description of Artificial Sequence: Synthetic coding sequence
atgagcgtggagctggaggaggccctgcccgtgaccaccgccgagggcatggccaagaaggtgaccaaggccggcggcagcgccgccctgagccccagcaagaagagaaagaacagcaagaagaagaaccagcccggcaagtacagccagctggtggtggagaccatcagaagactgggcgagagaaacggcagcagcctggccaagatctacaccgaggccaagaaggtgccctggttcgaccagcagaacggcagaacctacctgaagtacagcatcaaggccctggtgcagaacgacaccctgctgcaggtgaagggcaccggcgccaacggcagcttcaagctgaacagaaagaagctggagggcggcggcgagagaagaggcgcccccgccgccgccaccgcccccgcccccaccgcccacaaggccaagaaggccgcccccggcgccgccggcagcagaagagccgacaagaagcccgccagaggccagaagcccgagcagagaagccacaagaagggcgccggcgccaagaaggacaagggcggcaaggccaagaagaccgccgccgccggcggcaagaaggtgaagaaggccgccaagcccagcgtgcccaaggtgcccaagggcagaaagtag

SEQ ID NO: 8225 - DNA, 1467 bp, Artificial Sequence
  Description of Artificial Sequence: Synthetic coding sequence
atgttcgccgccggcctggcccccttctacgccagcaacttcagcctgtggagcgccgcctactgcagcagcgccggccccggcggctgcagcttccccctggaccccgccgccgtgaagaagcccagcttctgcatcgccgacatcctgcacgccggcgtgggcgacctgggcgccgcccccgagggcctggccggcgccagcgccgccgccctgaccgcccacctgggcagcgtgcacccccacgccagcttccaggccgccgccagaagccccctgagacccacccccgtggtggcccccagcgaggtgcccgccggcttcccccagagactgagccccctgagcgccgcctaccaccaccaccacccccagcagcagcagcagcagcagcagccccagcagcagcagcccccccccccccccagagccggcgccctgcagccccccgccagcggcaccagagtggtgcccaacccccaccacagcggcagcgcccccgcccccagcagcaaggacctgaagttcggcatcgacagaatcctgagcgccgagttcgaccccaaggtgaaggagggcaacaccctgagagacctgaccagcctgctgaccggcggcagacccgccggcgtgcacctgagcggcctgcagcccagcgccggccagttcttcgccagcctggaccccatcaacgaggccagcgccatcctgagccccctgaacagcaaccccagaaacagcgtgcagcaccagttccaggacaccttccccggcccctacgccgtgctgaccaaggacaccatgccccagacctacaagagaaagagaagctggagcagagccgtgttcagcaacctgcagagaaagggcctggagaagagattcgagatccagaagtacgtgaccaagcccgacagaaagcagctggccgccatgctgggcctgaccgacgcccaggtgaaggtgtggttccagaacagaagaatgaagtggagacacagcaaggaggcccaggcccagaaggacaaggacaaggaggccggcgagaagcccagcggcggcgcccccgccgccgacggcgagcaggacgagagaagccccagcagaagcgagggcgaggccgagagcgagagcagcgacagcgagagcctggacatggcccccagcgacaccgagagaaccgagggcagcgagagaagcctgcaccagaccaccgtgatcaaggcccccgtgaccggcgccctgatcaccgccagcagcgccggcagcggcggcagcagcggcggcggcggcaacagcttcagcttcagcagcgccagcagcctgagcagcagcagcaccagcgccggctgcgccagcagcctgggcggcggcggcgccagcgagctgctgcccgccacccagcccaccgccagcagcgcccccaagagccccgagcccgcccagggcgccctgggctgcctgtag

SEQ ID NO: 8226 - DNA, 1116 bp, Artificial Sequence
  Description of Artificial Sequence: Synthetic coding sequence
atgagcagcagaggcggcaagaagaagagcaccaagaccagcagaagcgccaaggccggcgtgatcttccccgtgggcagaatgctgagatacatcaagaagggccaccccaagtacagaatcggcgtgggcgcccccgtgtacatggccgccgtgctggagtacctgaccgccgagatcctggagctggccggcaacgccgccagagacaacaagaagggcagagtgacccccagacacatcctgctggccgtggccaacgacgaggagctgaaccagctgctgaagggcgtgaccatcgccagcggcggcgtgctgcccaacatccaccccgagctgctggccaagaagagaggcagcaagggcaagctggaggccatcatcacccccccccccgccaagaaggccaagagccccagccagaagaagcccgtgagcaagaaggccggcggcaagaagggcgccagaaagagcaagaagcagggcgaggtgagcaaggccgccagcgccgacagcaccaccgagggcacccccgccgacggcttcaccgtgctgagcaccaagagcctgttcctgggccagaagctgaacctgatccacagcgagatcagcaacctggccggcttcgaggtggaggccatcatcaaccccaccaacgccgacatcgacctgaaggacgacctgggcaacaccctggagaagaagggcggcaaggagttcgtggaggccgtgctggagctgagaaagaagaacggccccctggaggtggccggcgccgccgtgagcgccggccacggcctgcccgccaagttcgtgatccactgcaacagccccgtgtggggcgccgacaagtgcgaggagctgctggagaagaccgtgaagaactgcctggccctggccgacgacaagaagctgaagagcatcgccttccccagcatcggcagcggcagaaacggcttccccaagcagaccgccgcccagctgatcctgaaggccatcagcagctacttcgtgagcaccatgagcagcagcatcaagaccgtgtacttcgtgctgttcgacagcgagagcatcggcatctacgtgcaggagatggccaagctggacgccaactag

SEQ ID NO: 8227 - DNA, 348 bp, Artificial Sequence
  Description of Artificial Sequence: Synthetic coding sequence
atgcccagaagaagaagaagaagaggcagcagcggcgccggcggcagaggcagaacctgcagcagaaccgtgagagccgagctgagcttcagcgtgagccaggtggagagaagcctgagagagggccactacgcccagagactgagcagaaccgcccccgtgtacctggccgccgtgatcgagtacctgaccgccaaggtgcccgagctggccggcaacgaggcccagaacagcggcgagagaaacatcacccccctgctgctggacatggtggtgcacaacgacagactgctgagcaccctgttcaacaccaccaccatcagccaggtggcccccggcgaggactag

SEQ ID NO: 8228 - DNA, 348 bp, Artificial Sequence
  Description of Artificial Sequence: Synthetic coding sequence
atgcccagaagaagaagaagaagaggcagcagcggcgccggcggcagaggcagaacctgcagcagaaccgtgagagccgagctgagcttcagcgtgagccaggtggagagaagcctgagagagggccactacgcccagagactgagcagaaccgcccccgtgtacctggccgccgtgatcgagtacctgaccgccaaggtgctggagctggccggcaacgaggcccagaacagcggcgagagaaacatcacccccctgctgctggacatggtggtgcacaacgacagactgctgagcaccctgttcaacaccaccaccatcagccaggtggcccccggcgaggactag

SEQ ID NO: 8229 - DNA, 348 bp, Artificial Sequence; identical to SEQ ID NO: 8228
  Description of Artificial Sequence: Synthetic coding sequence

SEQ ID NO: 8230 - DNA, 3264 bp, Artificial Sequence
  Description of Artificial Sequence: Synthetic coding sequence
atggacctgtacagcacccccgccgccgccctggacagattcgtggccagaagactgcagcccagaaaggagttcgtggagaaggccagaagagccctgggcgccctggccgccgccctgagagagagaggcggcagactgggcgccgccgcccccagagtgctgaagaccgtgaagggcggcagcagcggcagaggcaccgccctgaagggcggctgcgacagcgagctggtgatcttcctggactgcttcaagagctacgtggaccagagagccagaagagccgagatcctgagcgagatgagagccagcctggagagctggtggcagaaccccgtgcccggcctgagactgaccttccccgagcagagcgtgcccggcgccctgcagttcagactgaccagcgtggacctggaggactggatggacgtgagcctggtgcccgccttcaacgtgctgggccaggccggcagcggcgtgaagcccaagccccaggtgtacagcaccctgctgaacagcggctgccagggcggcgagcacgccgcctgcttcaccgagctgagaagaaacttcgtgaacatcagacccgccaagctgaagaacctgatcctgctggtgaagcactggtaccaccaggtgtgcctgcagggcctgtggaaggagaccctgccccccgtgtacgccctggagctgctgaccatcttcgcctgggagcagggctgcaagaaggacgccttcagcctggccgagggcctgagaaccgtgctgggcctgatccagcagcaccagcacctgtgcgtgttctggaccgtgaactacggcttcgaggaccccgccgtgggccagttcctgcagagacagctgaagagacccagacccgtgatcctggaccccgccgaccccacctgggacctgggcaacggcgccgcctggcactgggacctgctggcccaggaggccgccagctgctacgaccacccctgcttcctgagaggcatgggcgaccccgtgcagagctggaagggccccggcctgcccagagccggctgcagcggcctgggccaccccatccagctggaccccaaccagaagacccccgagaacagcaagagcctgaacgccgtgtaccccagagccggcagcaagccccccagctgccccgcccccggccccaccggcgccgccagcatcgtgcccagcgtgcccggcatggccctggacctgagccagatccccaccaaggagctggacagattcatccaggaccacctgaagcccagcccccagttccaggagcaggtgaagaaggccatcgacatcatcctgagatgcctgcacgagaactgcgtgcacaaggccagcagagtgagcaagggcggcagcttcggcagaggcaccgacctgagagacggctgcgacgtggagctgatcatcttcctgaactgcttcaccgactacaaggaccagggccccagaagagccgagatcctggacgagatgagagcccagctggagagctggtggcaggaccaggtgcccagcctgagcctgcagttccccgagcagaacgtgcccgaggccctgcagttccagctggtgagcaccgccctgaagagctggaccgacgtgagcctgctgcccgccttcgacgccgtgggccagctgagcagcggcaccaagcccaacccccaggtgtacagcagactgctgaccagcggctgccaggagggcgagcacaaggcctgcttcgccgagctgagaagaaacttcatgaacatcagacccgtgaagctgaagaacctgatcctgctggtgaagcactggtacagacaggtggccgcccagaacaagggcaagggccccgcccccgccagcctgccccccgcctacgccctggagctgctgaccatcttcgcctgggagcagggctgcagacaggactgcttcaacatggcccagggcttcagaaccgtgctgggcctggtgcagcagcaccagcagctgtgcgtgtactggaccgtgaactacagcaccgaggaccccgccatgagaatgcacctgctgggccagctgagaaagcccagacccctggtgctggaccccgccgaccccacctggaacgtgggccacggcagctgggagctgctggcccaggaggccgccgccctgggcatgcaggcctgcttcctgagcagagacggcaccagcgtgcagccctgggacgtgatgcccgccctgctgtaccagacccccgccggcgacctggacaagttcatcagcgagttcctgcagcccaacagacagttcctggcccaggtgaacaaggccgtggacaccatctgcagcttcctgaaggagaactgcttcagaaacagccccatcaaggtgatcaaggtggtgaagggcggcagcagcgccaagggcaccgccctgagaggcagaagcgacgccgacctggtggtgttcctgagctgcttcagccagttcaccgagcagggcaacaagagagccgagatcatcagcgagatcagagcccagctggaggcctgccagcaggagagacagttcgaggtgaagttcgaggtgagcaagtgggagaaccccagagtgctgagcttcagcctgaccagccagaccatgctggaccagagcgtggacttcgacgtgctgcccgccttcgacgccctgggccagctggtgagcggcagcagacccagcagccaggtgtacgtggacctgatccacagctacagcaacgccggcgagtacagcacctgcttcaccgagctgcagagagacttcatcatcagcagacccaccaagctgaagagcctgatcagactggtgaagcactggtaccagcagtgcaccaagatcagcaagggcagaggcagcctgcccccccagcacggcctggagctgctgaccgtgtacgcctgggagcagggcggcaaggacagccagttcaacatggccgagggcttcagaaccgtgctggagctggtgacccagtacagacagctgtgcatctactggaccatcaactacaacgccaaggacaagaccgtgggcgacttcctgaagcagcagctgcagaagcccagacccatcatcctggaccccgccgaccccaccggcaacctgggccacaacgccagatgggacctgctggccaaggaggccgccgcctgcaccagcgccctgtgctgcatgggcagaaacggcatccccatccagccctggcccgtgaaggccgccgtgtag

SEQ ID NO: 8231 - DNA, 390 bp, Artificial Sequence
  Description of Artificial Sequence: Synthetic coding sequence
atgagcggcagaggcaagcagggcggcaaggtgagagccaaggccaagagcagaagcagcagagccggcctgcagttccccgtgggcagagtgcacagactgctgagaaagggcaactacgccgagagagtgggcgccggcgcccccgtgtacctggccgccgtgctggagtacctgaccgccgagatcctggagctggccggcaacgccgccagagacaacaagaagaccagaatcatccccagacacctgcagctggccatcagaaacgacgaggagctgaacaagctgctgggcaaggtgaccatcgcccagggcggcgtgctgcccaacatccaggccgtgctgctgcccaagaagaccgagagccagaagaccaagagcaagtag

SEQ ID NO: 8232 - DNA, 390 bp, Artificial Sequence; identical to SEQ ID NO: 8231
  Description of Artificial Sequence: Synthetic coding sequence

SEQ ID NO: 8233 - DNA, 591 bp, Artificial Sequence
  Description of Artificial Sequence: Synthetic coding sequence
atggagatcatcagcagcaagctgttcatcctgctgaccctggccaccagcagcctgctgaccagcaacatcttctgcgccgacgagctggtgatcagcaacctgcacagcaaggagaactacgacaagtacagcgagcccagaggctaccccaagggcgagagaagcctgaacttcgaggagctgaaggactggggccccaagaacgtgatcaagatgagcacccccgccgtgaacaagatgccccacagcttcgccaacctgcccctgagattcggcagaaacgtgcaggaggagagaagcgccggcgccaccgccaacctgcccctgagaagcggcagaaacatggaggtgagcctggtgagaagagtgcccaacctgccccagagattcggcagaaccaccaccgccaagagcgtgtgcagaatgctgagcgacctgtgccagggcagcatgcacagcccctgcgccaacgacctgttctacagcatgacctgccagcaccaggagatccagaaccccgaccagaagcagagcagaagactgctgttcaagaagatcgacgacgccgagctgaagcaggagaagtag

SEQ ID NO: 8234 - DNA, 387 bp, Artificial Sequence
  Description of Artificial Sequence: Synthetic coding sequence
atggccggcggcaaggccggcaaggacagcggcaaggccaaggccaaggccgtgagcagaagccagagagccggcctgcagttccccgtgggcagaatccacagacacctgaagaccagaaccaccagccacggcagagtgggcgccaccgccgccgtgtacagcgccgccatcctggagtacctgaccgccgaggtgctggagctggccggcaacgccagcaaggacctgaaggtgaagagaatcacccccagacacctgcagctggccatcagaggcgacgaggagctggacagcctgatcaaggccaccatcgccggcggcggcgtgatcccccacatccacaagagcctgatcggcaagaagggccagcagaagaccgcctag

SEQ ID NO: 8235 - DNA, 273 bp, Artificial Sequence
  Description of Artificial Sequence: Synthetic coding sequence
atggccggcggcaaggccggcaaggacagcggcaaggccaaggccaaggccgtgagcagaagccagagagccggcctgcaggtgctggagctggccggcaacgccagcaaggacctgaaggtgaagagaatcacccccagacacctgcagctggccatcagaggcgacgaggagctggacagcctgatcaaggccaccatcgccggcggcggcgtgatcccccacatccacaagagcctgatcggcaagaagggccagcagaagaccgcctag

SEQ ID NO: 8236 - DNA, 309 bp, Artificial Sequence
  Description of Artificial Sequence: Synthetic coding sequence
atgttccccgtgggcagaatccacagacacctgaagaccagaaccaccagccacggcagagtgggcgccaccgccgccgtgtacagcgccgccatcctggagtacctgaccgccgaggtgctggagctggccggcaacgccagcaaggacctgaaggtgaagagaatcacccccagacacctgcagctggccatcagaggcgacgaggagctggacagcctgatcaaggccaccatcgccggcggcggcgtgatcccccacatccacaagagcctgatcggcaagaagggccagcagaagaccgcctag

SEQ ID NO: 8237 - DNA, 201 bp, Artificial Sequence
  Description of Artificial Sequence: Synthetic coding sequence
atggccggcggcaaggccggcaaggacagcggcaaggccaaggccaaggccgtgagcagaagccagagagccggcctgcagttccccgtgggcagaatccacagacacctgaagaccagaaccaccagccacggcagagtgggcgccaccgccgccgtgtacagcgccgccatcctggagtacctgaccgccgaggtgtag

SEQ ID NO: 8238 - DNA, 1110 bp, Artificial Sequence
  Description of Artificial Sequence: Synthetic coding sequence
atgagcagcagaggcggcaagaagaagagcaccaagaccagcagaagcgccaaggccggcgtgatcttccccgtgggcagaatgctgagatacatcaagaagggccaccccaagtacagaatcggcgtgggcgcccccgtgtacatggccgccgtgctggagtacctgaccgccgagatcctggagctggccggcaacgccgccagagacaacaagaagggcagagtgacccccagacacatcctgctggccgtggccaacgacgaggagctgaaccagctgctgaagggcgtgaccatcgccagcggcggcgtgctgcccaacatccaccccgagctgctggccaagaagagaggcagcaagggcaagctggaggccatcatcacccccccccccgccaagaaggccaagagccccagccagaagaagcccgtgagcaagaaggccggcggcaagaagggcgccagaaagagcaagaagaagcagggcgaggtgagcaaggccgccagcgccgacagcaccaccgagggcacccccgccgacggcttcaccgtgctgagcaccaagagcctgttcctgggccagaagctgcaggtggtgcaggccgacatcgccagcatcgacagcgacgccgtggtgcaccccaccaacaccgacttctacatcggcggcgaggtgggcaacaccctggagaagaagggcggcaaggagttcgtggaggccgtgctggagctgagaaagaagaacggccccctggaggtggccggcgccgccgtgagcgccggccacggcctgcccgccaagttcgtgatccactgcaacagccccgtgtggggcgccgacaagtgcgaggagctgctggagaagaccgtgaagaactgcctggccctggccgacgacaagaagctgaagagcatcgccttccccagcatcggcagcggcagaaacggcttccccaagcagaccgccgcccagctgatcctgaaggccatcagcagctacttcgtgagcaccatgagcagcagcatcaagaccgtgtacttcgtgctgttcgacagcgagagcatcggcatctacgtgcaggagatggccaagctggacgccaactag

SEQ ID NO: 8239 - DNA, 603 bp, Artificial Sequence
  Description of Artificial Sequence: Synthetic coding sequence
atgagcagcagaggcggcaagaagaagagcaccaagaccagcagaagcgccaaggccggcgtgatcttccccgtgggcagaatgctgagatacatcaagaagggccaccccaagtacagaatcggcgtgggcgcccccgtgtacatggccgccgtgctggagtacctgaccggcaacaccctggagaagaagggcggcaaggagttcgtggaggccgtgctggagctgagaaagaagaacggccccctggaggtggccggcgccgccgtgagcgccggccacggcctgcccgccaagttcgtgatccactgcaacagccccgtgtggggcgccgacaagtgcgaggagctgctggagaagaccgtgaagaactgcctggccctggccgacgacaagaagctgaagagcatcgccttccccagcatcggcagcggcagaaacggcttccccaagcagaccgccgcccagctgatcctgaaggccatcagcagctacttcgtgagcaccatgagcagcagcatcaagaccgtgtacttcgtgctgttcgacagcgagagcatcggcatctacgtgcaggagatggccaagctggacgccaactag

SEQ ID NO: 8240 - DNA, 1119 bp, Artificial Sequence
  Description of Artificial Sequence: Synthetic coding sequence
atgagcagcagaggcggcaagaagaagagcaccaagaccagcagaagcgccaaggccggcgtgatcttccccgtgggcagaatgctgagatacatcaagaagggccaccccaagtacagaatcggcgtgggcgcccccgtgtacatggccgccgtgctggagtacctgaccgccgagatcctggagctggccggcaacgccgccagagacaacaagaagggcagagtgacccccagacacatcctgctggccgtggccaacgacgaggagctgaaccagctgctgaagggcgtgaccatcgccagcggcggcgtgctgcccaacatccaccccgagctgctggccaagaagagaggcagcaagggcaagctggaggccatcatcacccccccccccgccaagaaggccaagagccccagccagaagaagcccgtgagcaagaaggccggcggcaagaagggcgccagaaagagcaagaagaagcagggcgaggtgagcaaggccgccagcgccgacagcaccaccgagggcacccccgccgacggcttcaccgtgctgagcaccaagagcctgttcctgggccagaagctgaacctgatccacagcgagatcagcaacctggccggcttcgaggtggaggccatcatcaaccccaccaacgccgacatcgacctgaaggacgacctgggcaacaccctggagaagaagggcggcaaggagttcgtggaggccgtgctggagctgagaaagaagaacggccccctggaggtggccggcgccgccgtgagcgccggccacggcctgcccgccaagttcgtgatccactgcaacagccccgtgtggggcgccgacaagtgcgaggagctgctggagaagaccgtgaagaactgcctggccctggccgacgacaagaagctgaagagcatcgccttccccagcatcggcagcggcagaaacggcttccccaagcagaccgccgcccagctgatcctgaaggccatcagcagctacttcgtgagcaccatgagcagcagcatcaagaccgtgtacttcgtgctgttcgacagcgagagcatcggcatctacgtgcaggagatggccaagctggacgccaactag

SEQ ID NO: 8241 - DNA, 1119 bp, Artificial Sequence; identical to SEQ ID NO: 8240
  Description of Artificial Sequence: Synthetic coding sequence

SEQ ID NO: 8242 - DNA, 1119 bp, Artificial Sequence
  Description of Artificial Sequence: Synthetic coding sequence
atgagcggcagaagcggcaagaagaagatgagcaagctgagcagaagcgccagagccggcgtgatcttccccgtgggcagactgatgagatacctgaagaagggcaccttcaagtacagaatcagcgtgggcgcccccgtgtacatggccgccgtgatcgagtacctggccgccgagatcctggagctggccggcaacgccgccagagacaacaagaaggccagaatcgcccccagacacatcctgctggccgtggccaacgacgaggagctgaaccagctgctgaagggcgtgaccatcgccagcggcggcgtgctgcccagaatccaccccgagctgctggccaagaagagaggcaccaagggcaagagcgagaccatcctgagccccccccccgagaagagaggcagaaaggccaccagcggcaagaagggcggcaagaagagcaaggccgccaagcccagaaccagcaagaagagcaagcccaaggacagcgacaaggagggcaccagcaacagcaccagcgaggacggccccggcgacggcttcaccatcctgagcagcaagagcctggtgctgggccagaagctgagcctgacccagagcgacatcagccacatcggcagcatgagagtggagggcatcgtgcaccccaccaccgccgagatcgacctgaaggaggacatcggcaaggccctggagaaggccggcggcaaggagttcctggagaccgtgaaggagctgagaaagagccagggccccctggaggtggccgaggccgccgtgagccagagcagcggcctggccgccaagttcgtgatccactgccacatcccccagtggggcagcgacaagtgcgaggagcagctggaggagaccatcaagaactgcctgagcgccgccgaggacaagaagctgaagagcgtggccttcccccccttccccagcggcagaaactgcttccccaagcagaccgccgcccaggtgaccctgaaggccatcagcgcccacttcgacgacagcagcgccagcagcctgaagaacgtgtacttcctgctgttcgacagcgagagcatcggcatctacgtgcaggagatggccaagctggacgccaagtag

SEQ ID NO: 8243 - DNA, 732 bp, Artificial Sequence
  Description of Artificial Sequence: Synthetic coding sequence
atgagcggcagaagcggcaagaagaagatgagcaagctgagcagaagcgccagagccggcgtgatcttccccgtgggcagactgatgagatacctgaagaagggcaccttcaagtacagaatcagcgtgggcgcccccgtgtacatggccgccgtgatcgagtacctggccgccgagatcctggagctggccggcaacgccgccagagacaacaagaaggccagaatcgcccccagacacatcctgctggccgtggccaacgacgaggagctgaaccagagcaagcccaaggacagcgacaaggagggcaccagcaacagcaccagcgaggacggccccggcgacggcttcaccatcctgagcagcaagagcctggtgctgggccagaagctgagcctgacccagagcgacatcagccacatcggcagcatgagagtggagggcatcgtgcaccccaccaccgccgagatcgacctgaaggaggacatcggcaaggccctggagaaggccggcggcaaggagttcctggagaccgtgaaggagctgagaaagagccagggccccctggaggtggccgaggccgccgtgagccagagcagcggcctggccgccaagttcgtgatccactgccacatcccccagtggggcagcgacaagtgcgaggagcagctggaggagaccatcaagaactgcctgagcgccgccgaggacaagaagctgaagagcgtgtag

SEQ ID NO: 8244 - DNA, 732 bp, Artificial Sequence; identical to SEQ ID NO: 8243
  Description of Artificial Sequence: Synthetic coding sequence

SEQ ID NO: 8245 - DNA, 387 bp, Artificial Sequence
  Description of Artificial Sequence: Synthetic coding sequence
atggccggcggcaaggccggcaaggacagcggcaaggccaagaccaaggccgtgagcagaagccagagagccggcctgcagttccccgtgggcagaatccacagacacctgaagagcagaaccaccagccacggcagagtgggcgccaccgccgccgtgtacagcgccgccatcctggagtacctgaccgccgaggtgctggagctggccggcaacgccagcaaggacctgaaggtgaagagaatcacccccagacacctgcagctggccatcagaggcgacgaggagctggacagcctgatcaaggccaccatcgccggcggcggcgtgatcccccacatccacaagagcctgatcggcaagaagggccagcagaagaccgtgtag

SEQ ID NO: 8246 - DNA, 774 bp, Artificial Sequence
  Description of Artificial Sequence: Synthetic coding sequence
atgaagtgccacgccggcagcctgagcgccaacctgcccgccctgaaggtgaccggctggagcagatgcgtggccagcagacagcccatcaccgtgggcgtgtgcggccccaagagacccctgtggcccagcagcgagaagcccttcaacttccacaccctggccaagctgcacgacatcggcctgggcaacgacttcctggacatgaccctgaaggcccagcagcagaagcagaagagccacgccaccatccccaagtgcccccccctgccctggagccccaccgtgaccctgtgcagctgctacctgatggccgccgccagcgccatggccgaggccagcagcgagaccaccagcgaggagggccagagcatccaggagcccaaggaggccaacagcaccaaggcccagaagcagaagagaagaggctgcagaggcagcagaagaagacacgccaacagaagaggcgacagcttcggcgacagcttcaccccctacttccccagagtgctgaagcaggtgcaccagggcctgagcctgagccaggaggccgtgagcgtgatggacagcatgatccacgacatcctggacagaatcgccaccgaggccggccagctggcccactacaccaagagagtgaccatcaccagcagagacatccagatggccgtgagactgctgctgcccggcaagatgggcaagctggccgaggcccagggcaccaacgccgccctgagaaccagcctgtgcgccatctggcagcagagaaagtag

SEQ ID NO: 8247 - DNA, 465 bp, Artificial Sequence
  Description of Artificial Sequence: Synthetic coding sequence
atggccgccgccagcgccatggccgaggccagcagcgagaccaccagcgaggagggccagagcatccaggagcccaaggaggccaacagcaccaaggcccagaagcagaagagaagaggctgcagaggcagcagaagaagacacgccaacagaagaggcgacagcttcggcgacagcttcaccccctacttccccagagtgctgaagcaggtgcaccagggcctgagcctgagccaggaggccgtgagcgtgatggacagcatgatccacgacatcctggacagaatcgccaccgaggccggccagctggcccactacaccaagagagtgaccatcaccagcagagacatccagatggccgtgagactgctgctgcccggcaagatgggcaagctggccgaggcccagggcaccaacgccgccctgagaaccagcctgtgcgccatctggcagcagagaaagtag

SEQ ID NO: 8248 - DNA, 1026 bp, Artificial Sequence
  Description of Artificial Sequence: Synthetic coding sequence
atggccacctggagaagagacggcagactgaccggcggccagagactgctgtgcgccggcctggccggcaccctgagcctgagcctgaccgcccccctggagctggccaccgtgctggcccaggtgggcgtggtgagaggccacgccagaggcccctgggccaccggccacagagtgtggagagccgagggcctgagagccctgtggaagggcaacgccgtggcctgcctgagactgttcccctgcagcgccgtgcagctggccgcctacagaaagttcgtggtgctgttcaccgacgacctgggccacatcagccagtggagcagcatcatggccggcagcctggccggcatggtgagcaccatcgtgacctaccccaccgacctgatcaagaccagactgatcatgcagaacatcctggagcccagctacagaggcctgctgcacgccttcagcaccatctaccagcaggagggcttcctggccctgtacagaggcgtgagcctgaccgtggtgggcgccctgcccttcagcgccggcagcctgctggtgtacatgaacctggagaagatctggaacggccccagagaccagttcagcctgccccagaacttcgccaacgtgtgcctggccgccgccgtgacccagaccctgagcttccccttcgagaccgtgaagagaaagatgcaggcccagagcccctacctgccccacagcggcggcgtggacgtgcacttcagcggcgccgtggactgcttcagacagatcgtgaaggcccagggcgtgctgggcctgtggaacggcctgaccgccaacctgctgaagatcgtgccctacttcggcatcatgttcagcaccttcgagttctgcaagagaatctgcctgtaccagaacggctacatcctgagccccctgagctacaagctgacccccggcgtggaccagagcctgcagccccaggagctgagagagctgaagaagttcttcaagaccagaaagcccaagcccaagaagcccaccctgtag

SEQ ID NO: 8249 - DNA, 408 bp, Artificial Sequence
  Description of Artificial Sequence: Synthetic coding sequence
atggccagaaccaagcagaccgccagaaagagcaccggcggcaaggcccccagaaagcagctggccaccaaggccgccagaaagagcacccccagcacctgcggcgtgaagccccacagatacagacccggcaccgtggccctgagagagatcagaagataccagaagagcaccgagctgctgatcagaaagctgcccttccagagactggtgagagagatcgcccaggacttcaacaccgacctgagattccagagcgccgccgtgggcgccctgcaggaggccagcgaggcctacctggtgggcctgctggaggacaccaacctgtgcgccatccacgccaagagagtgaccatcatgcccaaggacatccagctggccagaagaatcagaggcgagagagcctag

SEQ ID NO: 8250 - DNA, 363 bp, Artificial Sequence
  Description of Artificial Sequence: Synthetic coding sequence
atgaccagcctggcccagcagctgcagagactggccctgccccagagcgacgccagcctgctgagcagagacgaggtggccagcctgctgttcgaccccaaggaggccgccaccatcgacagagacaccgccttcgccatcggctgcaccggcctggaggagctgctgggcatcgaccccagcttcgagcagttcgaggcccccctgttcagccagctggccaagaccctggagagaagcgtgcagaccaaggccgtgaacaagcagctggacgagaacatcagcctgttcctgatccacctgagcccctacttcctgctgaagcccgcccagaagtgcctggagtggctgatccacagatag

SEQ ID NO: 8251 - DNA, 6192 bp, Artificial Sequence
  Description of Artificial Sequence: Synthetic coding sequence
atgaccagcctggcccagcagctgcagagactggccctgccccagagcgacgccagcctgctgagcagagacgaggtggccagcctgctgttcgaccccaaggaggccgccaccatcgacagagacaccgccttcgccatcggctgcaccggcctggaggagctgctgggcatcgaccccagcttcgagcagttcgaggcccccctgttcagccagctggccaagaccctggagagaagcgtgcagaccaaggccgtgaacaagcagctggacgagaacatcagcctgttcctgatccacctgagcccctacttcctgctgaagcccgcccagaagtgcctggagtggctgatccacagattccacatccacctgtacaaccaggacagcctgatcgcctgcgtgctgccctaccacgagaccagaatcttcgtgagagtgatccagctgctgaagatcaacaacagcaagcacagatggttctggctgctgcccgtgaagcagagcggcgtgcccctggccaagggcaccctgatcacccactgctacaaggacctgggcttcatggacttcatctgcagcctggtgaccaagagcgtgaaggtgttcgccgagtaccccggcagcagcgcccagctgagagtgctgctggccttctacgccagcaccatcgtgagcgccctggtggccgccgaggacgtgagcgacaacatcatcgccaagctgttcccctacatccagaagggcctgaagagcagcctgcccgactacagagccgccacctacatgatcatctgccagatcagcgtgaaggtgaccatggagaacaccttcgtgaacagcctggccagccagatcatcaagaccctgaccaagatccccagcctgatcaaggacggcctgagctgcctgatcgtgctgctgcagagacagaagcccgagagcctgggcaagaagcccttcccccacctgtgcaacgtgcccgacctgatcaccatcctgcacggcatcagcgagacctacgacgtgagccccctgctgcactacatgctgccccacctggtggtgagcatcatccaccacgtgaccggcgaggagaccgagggcatggacggccagatctacaagagacacctggaggccatcctgaccaagatcagcctgaagaacaacctggaccacctgctggccagcctgctgttcgaggagtacatcagctacagcagccaggaggagatggacagcaacaaggtgagcctgctgaacgagcagttcctgcccctgatcagactgctggagagcaagtaccccagaaccctggacgtggtgctggaggagcacctgaaggagatcgccgacctgaagaagcaggagctgttccaccagttcgtgagcctgagcaccagcggcggcaagtaccagttcctggccgacagcgacaccagcctgatgctgagcctgaaccaccccctggcccccgtgagaatcctggccatgaaccacctgaagaagatcatgaagaccagcaaggagggcgtggacgagagcttcatcaaggaggccgtgctggccagactgggcgacgacaacatcgacgtggtgctgagcgccatcagcgccttcgagatcttcaaggagcacttcagcagcgaggtgaccatcagcaacctgctgaacctgttccagagagccgagctgagcaagaacggcgagtggtacgaggtgctgaagatcgccgccgacatcctgatcaaggaggagatcctgagcgagaacgaccagctgagcaaccaggtggtggtgtgcctgctgcccttcatggtgatcaacaacgacgacaccgagagcgccgagatgaagatcgccatctacctgagcaagagcggcatctgcagcctgcaccccctgctgagaggctgggaggaggccctggagaacgtgatcaagagcaccaagcccggcaagctgatcggcgtggccaaccagaagatgatcgagctgctggccgacaacatcaacctgggcgaccccagcagcatgctgaagatggtggaggacctgatcagcgtgggcgaggaggagagcttcaacctgaagcagaaggtgaccttccacgtgatcctgagcgtgctggtgagctgctgcagcagcctgaaggagacccacttccccttcgccatcagagtgttcagcctgctgcagaagaagatcaagaagctggagagcgtgatcaccgccgtggagatccccagcgagtggcacatcgagctgatgctggacagaggcatccccgtggagctgtgggcccactacgtggaggagctgaacagcacccagagagtggccgtggaggacagcgtgttcctggtgttcagcctgaagaagttcatctacgccctgaaggcccccaagagcttccccaagggcgacatctggtggaaccccgagcagctgaaggaggacagcagagactacctgcacctgctgatcggcctgttcgagatgatgctgaacggcgccgacgccgtgcacttcagagtgctgatgaagctgttcatcaaggtgcacctggaggacgtgttccagctgttcaagttctgcagcgtgctgtggacctacggcagcagcctgagcaaccccctgaactgcagcgtgaagaccgtgctgcagacccaggccctgtacgtgggctgcgccatgctgagcagccagaagacccagtgcaagcaccagctggccagcatcagcagccccgtggtgaccagcctgctgatcaacctgggcagccccgtgaaggaggtgagaagagccgccatccagtgcctgcaggccctgagcggcgtggccagccccttctacctgatcatcgaccacctgatcagcaaggccgaggagatcaccagcgacgccgcctacgtgatccaggacctggccaccctgttcgaggagctgcagagagagaagaagctgaagagccaccagaagctgagcgagaccctgaagaacctgctgagctgcgtgtacagctgccccagctacatcgccaaggacctgatgaaggtgctgcagggcgtgaacggcgagatcaccaagcccttcttcgccgccatcagcgacgagaaggtgcagcagaagctgctgagaatgctgttcgacctgctggtgaactgcaagaacagccactgcgcccagaccgtgagcagcgtgttcaagggcatcagcgtgaacgccgagcaggtgagaatcgagctggagccccccgacaaggccaagcccctgggcaccgtgcagcagaagagaagacagaagatgcagcagaagaagagccaggacctggagagcgtgcaggaggtgggcggcagctactggcagagagtgaccctgatcctggagctgctgcagcacaagaagaagctgagaagcccccagatcctggtgcccaccctgttcaacctgctgagcagatgcctggagcccctgccccaggagcagggcaacatggagtacaccaagcagctgatcctgagctgcctgctgaacatctgccagaagctgagccccgacggcggcaagatccccaaggacatcctggacgaggagaagttcaacgtggagctgatcgtgcagtgcatcagactgagcgagatgccccagacccaccaccacgccctgctgctgctgggcaccgtggccggcatcttccccgacaaggtgctgcacaacatcatgagcatcttcaccttcatgggcgccaacgtgatgagactggacgacacctacagcttccaggtgatcaacaagaccgtgaagatggtgatccccgccctgatccagagcgacagcggcgacagcatcgaggtgagcagaaacgtggaggagatcgtggtgaagatcatcagcgtgttcgtggacgccctgccccacgtgcccgagcacagaagactgcccatcctggtgcagctggtggacaccctgggcgccgagaagttcctgtggatcctgctgatcctgctgttcgagcagtacgtgaccaagaccgtgctggccgccgcctacggcgagaaggacgccatcctggaggccgacaccgagttctggttcagcgtgtgctgcgagttcagcgtgcagcaccagatccagagcctgatgaacatcctgcagtacctgctgaagctgcccgaggagaaggaggagaccatccccaaggccgtgagcttcaacaagagcgagagccaggaggagatgctgcaggtgttcaacgtggagacccacaccagcaagcagctgagacacttcaagttcctgagcgtgagcttcatgagccagctgctgagcagcaacaacttcctgaagaaggtggtggagagcggcggccccgagatcctgaagggcctggaggagagactgctggagaccgtgctgggctacatcagcgccgtggcccagagcatggagagaaacgccgacaagctgaccgtgaagttctggagagccctgctgagcaaggcctacgacctgctggacaaggtgaacgccctgctgcccaccgagaccttcatccccgtgatcagaggcctggtgggcaaccccctgcccagcgtgagaagaaaggccctggacctgctgaacaacaagctgcagcagaacatcagctggaagaagaccatcgtgaccagattcctgaagctggtgcccgacctgctggccatcgtgcagagaaagaagaaggagggcgaggaggagcaggccatcaacagacagaccgccctgtacaccctgaagctgctgtgcaagaacttcggcgccgagaaccccgaccccttcgtgcccgtgctgaacaccgccgtgaagctgatcgcccccgagagaaaggaggagaagaacgtgctgggcagcgccctgctgtgcatcgccgaggtgaccagcaccctggaggccctggccatcccccagctgcccagcctgatgcccagcctgctgaccaccatgaagaacaccagcgagctggtgagcagcgaggtgtacctgctgagcgccctggccgccctgcagaaggtggtggagaccctgccccacttcatcagcccctacctggagggcatcctgagccaggtgatccacctggagaagatcaccagcgagatgggcagcgccagccaggccaacatcagactgaccagcctgaagaagaccctggccaccaccctggcccccagagtgctgctgcccgccatcaagaagacctacaagcagatcgagaagaactggaagaaccacatgggccccttcatgagcatcctgcaggagcacatcggcgtgatgaagaaggaggagctgaccagccaccagagccagctgaccgccttcttcctggaggccctggacttcagagcccagcacagcgagaacgacctggaggaggtgggcaagaccgagaactgcatcatcgactgcctggtggccatggtggtgaagctgagcgaggtgaccttcagacccctgttcttcaagctgttcgactgggccaagaccgaggacgcccccaaggacagactgctgaccttctacaacctggccgactgcatcgccgagaagctgaagggcctgttcaccctgttcgccggccacctggtgaagcccttcgccgacaccctgaaccaggtgaacatcagcaagaccgacgaggccttcttcgacagcgagaacgaccccgagaagtgctgcctgctgctgcagttcatcctgaactgcctgtacaagatcttcctgttcgacacccagcacttcatcagcaaggagagagccgaggccctgatgatgcccctggtggaccagctggagaacagactgggcggcgaggagaagttccaggagagagtgaccaagcacctgatcccctgcatcgcccagttcagcgtggccatggccgacgacagcctgtggaagcccctgaactaccagatcctgctgaagaccagagacagcagccccaaggtgagattcgccgccctgatcaccgtgctggccctggccgagaagctgaaggagaactacatcgtgctgctgcccgagagcatccccttcctggccgagctgatggaggacgagtgcgaggaggtggagcaccagtgccagaagaccatccagcagctggagaccgtgctgggcgagcccctgcagagctacttctag

SEQ ID NO: 8252 - DNA, 6435 bp, Artificial Sequence
  Description of Artificial Sequence: Synthetic coding sequence
atgaccagcctggcccagcagctgcagagactggccctgccccagagcgacgccagcctgctgagcagagacgaggtggccagcctgctgttcgaccccaaggaggccgccaccatcgacagagacaccgccttcgccatcggctgcaccggcctggaggagctgctgggcatcgaccccagcttcgagcagttcgaggcccccctgttcagccagctggccaagaccctggagagaagcgtgcagaccaaggccgtgaacaagcagctggacgagaacatcagcctgttcctgatccacctgagcccctacttcctgctgaagcccgcccagaagtgcctggagtggctgatccacagattccacatccacctgtacaaccaggacagcctgatcgcctgcgtgctgccctaccacgagaccagaatcttcgtgagagtgatccagctgctgaagatcaacaacagcaagcacagatggttctggctgctgcccgtgaagcagagcggcgtgcccctggccaagggcaccctgatcacccactgctacaaggacctgggcttcatggacttcatctgcagcctggtgaccaagagcgtgaaggtgttcgccgagtaccccggcagcagcgcccagctgagagtgctgctggccttctacgccagcaccatcgtgagcgccctggtggccgccgaggacgtgagcgacaacatcatcgccaagctgttcccctacatccagaagggcctgaagagcagcctgcccgactacagagccgccacctacatgatcatctgccagatcagcgtgaaggtgaccatggagaacaccttcgtgaacagcctggccagccagatcatcaagaccctgaccaagatccccagcctgatcaaggacggcctgagctgcctgatcgtgctgctgcagagacagaagcccgagagcctgggcaagaagcccttcccccacctgtgcaacgtgcccgacctgatcaccatcctgcacggcatcagcgagacctacgacgtgagccccctgctgcactacatgctgccccacctggtggtgagcatcatccaccacgtgaccggcgaggagaccgagggcatggacggccagatctacaagagacacctggaggccatcctgaccaagatcagcctgaagaacaacctggaccacctgctggccagcctgctgttcgaggagtacatcagctacagcagccaggaggagatggacagcaacaaggtgagcctgctgaacgagcagttcctgcccctgatcagactgctggagagcaagtaccccagaaccctggacgtggtgctggaggagcacctgaaggagatcgccgacctgaagaagcaggagctgttccaccagttcgtgagcctgagcaccagcggcggcaagtaccagttcctggccgacagcgacaccagcctgatgctgagcctgaaccaccccctggcccccgtgagaatcctggccatgaaccacctgaagaagatcatgaagaccagcaaggagggcgtggacgagagcttcatcaaggaggccgtgctggccagactgggcgacgacaacatcgacgtggtgctgagcgccatcagcgccttcgagatcttcaaggagcacttcagcagcgaggtgaccatcagcaacctgctgaacctgttccagagagccgagctgagcaagaacggcgagtggtacgaggtgctgaagatcgccgccgacatcctgatcaaggaggagatcctgagcgagaacgaccagctgagcaaccaggtggtggtgtgcctgctgcccttcatggtgatcaacaacgacgacaccgagagcgccgagatgaagatcgccatctacctgagcaagagcggcatctgcagcctgcaccccctgctgagaggctgggaggaggccctggagaacgtgatcaagagcaccaagcccggcaagctgatcggcgtggccaaccagaagatgatcgagctgctggccgacaacatcaacctgggcgaccccagcagcatgctgaagatggtggaggacctgatcagcgtgggcgaggaggagagcttcaacctgaagcagaaggtgaccttccacgtgatcctgagcgtgctggtgagctgctgcagcagcctgaaggagacccacttccccttcgccatcagagtgttcagcctgctgcagaagaagatcaagaagctggagagcgtgatcaccgccgtggagatccccagcgagtggcacatcgagctgatgctggacagaggcatccccgtggagctgtgggcccactacgtggaggagctgaacagcacccagagagtggccgtggaggacagcgtgttcctggtgttcagcctgaagaagttcatctacgccctgaaggcccccaagagcttccccaagggcgacatctggtggaaccccgagcagctgaaggaggacagcagagactacctgcacctgctgatcggcctgttcgagatgatgctgaacggcgccgacgccgtgcacttcagagtgctgatgaagctgttcatcaaggtgcacctggaggacgtgttccagctgttcaagttctgcagcgtgctgtggacctacggcagcagcctgagcaaccccctgaactgcagcgtgaagaccgtgctgcagacccaggccctgtacgtgggctgcgccatgctgagcagccagaagacccagtgcaagcaccagctggccagcatcagcagccccgtggtgaccagcctgctgatcaacctgggcagccccgtgaaggaggtgagaagagccgccatccagtgcctgcaggccctgagcggcgtggccagccccttctacctgatcatcgaccacctgatcagcaaggccgaggagatcaccagcgacgccgcctacgtgatccaggacctggccaccctgttcgaggagctgcagagagagaagaagctgaagagccaccagaagctgagcgagaccctgaagaacctgctgagctgcgtgtacagctgccccagctacatcgccaaggacctgatgaaggtgctgcagggcgtgaacggcgagatggtgctgagccagctgctgcccatggccgagcagctgctggagaagatccagaaggagcccaccgccgtgctgaaggacgaggccatggtgctgcacctgaccctgggcaagtacaacgagttcagcgtgagcctgctgaacgaggaccccaagagcctggacatcttcatcaaggccgtgcacaccaccaaggagctgtacgccggcatgcccaccatccagatcaccgccctggagaagatcaccaagcccttcttcgccgccatcagcgacgagaaggtgcagcagaagctgctgagaatgctgttcgacctgctggtgaactgcaagaacagccactgcgcccagaccgtgagcagcgtgttcaagggcatcagcgtgaacgccgagcaggtgagaatcgagctggagccccccgacaaggccaagcccctgggcaccgtgcagcagaagagaagacagaagatgcagcagaagaagagccaggacctggagagcgtgcaggaggtgggcggcagctactggcagagagtgaccctgatcctggagctgctgcagcacaagaagaagctgagaagcccccagatcctggtgcccaccctgttcaacctgctgagcagatgcctggagcccctgccccaggagcagggcaacatggagtacaccaagcagctgatcctgagctgcctgctgaacatctgccagaagctgagccccgacggcggcaagatccccaaggacatcctggacgaggagaagttcaacgtggagctgatcgtgcagtgcatcagactgagcgagatgccccagacccaccaccacgccctgctgctgctgggcaccgtggccggcatcttccccgacaaggtgctgcacaacatcatgagcatcttcaccttcatgggcgccaacgtgatgagactggacgacacctacagcttccaggtgatcaacaagaccgtgaagatggtgatccccgccctgatccagagcgacagcggcgacagcatcgaggtgagcagaaacgtggaggagatcgtggtgaagatcatcagcgtgttcgtggacgccctgccccacgtgcccgagcacagaagactgcccatcctggtgcagctggtggacaccctgggcgccgagaagttcctgtggatcctgctgatcctgctgttcgagcagtacgtgaccaagaccgtgctggccgccgcctacggcgagaaggacgccatcctggaggccgacaccgagttctggttcagcgtgtgctgcgagttcagcgtgcagcaccagatccagagcctgatgaacatcctgcagtacctgctgaagctgcccgaggagaaggaggagaccatccccaaggccgtgagcttcaacaagagcgagagccaggaggagatgctgcaggtgttcaacgtggagacccacaccagcaagcagctgagacacttcaagttcctgagcgtgagcttcatgagccagctgctgagcagcaacaacttcctgaagaaggtggtggagagcggcggccccgagatcctgaagggcctggaggagagactgctggagaccgtgctgggctacatcagcgccgtggcccagagcatggagagaaacgccgacaagctgaccgtgaagttctggagagccctgctgagcaaggcctacgacctgctggacaaggtgaacgccctgctgcccaccgagaccttcatccccgtgatcagaggcctggtgggcaaccccctgcccagcgtgagaagaaaggccctggacctgctgaacaacaagctgcagcagaacatcagctggaagaagaccatcgtgaccagattcctgaagctggtgcccgacctgctggccatcgtgcagagaaagaagaaggagggcgaggaggagcaggccatcaacagacagaccgccctgtacaccctgaagctgctgtgcaagaacttcggcgccgagaaccccgaccccttcgtgcccgtgctgaacaccgccgtgaagctgatcgcccccgagagaaaggaggagaagaacgtgctgggcagcgccctgctgtgcatcgccgaggtgaccagcaccctggaggccctggccatcccccagctgcccagcctgatgcccagcctgctgaccaccatgaagaacaccagcgagctggtgagcagcgaggtgtacctgctgagcgccctggccgccctgcagaaggtggtggagaccctgccccacttcatcagcccctacctggagggcatcctgagccaggtgatccacctggagaagatcaccagcgagatgggcagcgccagccaggccaacatcagactgaccagcctgaagaagaccctggccaccaccctggcccccagagtgctgctgcccgccatcaagaagacctacaagcagatcgagaagaactggaagaaccacatgggccccttcatgagcatcctgcaggagcacatcggcgtgatgaagaaggaggagctgaccagccaccagagccagctgaccgccttcttcctggaggccctggacttcagagcccagcacagcgagaacgacctggaggaggtgggcaagaccgagaactgcatcatcgactgcctggtggccatggtggtgaagctgagcgaggtgaccttcagacccctgttcttcaagctgttcgactgggccaagaccgaggacgcccccaaggacagactgctgaccttctacaacctggccgactgcatcgccgagaagctgaagggcctgttcaccctgttcgccggccacctggtgaagcccttcgccgacaccctgaaccaggtgaacatcagcaagaccgacgaggccttcttcgacagcgagaacgaccccgagaagtgctgcctgctgctgcagttcatcctgaactgcctgtacaagatcttcctgttcgacacccagcacttcatcagcaaggagagagccgaggccctgatgatgcccctggtggaccagctggagaacagactgggcggcgaggagaagttccaggagagagtgaccaagcacctgatcccctgcatcgcccagttcagcgtggccatggccgacgacagcctgtggaagcccctgaactaccagatcctgctgaagaccagagacagcagccccaaggtgagattcgccgccctgatcaccgtgctggccctggccgagaagctgaaggagaactacatcgtgctgctgcccgagagcatccccttcctggccgagctgatggaggacgagtgcgaggaggtggagcaccagtgccagaagaccatccagcagctggagaccgtgctgggcgagcccctgcagagctacttctag

SEQ ID NO: 8253 - DNA, 231 bp, Artificial Sequence
  Description of Artificial Sequence: Synthetic coding sequence
atggccgagaccgaccccaagaccgtgcaggacctgaccagcgtggtgcagaccctgctgcagcagatgcaggacaagttccagaccatgagcgaccagatcatcggcagaatcgacgacatgagcagcagaatcgacgacctggagaagaacatcgccgacctgatgacccaggccggcgtggaggagctggagagcgagaacaagatccccgccacccagaagagctag

SEQ ID NO: 8254 - DNA, 1791 bp, Artificial Sequence
  Description of Artificial Sequence: Synthetic coding sequence
atggaggccctgctgagcacccccatcaaccccaacaacttccccgccaagctgtggagactggtgaacagccccagatacagaagcatcagatgggacggcagaggcgagggcctgctgatcgaccagcccctgttcgaggccgagctgctgagcccccccggccccggcggcggcggcggcaccgccggcgccggcgccgagcccgagctgttcaagaccaccagcttcaccagcttcatcagacagctgaacctgtacggcttcagaaaggtggtgctgggcggccccggcggcggcaagcccgccggcaacggccccctgcaccacttccacaacccccacttcagaagagaccagccccagctgctggtgcacctgaagagactgaccagcgccaacaaggccaagctggccgccggcctggaggtgccctgcagaccccccaacagattccagagactgctgatcaccagcgccagcgccgccaccgcccccctgcagcaccagcagccccccccccccgccggccccagacccgagccccacggccccgtggccgtgggccagttccacagaagcttcagaagagacagcctgagcccctacagctgcgtgagcacccccagccacgaccacagcacctaccccctgaagggcctggacagaacccccgtgccccacagaatctggcagaacagcctgggcatgcaccccggccaggtggagaccagccccaccttcagcgacaagggcgtgcccttccccgtgctgcagagattccccaccgaggtgacctacaccctgcagcccagcaccaccagcgtgcacgtgcagcagggcccccagaccatggtgagcagcagccagaagtacagcaactacacccccagcgcccagtacagccaggcctactaccccaccgccgtgctgcagtgctgcagccccacccacatggacgccctgagcagctgcgtgacccccaacgccagcagctacgcccactgcaactacttccagaaccccagcatgcagagcagctaccccgtggagttcctgcccagcaactggccctgcagcaccaccgacgagaacaccaagaccgaggtgaacctggaggccgtgttccagatcgtggacgagctgcacagcagccccaagctggagatggtgaaggtggagcccgtggagaaccagtgccccaccagccccagctacagaggccagcacatcctggccaacagcaacaacagcaacccctgcagcgccagccaggccagccagctggagcccctgacccccgtgggcagcgacatcatgagcttcgtggtgggcaccgagcaggccgtggcctgcagcctgccccagagccccgagtacatctacaccatccacaccgcccagcccgtggagaacagcaccatccaggagagcgccgccatccagcaggcccacgtgaagctgaaggagcacctgaaccacaaccccagccccagcagcgtggtgttcgtgcaggagggcccccccttcagcacccaccaggtggacgccaacatcaagtgccagaccagcagcagagagaacatcctgcccagcgagcagatgggcttcctgatcagcgagatgggccccgccagcaagcccagcgaggacaccggcctggccacccccgccagatacagagagcacagaagcaacagccagcagggcaagagccccgacctgcacctgctggtggacgtggcctgcaagcaggagagattccccaaggaggaggagctgaaggagtag

SEQ ID NO: 8255 - DNA, 1491 bp, Artificial Sequence
  Description of Artificial Sequence: Synthetic coding sequence
ggcggcatcgagaacggcgtgggcgagctgggcagcggcggcgaggcccccgccagaagaggcgacggcggcgccgccctgcacccccaccagccccagcagctgcccagacaggccgtggcccccggcgagcagcccgccctgcccctgcaccccctgggcagacccagaagaggcgccgcctacagaagcgccgccctgagaggcagagccgcccagccccccgccggccccagacccgagccccacggccccgtggccgtgggccagttccacagaagcttcagaagagacagcctgagcccctacagctgcgtgagcacccccagccacgaccacagcacctaccccctgaagggcctggacagaacccccgtgccccacagaatctggcagaacagcctgggcatgcaccccggccaggtggagaccagccccaccttcagcgacaagggcgtgcccttccccgtgctgcagagattccccaccgaggtgacctacaccctgcagcccagcaccaccagcgtgcacgtgcagcagggcccccagaccatggtgagcagcagccagaagtacagcaactacacccccagcgcccagtacagccaggcctactaccccaccgccgtgctgcagtgctgcagccccacccacatggacgccctgagcagctgcgtgacccccaacgccagcagctacgcccactgcaactacttccagaaccccagcatgcagagcagctaccccgtggagttcctgcccagcaactggccctgcagcaccaccgacgagaacaccaagaccgaggtgaacctggaggccgtgttccagatcgtggacgagctgcacagcagccccaagctggagatggtgaaggtggagcccgtggagaaccagtgccccaccagccccagctacagaggccagcacatcctggccaacagcaacaacagcaacccctgcagcgccagccaggccagccagctggagcccctgacccccgtgggcagcgacatcatgagcttcgtggtgggcaccgagcaggccgtggcctgcagcctgccccagagccccgagtacatctacaccatccacaccgcccagcccgtggagaacagcaccatccaggagagcgccgccatccagcaggcccacgtgaagctgaaggagcacctgaaccacaaccccagccccagcagcgtggtgttcgtgcaggagggcccccccttcagcacccaccaggtggacgccaacatcaagtgccagaccagcagcagagagaacatcctgcccagcgagcagatgggcttcctgatcagcgagatgggccccgccagcaagcccagcgaggacaccggcctggccacccccgccagatacagagagcacagaagcaacagccagcagggcaagagccccgacctgcacctgctggtggacgtggcctgcaagcaggagagattccccaaggaggaggagctgaaggagtag

SEQ ID NO: 8256 - DNA, 3264 bp, Artificial Sequence
  Description of Artificial Sequence: Synthetic coding sequence
atggccagaagcagcccctacctgagacagctgcagggccccctgctgccccccagagacctggtggaggaggacgacgactacctgaacgacgacgtggaggaggacgaggagagcgtgttcatcgacgccgaggagctgtgcagcggcggcgtgaaggccggcagcctgcccggctgcctgagagtgagcatctgcgacgagaacacccaggagacctgcaaggtgttcggcagattccccatcaccggcgcctggtggagagtgaaggtgcaggtgaagcccgtggtgggcagcagaagctaccagtaccaggtgcagggcttccccagctacttcctgcagagcgacatgagcccccccaaccagaagcacatctgcgccctgttcctgaaggagtgcgaggtgagcagcgacgacgtgaacaagttcctgacctgggtgaaggaggtgagcaactacaagaacctgaacttcgagaacctgagagagaccctgagaaccttccacaaggagaccggcagaaaggaccagaagcagcccacccagaacggccaggaggagctgttcctggacaacgagatgagcctgcccctggagaacaccatccccttcagaaacgtgatgaccgccctgcagttccccaagatcatggagttcctgcccgtgctgctgcccagacacttcaagtggatcatcggcagcggcagcaaggagatgctgaaggagatcgaggagatcctgggcacccacccctggaagctgggcttcagcaagatcacctacagagagtggaagctgctgagatgcgaggccagctggatcgccttctgccagtgcgagagcctgctgcagctgatgaccgacctggagaagaacgccctgatcatgtacagcagactgaagcagatctgcagagaggacggccacacctacgtggaggtgaacgacctgaccctgaccctgagcaaccacatgagcttccacgccgccagcgagagcctgaagttcctgaaggacatcggcgtggtgacctacgagaagagctgcgtgttcccctacgacctgtaccacgccgagagagccatcgccttcagcatctgcgacctgatgaagaagcccccctggcacctgtgcgtggacgtggagaaggtgctggccagcatccacaccaccaagcccgagaacagcagcgacgacgccctgaacgagagcaagcccgacgaggtgagactggagaaccccgtggacgtggtggacacccaggacaacggcgaccacatctggaccaacggcgagaacgagatcaacgccgagatcagcgaggtgcagctggaccaggaccaggtggaggtgcccctggacagagaccaggtggccgccctggagatgatctgcagcaaccccgtgaccgtgatcagcggcaagggcggctgcggcaagaccaccatcgtgagcagactgttcaagcacatcgagcagctggaggagagagaggtgaagaaggcctgcgaggacttcgagcaggaccagaacgccagcgaggagtggatcaccttcaccgagcagagccagctggaggccgacaaggccatcgaggtgctgctgaccgcccccaccggcaaggccgccggcctgctgagacagaagaccggcctgcacgcctacaccctgtgccaggtgaactacagcttctacagctggacccagaccatgatgaccaccaacaagccctggaagttcagcagcgtgagagtgctggtggtggacgagggcagcctggtgagcgtgggcatcttcaagagcgtgctgaacctgctgtgcgagcacagcaagctgagcaagctgatcatcctgggcgacatcagacagctgcccagcatcgagcccggcaacctgctgaaggacctgttcgagaccctgaagagcagaaactgcgccatcgagctgaagaccaaccacagagccgagagccagctgatcgtggacaacgccaccagaatcagcagaagacagttccccaagttcgacgccgagctgaacatcagcgacaaccccaccctgcccatcagcatccaggacaagaccttcatcttcgtgagactgcccgaggaggacgccagcagccagagcagcaagaccaaccaccacagctgcctgtacagcgccgtgaagaccctgctgcaggagaacaacctgcagaacgccaagaccagccagttcatcgccttcagaagacaggactgcgacctgatcaacgactgctgctgcaagcactacaccggccacctgaccaaggaccaccagagcagactggtgttcggcatcggcgacaagatctgctgcaccagaaacgcctacctgagcgacctgctgcccgagaacatcagcggcagccagcagaacaacgacctggacgccagcagcgaggacttcagcggcaccctgcccgacttcgccaagaacaagagagacttcgagagcaacgtgagactgtgcaacggcgagatcttcttcatcaccaacgacgtgaccgacgtgaccttcggcaagagaagaagcctgaccatcaacaacatggccggcctggaggtgaccgtggacttcaagaagctgatgaagtactgcagaatcaagcacgcctgggccagaaccatccacaccttccagggcagcgaggagcagaccgtggtgtacgtggtgggcaaggccggcagacagcactggcagcacgtgtacaccgccgtgaccagaggcagatgcagagtgtacgtgatcgccgaggagagccagctgagaaacgccatcatgaagaacagcttccccagaaagaccagactgaagcacttcctgcagagcaagctgagcagcagcggcgccccccccgccgacttccccagccccagaaagagcagcggcgacagcggcggccccagcacccccagcgccagccccctgcccgtggtgaccgaccacgccatgaccaacgacgtgacctggagcgaggccagcagccccgacgagagaaccctgaccttcgccgagagatggcagctgagcagccccgacggcgtggacaccgacgacgacctgcccaagagcagagccagcaagagaacctgcggcgtgaacgacgacgagagccccagcaagatcttcatggtgggcgagagcccccaggtgagcagcagactgcagaacctgagactgaacaacctgatccccagacagctgttcaagcccaccgacaaccaggagacctag

SEQ ID NO: 8257 - DNA, 3264 bp, Artificial Sequence; identical to SEQ ID NO: 8256
  Description of Artificial Sequence: Synthetic coding sequence

SEQ ID NO: 8258 - DNA, 3030 bp, Artificial Sequence
  Description of Artificial Sequence: Synthetic coding sequence
atgagctggatgttcaagagagaccccgtgtggaagtacctgcagaccgtgcagtacggcgtgcacggcaacttccccagactgagctaccccaccttcttccccagattcgagttccaggacgtgatcccccccgacgacttcctgaccagcgacgaggaggtggacagcgtgctgttcggcagcctgagaggccacgtggtgggcctgagatactacaccggcgtggtgaacaacaacgagatggtggccctgcagagagaccccaacaacccctacgacaagaacgccatcaaggtgaacaacgtgaacggcaaccaggtgggccacctgaagaaggagctggccggcgccctggcctacatcatggacaacaagctggcccagatcgagggcgtggtgcccttcggcgccaacaacgccttcaccatgcccctgcacatgaccttctggggcaaggaggagaacagaaaggccgtgagcgaccagctgaagaagcacggcttcaagctgggccccgcccccaagaccctgggcttcaacctggagagcggctggggcagcggcagagccggccccagctacagcatgcccgtgcacgccgccgtgcagatgaccaccgagcagctgaagaccgagttcgacaagctgttcgaggacctgaaggaggacgacaagacccacgagatggagcccgccgaggccatcgagacccccctgctgccccaccagaagcaggccctggcctggatggtgagcagagagaacagcaaggagctgccccccttctgggagcagagaaacgacctgtactacaacaccatcaccaacttcagcgagaaggacagacccgagaacgtgcacggcggcatcctggccgacgacatgggcctgggcaagaccctgaccgccatcgccgtgatcctgaccaacttccacgacggcagacccctgcccatcgagagagtgaagaagaacctgctgaagaaggagtacaacgtgaacgacgacagcatgaagctgggcggcaacaacaccagcgagaaggccgacggcctgagcaaggacgccagcagatgcagcgagcagcccagcatcagcgacatcaaggagaagagcaagttcagaatgagcgagctgagcagcagcagacccaagagaagaaagaccgccgtgcagtacatcgagagcagcgacagcgaggagatcgagaccagcgagctgccccagaagatgaagggcaagctgaagaacgtgcagagcgagaccaagggcagagccaaggccggcagcagcaaggtgatcgaggacgtggccttcgcctgcgccctgaccagcagcgtgcccaccaccaagaagaagatgctgaagaagggcgcctgcgccgtggagggcagcaagaagaccgacgtggaggagagacccagaaccaccctgatcatctgccccctgagcgtgctgagcaactggatcgaccagttcggccagcacatcaagagcgacgtgcacctgaacttctacgtgtactacggccccgacagaatcagagagcccgccctgctgagcaagcaggacatcgtgctgaccacctacaacatcctgacccacgactacggcaccaagggcgacagccccctgcacagcatcagatggctgagagtgatcctggacgagggccacgccatcagaaaccccaacgcccagcagaccaaggccgtgctggacctggagagcgagagaagatgggtgctgaccggcacccccatccagaacagcctgaaggacctgtggagcctgctgagcttcctgaagctgaagcccttcatcgacagagagtggtggcacagaaccatccagagacccgtgaccatgggcgacgagggcggcctgagaagactgcagagcctgatcaagaacatcaccctgagaagaaccaagaccagcaagatcaagggcaagcccgtgctggagctgcccgagagaaaggtgttcatccagcacatcaccctgagcgacgaggagagaaagatctaccagagcgtgaagaacgagggcagagccaccatcggcagatacttcaacgagggcaccgtgctggcccactacgccgacgtgctgggcctgctgctgagactgagacagatctgctgccacacctacctgctgaccaacgccgtgagcagcaacggccccagcggcaacgacacccccgaggagctgagaaagaagctgatcagaaagatgaagctgatcctgagcagcggcagcgacgaggagtgcgccatctgcctggacagcctgaccgtgcccgtgatcacccactgcgcccacgtgttctgcaagccctgcatctgccaggtgatccagaacgagcagccccacgccaagtgccccctgtgcagaaacgacatccacgaggacaacctgctggagtgcccccccgaggagctggccagagacagcgagaagaagagcgacatggagtggaccagcagcagcaagatcaacgccctgatgcacgccctgaccgacctgagaaagaagaaccccaacatcaagagcctggtggtgagccagttcaccaccttcctgagcctgatcgagatccccctgaaggccagcggcttcgtgttcaccagactggacggcagcatggcccagaagaagagagtggagagcatccagtgcttccagaacaccgaggccggcagccccaccatcatgctgctgagcctgaaggccggcggcgtgggcctgaacctgagcgccgccagcagagtgttcctgatggaccccgcctggaaccccgccgccgaggaccagtgcttcgacagatgccacagactgggccagaagcaggaggtgatcatcaccaagttcatcgtgaaggacagcgtggaggagaacatgctgaagatccagaacaagaagagagagctggccgccggcgccttcggcaccaagaagcccaacgccgacgagatgaagcaggccaagatcaacgagatcagaaccctgatcgacctgtag

SEQ ID NO: 8259 - DNA, 3030 bp, Artificial Sequence; identical to SEQ ID NO: 8258
  Description of Artificial Sequence: Synthetic coding sequence

SEQ ID NO: 8260 - DNA, 1179 bp, Artificial Sequence
  Description of Artificial Sequence: Synthetic coding sequence
atgttcaagagagaccccgtgtggaagtacctgcagaccgtgcagtacggcgtgcacggcaacttccccagactgagctaccccaccttcttccccagattcgagttccaggacgtgatcccccccgacgacttcctgaccagcgacgaggaggtggacagcgtgctgttcggcagcctgagaggccacgtggtgggcctgagatactacaccggcgtggtgaacaacaacgagatggtggccctgcagagagaccccaacaacccctacgacaagaacgccatcaaggtgaacaacgtgaacggcaaccaggtgggccacctgaagaaggagctggccggcgccctggcctacatcatggacaacaagctggcccagatcgagggcgtggtgcccttcggcgccaacaacgccttcaccatgcccctgcacatgaccttctggggcaaggaggagaacagaaaggccgtgagcgaccagctgaagaagcacggcttcaagctgggccccgcccccaagaccctgggcttcaacctggagagcggctggggcagcggcagagccggccccagctacagcatgcccgtgcacgccgccgtgcagatgaccaccgagcagctgaagaccgagttcgacaagctgttcgaggacctgaaggaggacgacaagacccacgagatggagcccgccgaggccatcgagacccccctgctgccccaccagaagcaggccctggcctggatggtgagcagagagaacagcaaggagctgccccccttctgggagcagagaaacgacctgtactacaacaccatcaccaacttcagcgagaaggacagacccgagaacgtgcacggcggcatcctggccgacgacatgggcctgggcaagaccctgaccgccatcgccgtgatcctgaccaacttccacgacggcagacccctgcccatcgagagagtgaagaagaacctgctgaagaaggagtacaacgtgaacgacgacagcatgaagctgggcggcaacaacaccagcgagaaggccgacggcctgagcaaggacgccagcagatgcagcgagcagcccagcatcagcgacatcaaggagaagagcaagttcagaatgagcgagctgagcagcagcagacccaagagccagaagaagaagaagaagagagagtag

SEQ ID NO: 8261 - DNA, 1374 bp, Artificial Sequence
  Description of Artificial Sequence: Synthetic coding sequence
atgttcaagagagaccccgtgtggaagtacctgcagaccgtgcagtacggcgtgcacggcaacttccccagactgagctaccccaccttcttccccagattcgagttccaggacgtgatcccccccgacgacttcctgaccagcgacgaggaggtggacagcgtgctgttcggcagcctgagaggccacgtggtgggcctgagatactacaccggcgtggtgaacaacaacgagatggtggccctgcagagagaccccaacaacccctacgacaagaacgccatcaaggtgaacaacgtgaacggcaaccaggtgggccacctgaagaaggagctggccggcgccctggcctacatcatggacaacaagctggcccagatcgagggcgtggtgcccttcggcgccaacaacgccttcaccatgcccctgcacatgaccttctggggcaaggaggagaacagaaaggccgtgagcgaccagctgaagaagcacggcttcaagctgggccccgcccccaagaccctgggcttcaacctggagagcggctggggcagcggcagagccggccccagctacagcatgcccgtgcacgccgccgtgcagatgaccaccgagcagctgaagaccgagttcgacaagctgttcgaggacctgaaggaggacgacaagacccacgagatggagcccgccgaggccatcgagacccccctgctgccccaccagaagcaggccctggcctggatggtgagcagagagaacagcaaggagctgccccccttctgggagcagagaaacgacctgtactacaacaccatcaccaacttcagcgagaaggacagacccgagaacgtgcacggcggcatcctggccgacgacatgggcctgggcaagaccctgaccgccatcgccgtgatcctgaccaacttccacgacggcagacccctgcccatcgagagagtgaagaagaacctgctgaagaaggagtacaacgtgaacgacgacagcatgaagctgggcggcaacaacaccagcgagaaggccgacggcctgagcaaggacgccagcagatgcagcgagcagcccagcatcagcgacatcaaggagaagagcaagttcagaatgagcgagctgagcagcagcagacccaagagaagaaagaccgccgtgcagtacatcgagagcagcgacagcgaggagatcgagaccagcgagctgccccagaagatgaagggcaagctgaagaacgtgcagagcgagaccaagggcagagccaaggccggcagcagcaaggtgatcgaggacgtggccttcgcctgcgccctgaccagcagcgtgcccaccaccaagaagaagatgctgaagaaggtgaagtag

SEQ ID NO: 8262 - DNA, 3030 bp, Artificial Sequence; identical to SEQ ID NO: 8258
  Description of Artificial Sequence: Synthetic coding sequence

SEQ ID NO: 8263 - DNA, 984 bp, Artificial Sequence
  Description of Artificial Sequence: Synthetic coding sequence
atgagcgacaagctgaaggagagaaaggtgagcagactgagccccaacggcacctgcgccctggtggtggaggccagcgacagccccaccagacacctgggcggccccatggccggcaagtgcccccacggcaccctgagcgtggaggagagcagagtgagaacccccgtgagccacaaggtgatcgagaagagaagaagagacagaatcaacagatgcctgaacgagctgggcaagaccgtgcccatggccctggccaagcagggcgagccccaggaggccctggcccagatcagaagcagagtgagaagcctggtgctgagcagcgccaccgtgcccgaccagcaggccctgggcagatgcgagggccccttcctgctgctgcagagcagcggcaagctggagaaggccgagatcctggagatgaccgtgcagtacctgagagccctgcacagcgccgacttccccagaggcagagagaaggccgagctgctggccgagttcgccaactacttccactacggctaccacgagtgcatgaagaacctggtgcactacctgaccaccgtggagagaatggagaccaaggacaccaagtacgccagaatcctggccttcctgcagagcaaggccagactgggcgccgagcccgccttcccccccctgggcagcctgcccgagcccgacttcagctaccagctgcaccccgccggccccgagttcgccggccacagccccggcgaggccgccgtgttcccccagggcagcggcgccggccccttcccctggccccccggcgccgccagaagccccgccctgccctacctgcccagcgcccccgtgcccctggccagccccgcccagcagcacagccccttcctgacccccgtgcagggcctggacagacactacctgaacctgatcggccacgcccaccccaacgccctgaacctgcacaccccccagcacccccccgtgctgtag

SEQ ID NO: 8264 - DNA, 726 bp, Artificial Sequence
  Description of Artificial Sequence: Synthetic coding sequence
atgagcgacaagctgaaggagagaaagagaacccccgtgagccacaaggtgatcgagaagagaagaagagacagaatcaacagatgcctgaacgagctgggcaagaccgtgcccatggccctggccaagcagagcagcggcaagctggagaaggccgagatcctggagatgaccgtgcagtacctgagagccctgcacagcgccgacttccccagaggcagagagaaggagctgctggccgagttcgccaactacttccactacggctaccacgagtgcatgaagaacctggtgcactacctgaccaccgtggagagaatggagaccaaggacaccaagtacgccagaatcctggccttcctgcagagcaaggccagactgggcgccgagcccgccttcccccccctgggcagcctgcccgagcccgacttcagctaccagctgcaccccgccggccccgagttcgccggccacagccccggcgaggccgccgtgttcccccagggcagcggcgccggccccttcccctggccccccggcgccgccagaagccccgccctgccctacctgcccagcgcccccgtgcccctggccagccccgcccagcagcacagccccttcctgacccccgtgcagggcctggacagacactacctgaacctgatcggccacgcccaccccaacgccctgaacctgcacaccccccagcacccccccgtgctgtag

SEQ ID NO: 8265 - DNA, 729 bp, Artificial Sequence
  Description of Artificial Sequence: Synthetic coding sequence
atgagcgacaagctgaaggagagaaagagaacccccgtgagccacaaggtgatcgagaagagaagaagagacagaatcaacagatgcctgaacgagctgggcaagaccgtgcccatggccctggccaagcagagcagcggcaagctggagaaggccgagatcctggagatgaccgtgcagtacctgagagccctgcacagcgccgacttccccagaggcagagagaaggccgagctgctggccgagttcgccaactacttccactacggctaccacgagtgcatgaagaacctggtgcactacctgaccaccgtggagagaatggagaccaaggacaccaagtacgccagaatcctggccttcctgcagagcaaggccagactgggcgccgagcccgccttcccccccctgggcagcctgcccgagcccgacttcagctaccagctgcaccccgccggccccgagttcgccggccacagccccggcgaggccgccgtgttcccccagggcagcggcgccggccccttcccctggccccccggcgccgccagaagccccgccctgccctacctgcccagcgcccccgtgcccctggccagccccgcccagcagcacagccccttcctgacccccgtgcagggcctggacagacactacctgaacctgatcggccacgcccaccccaacgccctgaacctgcacaccccccagcacccccccgtgctgtag

SEQ ID NO: 8266 - DNA, 2031 bp, Artificial Sequence
  Description of Artificial Sequence: Synthetic coding sequence
atgccccacgccttcaagcccggcgacctggtgttcgccaagatgaagggctacccccactggcccgccagaatcgacgacatcgccgacggcgccgtgaagcccccccccaacaagtaccccatcttcttcttcggcacccacgagaccgccttcctgggccccaaggacctgttcccctacgacaagtgcaaggacaagtacggcaagcccaacaagagaaagggcttcaacgagggcctgtgggagatccagaacaacccccacgccagctacagcgcccccccccccgtgagcagcagcgacagcgaggcccccgaggccaaccccgccgacggcagcgacgccgacgaggacgacgaggacagaggcgtgatggccgtgaccgccgtgaccgccaccgccgccagcgacagaatggagagcgacagcgacagcgacaagagcagcgacaacagcggcctgaagagaaagacccccgccctgaagatgagcgtgagcaagagagccagaaaggccagcagcgacctggaccaggccagcgtgagccccagcgaggaggagaacagcgagagcagcagcgagagcgagaagaccagcgaccaggacttcacccccgagaagaaggccgccgtgagagcccccagaagaggccccctgggcggcagaaagaagaagaaggcccccagcgccagcgacagcgacagcaaggccgacagcgacggcgccaagcccgagcccgtggccatggccagaagcgccagcagcagcagcagcagcagcagcagcagcgacagcgacgtgagcgtgaagaagccccccagaggcagaaagcccgccgagaagcccctgcccaagcccagaggcagaaagcccaagcccgagagaccccccagcagcagcagcagcgacagcgacagcgacgaggtggacagaatcagcgagtggaagagaagagacgaggccagaagaagagagctggaggccagaagaagaagagagcaggaggaggagctgagaagactgagagagcaggagaaggaggagaaggagagaagaagagagagagccgacagaggcgaggccgagagaggcagcggcggcagcagcggcgacgagctgagagaggacgacgagcccgtgaagaagagaggcagaaagggcagaggcagaggcccccccagcagcagcgacagcgagcccgaggccgagctggagagagaggccaagaagagcgccaagaagccccagagcagcagcaccgagcccgccagaaagcccggccagaaggagaagagagtgagacccgaggagaagcagcaggccaagcccgtgaaggtggagagaaccagaaagagaagcgagggcttcagcatggacagaaaggtggagaagaagaaggagcccagcgtggaggagaagctgcagaagctgcacagcgagatcaagttcgccctgaaggtggacagccccgacgtgaagagatgcctgaacgccctggaggagctgggcaccctgcaggtgaccagccagatcctgcagaagaacaccgacgtggtggccaccctgaagaagatcagaagatacaaggccaacaaggacgtgatggagaaggccgccgaggtgtacaccagactgaagagcagagtgctgggccccaagatcgaggccgtgcagaaggtgaacaaggccggcatggagaaggagaaggccgaggagaagctggccggcgaggagctggccggcgaggagctggccggcgaggaggccccccaggagaaggccgaggacaagcccagcaccgacctgagcgcccccgtgaacggcgaggccaccagccagaagggcgagagcgccgaggacaaggagcacgaggagggcagagacagcgaggagggccccagatgcggcagcagcgaggacctgcacgacagcgtgagagagggccccgacctggacagacccggcagcgacagacaggagagagagagagccagaggcgacagcgaggccctggacgaggagagctag

SEQ ID NO: 8267 - DNA, 1524 bp, Artificial Sequence
  Description of Artificial Sequence: Synthetic coding sequence
atgaagggctacccccactggcccgccagaatcgacgacatcgccgacggcgccgtgaagcccccccccaacaagtaccccatcttcttcttcggcacccacgagaccgccttcctgggccccaaggacctgttcccctacgacaagtgcaaggacaagtacggcaagcccaacaagagaaagggcttcaacgagggcctgtgggagatccagaacaacccccacgccagctacagcgcccccccccccgtgagcagcagcgacagcgaggcccccgaggccaaccccgccgacggcagcgacgccgacgaggacgacgaggacagaggcgtgatggccgtgaccgccgtgaccgccaccgccgccagcgacagaatggagagcgacagcgacagcgacaagagcagcgacaacagcggcctgaagagaaagacccccgccctgaagatgagcgtgagcaagagagccagaaaggccagcagcgacctggaccaggccagcgtgagccccagcgaggaggagaacagcgagagcagcagcgagagcgagaagaccagcgaccaggacttcacccccgagaagaaggccgccgtgagagcccccagaagaggccccctgggcggcagaaagaagaagaaggcccccagcgccagcgacagcgacagcaaggccgacagcgacggcgccaagcccgagcccgtggccatggccagaagcgccagcagcagcagcagcagcagcagcagcagcgacagcgacgtgagcgtgaagaagccccccagaggcagaaagcccgccgagaagcccctgcccaagcccagaggcagaaagcccaagcccgagagaccccccagcagcagcagcagcgacagcgacagcgacgaggtggacagaatcagcgagtggaagagaagagacgaggccagaagaagagagctggaggccagaagaagaagagagcaggaggaggagctgagaagactgagagagcaggagaaggaggagaaggagagaagaagagagagagccgacagaggcgaggccgagagaggcagcggcggcagcagcggcgacgagctgagagaggacgacgagcccgtgaagaagagaggcagaaagggcagaggcagaggcccccccagcagcagcgacagcgagcccgaggccgagctggagagagaggccaagaagagcgccaagaagccccagagcagcagcaccgagcccgccagaaagcccggccagaaggagaagagagtgagacccgaggagaagcagcaggccaagctggagtgcaacggcgtgatcagcgcccactgcaacctgagactgcccggcagcagcgacagccccgccagcgccctgcccagcagctgggactacagacaccccccccccagactggccaacttctgctgcttcagcagacacggcgtgagcagctgctggcccggctggagcagaagccccgaccccgtgatctgccccccccagccccccaaggtgctgggcctgcaggtgtag

SEQ ID NO: 8268 - DNA, 1662 bp, Artificial Sequence
  Description of Artificial Sequence: Synthetic coding sequence
atggccaccgacaccagccagggcgagctggtgcaccccaaggccctgcccctgatcgtgggcgcccagctgatccacgccgacaagctgggcgagaaggtggaggacagcaccatgcccatcagaagaaccgtgaacagcaccagagagaccccccccaagagcaagctggccgagggcgaggaggagaagcccgagcccgacatcagcagcgaggagagcgtgagcaccgtggaggagcaggagaacgagaccccccccgccaccagcagcgaggccgagcagcccaagggcgagcccgagaacgaggagaaggaggagaacaagagcagcgaggagaccaagaaggacgagaaggaccagagcaaggagaaggagaagaaggtgaagaagaccatccccagctgggccaccctgagcgccagccagctggccagagcccagaagcagacccccatggccagcagccccagacccaagatggacgccatcctgaccgaggccatcaaggcctgcttccagaagagcggcgccagcgtggtggccatcagaaagtacatcatccacaagtaccccagcctggagctggagagaagaggctacctgctgaagcaggccctgaagagagagctgaacagaggcgtgatcaagcaggtgaagggcaagggcgccagcggcagcttcgtggtggtgcagaagagcagaaagaccccccagaagagcagaaacagaaagaacagaagcagcgccgtggaccccgagccccaggtgaagctggaggacgtgctgcccctggccttcaccagactgtgcgagcccaaggaggccagctacagcctgatcagaaagtacgtgagccagtactaccccaagctgagagtggacatcagaccccagctgctgaagaacgccctgcagagagccgtggagagaggccagctggagcagatcaccggcaagggcgccagcggcaccttccagctgaagaagagcggcgagaagcccctgctgggcggcagcctgatggagtacgccatcctgagcgccatcgccgccatgaacgagcccaagacctgcagcaccaccgccctgaagaagtacgtgctggagaaccaccccggcaccaacagcaactaccagatgcacctgctgaagaagaccctgcagaagtgcgagaagaacggctggatggagcagatcagcggcaagggcttcagcggcaccttccagctgtgcttcccctactaccccagccccggcgtgctgttccccaagaaggagcccgacgacagcagagacgaggacgaggacgaggacgagagcagcgaggaggacagcgaggacgaggagcccccccccaagagaagactgcagaagaagacccccgccaagagccccggcaaggccgccagcgtgaagcagagaggcagcaagcccgcccccaaggtgagcgccgcccagagaggcaaggccagacccctgcccaagaaggccccccccaaggccaagacccccgccaagaagaccagacccagcagcaccgtgatcaagaagcccagcggcggcagcagcaagaagcccgccaccagcgccagaaaggaggtgaagctgcccggcaagggcaagagcaccatgaagaagagcttcagagtgaagaagtag

SEQ ID NO: 8269 - DNA, 402 bp, Artificial Sequence
  Description of Artificial Sequence: Synthetic coding sequence
atggccaccgacaccagccagggcgagctggtgcaccccaaggccctgcccctgatcgtgggcgcccagctgatccacgccgacaagctgggcgagaaggtggaggacagcaccatgcccatcagaagaaccgtgaacagcaccagagagaccccccccaagagcaagctggccgagggcgaggaggagaagcccgagcccgacatcagcagcgaggagagcgtgagcaccgtggaggagcaggagaacgagaccccccccgccaccagcagcgaggccgagcagcccaagggcgagcccgagaacgaggagaaggaggagaacaagagcagcgaggagaccaagaaggagagagccgacagcatccacagcaccctgttcatcatcggccagaacagctag

SEQ ID NO: 8270 - DNA, 1206 bp, Artificial Sequence
  Description of Artificial Sequence: Synthetic coding sequence
atggccagcagccccagacccaagatggacgccatcctgaccgaggccatcaaggcctgcttccagaagagcggcgccagcgtggtggccatcagaaagtacatcatccacaagtaccccagcctggagctggagagaagaggctacctgctgaagcaggccctgaagagagagctgaacagaggcgtgatcaagcaggtgaagggcaagggcgccagcggcagcttcgtggtggtgcagaagagcagaaagaccccccagaagagcagaaacagaaagaacagaagcagcgccgtggaccccgagccccaggtgaagctggaggacgtgctgcccctggccttcaccagactgtgcgagcccaaggaggccagctacagcctgatcagaaagtacgtgagccagtactaccccaagctgagagtggacatcagaccccagctgctgaagaacgccctgcagagagccgtggagagaggccagctggagcagatcaccggcaagggcgccagcggcaccttccagctgaagaagagcggcgagaagcccctgctgggcggcagcctgatggagtacgccatcctgagcgccatcgccgccatgaacgagcccaagacctgcagcaccaccgccctgaagaagtacgtgctggagaaccaccccggcaccaacagcaactaccagatgcacctgctgaagaagaccctgcagaagtgcgagaagaacggctggatggagcagatcagcggcaagggcttcagcggcaccttccagctgtgcttcccctactaccccagccccggcgtgctgttccccaagaaggagcccgacgacagcagagacgaggacgaggacgaggacgagagcagcgaggaggacagcgaggacgaggagcccccccccaagagaagactgcagaagaagacccccgccaagagccccggcaaggccgccagcgtgaagcagagaggcagcaagcccgcccccaaggtgagcgccgcccagagaggcaaggccagacccctgcccaagaaggccccccccaaggccaagacccccgccaagaagaccagacccagcagcaccgtgatcaagaagcccagcggcggcagcagcaagaagcccgccaccagcgccagaaaggaggtgaagctgcccggcaagggcaagagcaccatgaagaagagcttcagagtgaagaagtag

SEQ ID NO: 8271 - DNA, 1548 bp, Artificial Sequence
  Description of Artificial Sequence: Synthetic coding sequence
atgcccatcagaagaaccgtgaacagcaccagagagaccccccccaagagcaagctggccgagggcgaggaggagaagcccgagcccgacatcagcagcgaggagagcgtgagcaccgtggaggagcaggagaacgagaccccccccgccaccagcagcgaggccgagcagcccaagggcgagcccgagaacgaggagaaggaggagaacaagagcagcgaggagaccaagaaggacgagaaggaccagagcaaggagaaggagaagaaggtgaagaagaccatccccagctgggccaccctgagcgccagccagctggccagagcccagaagcagacccccatggccagcagccccagacccaagatggacgccatcctgaccgaggccatcaaggcctgcttccagaagagcggcgccagcgtggtggccatcagaaagtacatcatccacaagtaccccagcctggagctggagagaagaggctacctgctgaagcaggccctgaagagagagctgaacagaggcgtgatcaagcaggtgaagggcaagggcgccagcggcagcttcgtggtggtgcagaagagcagaaagaccccccagaagagcagaaacagaaagaacagaagcagcgccgtggaccccgagccccaggtgaagctggaggacgtgctgcccctggccttcaccagactgtgcgagcccaaggaggccagctacagcctgatcagaaagtacgtgagccagtactaccccaagctgagagtggacatcagaccccagctgctgaagaacgccctgcagagagccgtggagagaggccagctggagcagatcaccggcaagggcgccagcggcaccttccagctgaagaagagcggcgagaagcccctgctgggcggcagcctgatggagtacgccatcctgagcgccatcgccgccatgaacgagcccaagacctgcagcaccaccgccctgaagaagtacgtgctggagaaccaccccggcaccaacagcaactaccagatgcacctgctgaagaagaccctgcagaagtgcgagaagaacggctggatggagcagatcagcggcaagggcttcagcggcaccttccagctgtgcttcccctactaccccagccccggcgtgctgttccccaagaaggagcccgacgacagcagagacgaggacgaggacgaggacgagagcagcgaggaggacagcgaggacgaggagcccccccccaagagaagactgcagaagaagacccccgccaagagccccggcaaggccgccagcgtgaagcagagaggcagcaagcccgcccccaaggtgagcgccgcccagagaggcaaggccagacccctgcccaagaaggccccccccaaggccaagacccccgccaagaagaccagacccagcagcaccgtgatcaagaagcccagcggcggcagcagcaagaagcccgccaccagcgccagaaaggaggtgaagctgcccggcaagggcaagagcaccatgaagaagagcttcagagtgaagaagtag

SEQ ID NO: 8272 - DNA, 231 bp, Artificial Sequence
  Description of Artificial Sequence: Synthetic coding sequence
atggccaccgacaccagccagggcgagctggtgcaccccaaggccctgcccctgatcgtgggcgcccagctgatccacgccgacaagctgggcgagaaggtggaggacagcaccatgcccatcagaagaaccgtgaacagcaccagagagaccccccccaagagcaagctggccgagggcgaggaggagaagcccgagcccgacatcagcagcgaggagagcgtgagctag

SEQ ID NO: 8273 - DNA, 375 bp, Artificial Sequence
  Description of Artificial Sequence: Synthetic coding sequence
atggccaccgacaccagccagggcgagctggtgcaccccaaggccctgcccctgatcgtgggcgcccagctgatccacgccgacaagctgggcgagaaggtggaggacagcaccatgcccatcagaagaaccgtgaacagcaccagagagaccccccccaagagcaagctggccgagggcgaggaggagaagcccgagcccgacatcagcagcgaggagagcgtgagcaccgtggaggagcaggagaacgagaccccccccgccaccagcagcgaggccgagcagcccaagggcgagcccgagaacgaggagaaggaggagaacaagagcagcgaggagaccaagaaggacgagaaggaccagagcaaggagtag

SEQ ID NO: 8274 - DNA, 123 bp, Artificial Sequence
  Description of Artificial Sequence: Synthetic coding sequence
atgcccatcagaagaaccgtgaacagcaccagagagaccccccccaagagcaagctggccgagggcgaggaggagaagcccgagcccgacatcagcagcgaggagagcgtgagcaccgtgtag

SEQ ID NO: 8275 - DNA, 762 bp, Artificial Sequence
  Description of Artificial Sequence: Synthetic coding sequence
aagaaggacgagaaggaccagagcaaggagaaggagaagaaggtgaagaagaccatccccagctgggccaccctgagcgccagccagctggccagagcccagaagcagacccccatggccagcagccccagacccaagatggacgccatcctgaccgaggccatcaaggcctgcttccagaagagcggcgccagcgtggtggccatcagaaagtacatcatccacaagtaccccagcctggagctggagagaagaggctacctgctgaagcaggccctgaagagagagctgaacagaggcgtgatcaagcagaacagaagcagcgccgtggaccccgagccccaggtgaagctggaggacgtgctgcccctggccttcaccagactgtgcgagcccaaggaggccagctacagcctgatcagaaagtacgtgagccagtactaccccaagctgagagtggacatcagaccccagctgctgaagaacgccctgcagagagccgtggagagaggccagctggagcagatcaccggcaagggcgccagcggcaccttccagctgaagaagagcggcgagaagcccctgctgggcggcagcctgatggagtacgccatcctgagcgccatcgccgccatgaacgagcccaagacctgcagcaccaccgccctgaagaagtacgtgctggagaaccaccccggcaccaacagcaactaccagatgcacctgctgaagaagaccctgcagaagtgcgagaagaactag

SEQ ID NO: 8276 - DNA, 837 bp, Artificial Sequence
  Description of Artificial Sequence: Synthetic coding sequence
atgcccatcagaagaaccgtgaacagcaccagagagaccccccccaagagcaagctggccgagggcgaggaggagaagcccgagcccgacatcagcagcgaggagagcgtgagcaccgtggaggagcaggagaacgagaccccccccgccaccagcagcgaggccgagcagcccaagggcgagcccgagaacgaggagaaggaggagaacaagagcagcgaggagaccaagaaggacgagaaggaccagagcaaggagaaggagaagaaggtgaagaagaccatccccagctgggccaccctgagcgccagccagctggccagagcccagaagcagacccccatggccagcagccccagacccaagatggacgccatcctgaccgaggccatcaaggcctgcttccagaagagcggcgccagcgtggtggccatcagaaagtacatcatccacaagtaccccagcctggagctggagagaagaggctacctgctgaagcaggccctgaagagagagctgaacagaggcgtgatcaagcaggtgaagggcaagggcgccagcggcagcttcgtggtggtgcagaagagcagaaagaccccccagaagagcagaaacagaaagaacagaagcagcgccgtggaccccgagccccaggtgaagctggaggacgtgctgcccctggccttcaccagactgtgcgagcccaaggaggccagctacagcctgatcagaaagtacgtgagccagtactaccccaagctgagagtggacatcagaccccagctgctgaagaacgccctgcagagagccgtggagagaggccagctggagcagtag

SEQ ID NO: 8277 - DNA, 138 bp, Artificial Sequence
  Description of Artificial Sequence: Synthetic coding sequence
atgcccatcagaagaaccgtgaacagcaccagagagaccccccccaagagcaagctggccgagggcgaggaggagaagcccgagcccgacatcagcagcgaggagagcgtgagcaccgtggaggagcaggagaactag

SEQ ID NO: 8278 - DNA, 984 bp, Artificial Sequence
  Description of Artificial Sequence: Synthetic coding sequence
atggccaccgacaccagccagggcgagctggtgcaccccaaggccctgcccctgatcgtgggcgcccagctgatccacgccgacaagctgggcgagaaggtggaggacagcaccatgcccatcagaagaaccgtgaacagcaccagagagaccccccccaagagcaagctggccgagggcgaggaggagaagcccgagcccgacatcagcagcgaggagagcgtgagcaccgtggaggagcaggagaacgagaccccccccgccaccagcagcgaggccgagcagcccaagggcgagcccgagaacgaggagaaggaggagaacaagagcagcgaggagaccaagaaggacgagaaggaccagagcaaggagaaggagaagaaggtgaagaagaccatccccagctgggccaccctgagcgccagccagctggccagagcccagaagcagacccccatggccagcagccccagacccaagatggacgccatcctgaccgaggccatcaaggcctgcttccagaagagcggcgccagcgtggtggccatcagaaagtacatcatccacaagtaccccagcctggagctggagagaagaggctacctgctgaagcaggccctgaagagagagctgaacagaggcgtgatcaagcaggtgaagggcaagggcgccagcggcagcttcgtggtggtgcagaagagcagaaagaccccccagaagagcagaaacagaaagaacagaagcagcgccgtggaccccgagccccaggtgaagctggaggacgtgctgcccctggccttcaccagactgtgcgagcccaaggaggccagctacagcctgatcagaaagtacgtgagccagtactaccccaagctgagagtggacatcagaccccagctgctgaagaacgccctgcagagagccgtggagagaggccagctggagcagatcaccggcaagggcgccagcggcaccttccagtag

SEQ ID NO: 8279 - DNA, 60 bp, Artificial Sequence
  Description of Artificial Sequence: Synthetic coding sequence
atgcccatcagaagaaccgtgaacagcaccagagagaccccccccaagagcaagctgtag

SEQ ID NO: 8280 - DNA, 918 bp, Artificial Sequence
  Description of Artificial Sequence: Synthetic coding sequence
atggagaacagccagctgtgcaagctgttcatcggcggcctgaacgtgcagaccagcgagagcggcctgagaggccacttcgaggccttcggcaccctgaccgactgcgtggtggtggtgaacccccagaccaagagaagcagatgcttcggcttcgtgacctacagcaacgtggaggaggccgacgccgccatggccgccagcccccacgccgtggacggcaacaccgtggagctgaagagagccgtgagcagagaggacagcgccagacccggcgcccacgccaaggtgaagaagctgttcgtgggcggcctgaagggcgacgtggccgagggcgacctgatcgagcacttcagccagttcggcaccgtggagaaggccgagatcatcgccgacaagcagagcggcaagaagagaggcttcggcttcgtgtacttccagaaccacgacgccgccgacaaggccgccgtggtgaagttccaccccatccagggccacagagtggaggtgaagaaggccgtgcccaaggaggacatctacagcggcggcggcggcggcggcagcagaagcagcagaggcggcagaggcggcagaggcagaggcggcggcagagaccagaacggcctgagcaagggcggcggcggcggctacaacagctacggcggctacggcggcggcggcggcggcggctacaacgcctacggcggcggcggcggcggcagcagctacggcggcagcgactacggcaacggcttcggcggcttcggcagctacagccagcaccagagcagctacggccccatgaagagcggcggcggcggcggcggcggcggcagcagctggggcggcagaagcaacagcggcccctacagaggcggctacggcggcggcggcggctacggcggcagcagcttctag

SEQ ID NO: 8281 - DNA, 1107 bp, Artificial Sequence
  Description of Artificial Sequence: Synthetic coding sequence
atgggcaccccccccggcctgcagaccgactgcgaggccctgctgagcagattccaggagaccgacagcgtgagattcgaggacttcaccgagctgtggagaaacatgaagttcggcaccatcttctgcggcagaatgagaaacctggagaagaacatgttcaccaaggaggccctggccctggcctggagatacttcctgcccccctacaccttccagatcagagtgggcgccctgtacctgctgtacggcctgtacaacacccagctgtgccagcccaagcagaagatcagagtggccctgaaggactgggacgaggtgctgaagttccagcaggacctggtgaacgcccagcacttcgacgccgcctacatcttcagaaagctgagactggacagagccttccacttcaccgccatgcccaagctgctgagctacagaatgaagaagaagatccacagagccgaggtgaccgaggagttcaaggaccccagcgacagagtgatgaagctgatcaccagcgacgtgctggaggagatgctgaacgtgcacgaccactaccagaacatgaagcacgtgatcagcgtggacaagagcaagcccgacaaggccctgagcctgatcaaggacgacttcttcgacaacatcaagaacatcgtgctggagcaccagcagtggcacaaggacagaaagaaccccagcctgaagagcaagaccaacgacggcgaggagaagatggagggcaacagccaggagaccgagagatgcgagagagccgagagcctggccaagatcaagagcaaggccttcagcgtggtgatccaggccagcaagagcagaagacacagacaggtgaagctggacagcagcgacagcgacagcgccagcggccagggccaggtgaaggccaccagaaagaaggagaagaaggagagactgaagcccgccggcagaaagatgagcctgagaaacaagggcaacgtgcagaacatccacaaggaggacaagcccctgagcctgagcatgcccgtgatcaccgaggaggaggagaacgagagcctgagcggcaccgagttcaccgccagcaagaagagaagaaagcactag

SEQ ID NO: 8282 - DNA, 921 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagtacggcaagatcgtgggctgcagcgtgcacaagggcttcgccttcgtgcagtacgtgaacgagagaaacgccagagccgccgtggccggcgaggacggcagaatgatcgccggccaggtgctggacatcaacctggccgccgagcccaaggtgaacagaggcaaggccggcgtgaagagaagcgccgccgagatgtacggcagcgtgaccgagcaccccagccccagccccctgctgagcagcagcttcgacctggactacgacttccagagagactactacgacagaatgtacagctaccccgccagagtgcccccccccccccccatcgccagagccgtggtgcccagcaagagacagagagtgagcggcaacaccagcagaagaggcaagagcggcttcaacagcaagagcggccagagaggcagcagcaagagcggcaagctgaagggcgacgacctgcaggccatcaagaaggagctgacccagatcaagcagaaggtggacagcctgctggagaacctggagaagatcgagaaggagcagagcaagcaggccgtggagatgaagaacgacaagagcgaggaggagcagagcagcagcagcgtgaagaaggacgagaccaacgtgaagatggagagcgagggcggcgccgacgacagcgccgaggagggcgacctgctggacgacgacgacaacgaggacagaggcgacgaccagctggagctgatcaaggacgacgagaaggaggccgaggagggcgaggacgacagagacagcgccaacggcgaggacgacagctag

SEQ ID NO: 8283 - DNA, 309 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagaaggacgagaccaacgtgaagatggagagcgagggcggcgccgacgacagcgccgaggagggcgacctgctggacgacgacgacaacgaggacagaggcgacgaccagctggagctgatcaaggacgacgagaaggaggccgaggagggcgaggacgacagagacagcgccaacggcgaggacgacagctag

SEQ ID NO: 8284 - DNA, 921 bp, Artificial Sequence; identical to SEQ ID NO: 8282
  Description of Artificial Sequence: Synthetic coding sequence

SEQ ID NO: 8285 - DNA, 882 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagtacggcaagatcgtgggctgcagcgtgcacaagggcttcgccttcgtgcagtacgtgaacgagagaaacgccagagccgccgtggccggcgaggacggcagaatgatcgccggccaggtgctggacatcaacctggccgccgagcccaaggtgaacagaggcaaggccggcgtgaagagaagcgccgccgagatgtacggcagcagcttcgacctggactacgacttccagagagactactacgacagaatgtacagctaccccgccagagtgcccccccccccccccatcgccagagccgtggtgcccagcaagagacagagagtgagcggcaacaccagcagaagaggcaagagcggcttcaacagcaagagcggccagagaggcagcagcaagagcggcaagctgaagggcgacgacctgcaggccatcaagaaggagctgacccagatcaagcagaaggtggacagcctgctggagaacctggagaagatcgagaaggagcagagcaagcaggccgtggagatgaagaacgacaagagcgaggaggagcagagcagcagcagcgtgaagaaggacgagaccaacgtgaagatggagagcgagggcggcgccgacgacagcgccgaggagggcgacctgctggacgacgacgacaacgaggacagaggcgacgaccagctggagctgatcaaggacgacgagaaggaggccgaggagggcgaggacgacagagacagcgccaacggcgaggacgacagctag

SEQ ID NO: 8286 - DNA, 912 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagtacggcaagatcgtgggctgcagcgtgcacaagggcttcgccttcgtgcagtacgtgaacgagagaaacgccagagccgccgtggccggcgaggacggcagaatgatcgccggccaggtgctggacatcaacctggccgccgagcccaaggtgaacagaggcaaggccggcgtgaagagaagcgccgccgagatgtacggcagcgtgaccgagcaccccagccccagccccctgctgagcagcagcttcgacctggactacgacttccagagagactactacgacagaatgtacagctaccccgccagagtgcccccccccccccccatcgccagagccgtggtgcccagcaagagacagagagtgagcggcaacaccagcagaagaggcaagagcggcttcaacagcaagagcggccagagaggcagcagcaagagcggcaagctgaagggcgacgacctgcaggccatcaagaaggagctgacccagatcaagcagaaggtggacagcctgctggagaacctggagaagatcgagaaggagcagagcaagcaggccgtggagatgaagaacgacaagagcgaggaggagcagagcagcagcagcgtgaagaaggacgagaccaacgtgaagatggagagcgagggcggcgccgacgacagcgccgaggagggcgacctgctggacgacgacgacaacgaggacagaggcgacgaccagctggagctgatcaaggacgacgagaaggaggccgaggagggcgaggacgacagagacagcgccaacggcggctag

SEQ ID NO: 8287 - DNA, 882 bp, Artificial Sequence; identical to SEQ ID NO: 8285
  Description of Artificial Sequence: Synthetic coding sequence

SEQ ID NO: 8288 - DNA, 444 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagtacggcaagatcgtgggctgcagcgtgcacaagggcttcgccttcgtgcagtacgtgaacgagagaaacgccagagccgccgtggccggcgaggacggcagaatgatcgccggccaggtgctggacatcaacctggccgccgagcccaaggtgaacagaggcaaggccggcgtgaagagaagcgccgccgagatgtacggcagcgtgaccgagcaccccagccccagccccctgctgagcgtgtaccaggagaccctgcacgagggcgccaaggtggccagcatcctgagagtggacagcggcgacctgcccagcctggagagctag

SEQ ID NO: 8289 - DNA, 882 bp, Artificial Sequence; identical to SEQ ID NO: 8285
  Description of Artificial Sequence: Synthetic coding sequence

SEQ ID NO: 8290 - DNA, 789 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagtacggcaagatcgtgggctgcagcgtgcacaagggcttcgccttcgtgcagtacgtgaacgagagaaacgccagagccgccgtggccggcgaggacggcagaatgatcgccggccaggtgctggacatcaacctggccgccgagcccaaggtgaacagaggcaaggccggcgtgaagagaagcgccgccgagatgtacggcagcagcttcgacctggactacgacttccagagagactactacgacagaatgtacagctaccccgccagagtgcccccccccccccccatcgccagagccgtggtgcccagcaagagacagagagtgagcggcaacaccagcagaagaggcaagagcggcttcaacagcaagagcggccagagaggcagcagcaagagcggcaagctgaagggcgacgacctgcaggccatcaagaaggagctgacccagatcaagcagaaggtggacagcctgctggagaacctggagaagatcgagaaggagcagagcaagcaggccgtggagatgaagaacgacaagagcgaggaggagcagagcagcagcagcgtgaagaaggacgagaccaacgtgaagatggagagcgagggcggcgccgacgacagcgccgaggagggcgacctgctggacgacgacgacaacgaggacagatag

SEQ ID NO: 8291 - DNA, 921 bp, Artificial Sequence; identical to SEQ ID NO: 8282
  Description of Artificial Sequence: Synthetic coding sequence

SEQ ID NO: 8292 - DNA, 381 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagtacggcaagatcgtgggctgcagcgtgcacaagggcttcgccttcgtgcagtacgtgaacgagagaaacgccagagccgccgtggccggcgaggacggcagaatgatcgccggccaggtgctggacatcaacctggccgccgagcccaaggtgaacagaggcaaggccggcgtgaagagaagcgccgccgagatgtacggcagcagcttcgacctggactacgacttccagagagactactacgacagaatgtacagctactag

SEQ ID NO: 8293 - DNA, 882 bp, Artificial Sequence; identical to SEQ ID NO: 8285
  Description of Artificial Sequence: Synthetic coding sequence

SEQ ID NO: 8294 - DNA, 528 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagtacggcaagatcgtgggctgcagcgtgcacaagggcttcgccttcgtgcagtacgtgaacgagagaaacgccagagccgccgtggccggcgaggacggcagaatgatcgccggccaggtgctggacatcaacctggccgccgagcccaaggtgaacagaggcaaggccggcgtgaagagaagcgccgccgagatgtacggcagcgtgaccgagcaccccagccccagccccctgctgagcagcagcttcgacctggactacgacttccagagagactactacgacagaatgtacagctaccccgccagagtgcccccccccccccccatcgccagagccgtggtgcccagcaagagacagagagtgagcggcaacaccagcagaagaggcaagagcggcttcaacagctag

SEQ ID NO: 8295 - DNA, 354 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagtacggcaagatcgtgggctgcagcgtgcacaagggcttcgccttcgtgcagtacgtgaacgagagaaacgccagagccgccgtggccggcgaggacggcagaatgatcgccggccaggtgctggacatcaacctggccgccgagcccaaggtgaacagaggcaaggccggcgtgaagagaagcgccgccgagatgtacggcagcagcttcgacctggactacgacttccagagatag

SEQ ID NO: 8296 - DNA, 564 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagtacggcaagatcgtgggctgcagcgtgcacaagggcttcgccttcgtgcagtacgtgaacgagagaaacgccagagccgccgtggccggcgaggacggcagaatgatcgccggccaggtgctggacatcaacctggccgccgagcccaaggtgaacagaggcaaggccggcgtgaagagaagcgccgccgagatgtacggcagcgtgaccgagcaccccagccccagccccctgctgagcagcagcttcgacctggactacgacttccagagagactactacgacagaatgtacagctaccccgccagagtgcccccccccccccccatcgccagagccgtggtgcccagcaagagacagagagtgagcggcaacaccagcagaagaggcaagagcggcttcaacagcaagagcggccagagaggcagcagcaagagcggcaagtag

SEQ ID NO: 8297 - DNA, 753 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagtacggcaagatcgtgggctgcagcgtgcacaagggcttcgccttcgtgcagtacgtgaacgagagaaacgccagagccgccgtggccggcgaggacggcagaatgatcgccggccaggtgctggacatcaacctggccgccgagcccaaggtgaacagaggcaaggccggcgtgaagagaagcgccgccgagatgtacggcagcagcttcgacctggactacgacttccagagagactactacgacagaatgtacagctaccccgccagagtgcccccccccccccccatcgccagagccatcaagaaggagctgacccagatcaagcagaaggtggacagcctgctggagaacctggagaagatcgagaaggagcagagcaagcaggccgtggagatgaagaacgacaagagcgaggaggagcagagcagcagcagcgtgaagaaggacgagaccaacgtgaagatggagagcgagggcggcgccgacgacagcgccgaggagggcgacctgctggacgacgacgacaacgaggacagaggcgacgaccagctggagctgatcaaggacgacgagaaggaggccgaggagggcgaggacgacagagacagcgccaacggcgaggacgacagctag

SEQ ID NO: 8298 - DNA, 366 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagtacggcaagatcgtgggctgcagcgtgcacaagggcttcgccttcgtgcagtacgtgaacgagagaaacgccagagccgccgtggccggcgaggacggcagaatgatcgccggccaggtgctggacatcaacctggccgccgagcccaaggtgaacagaggcaaggccggcgtgaagagaagcgccgccgagatgtacggcagcagcttcgacctggactacgacttccagagagactactacgactag

SEQ ID NO: 8299 - DNA, 681 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaacagcagcttcgacctggactacgacttccagagagactactacgacagaatgtacagctaccccgccagagtgcccccccccccccccatcgccagagccgtggtgcccagcaagagacagagagtgagcggcaacaccagcagaagaggcaagagcggcttcaacagcaagagcggccagagaggcagcagcaagagcggcaagctgaagggcgacgacctgcaggccatcaagaaggagctgacccagatcaagcagaaggtggacagcctgctggagaacctggagaagatcgagaaggagcagagcaagcaggccgtggagatgaagaacgacaagagcgaggaggagcagagcagcagcagcgtgaagaaggacgagaccaacgtgaagatggagagcgagggcggcgccgacgacagcgccgaggagggcgacctgctggacgacgacgacaacgaggacagaggcgacgaccagctggagctgatcaaggacgacgagaaggaggccgaggagggcgaggacgacagagacagcgccaacggcgaggacgacagctag

SEQ ID NO: 8300 - DNA, 882 bp, Artificial Sequence; identical to SEQ ID NO: 8285
  Description of Artificial Sequence: Synthetic coding sequence

SEQ ID NO: 8301 - DNA, 921 bp, Artificial Sequence; identical to SEQ ID NO: 8282
  Description of Artificial Sequence: Synthetic coding sequence

SEQ ID NO: 8302 - DNA, 201 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagtacggcaagatcgtgggctgcagcgtgcacaagggcttcgccttcgtgcagtacgtgaacgagagaaacgccagagccgcctag

SEQ ID NO: 8303 - DNA, 444 bp, Artificial Sequence; identical to SEQ ID NO: 8288
  Description of Artificial Sequence: Synthetic coding sequence

SEQ ID NO: 8304 - DNA, 165 bp, Artificial Sequence
  Description of Artificial Sequence: Synthetic coding sequence
atggccagcaacgtgaccaacaagaccgaccccagaagcatgaacagcagagtgttcatcggcaacctgaacaccctggtggtgaagaagagcgacgtggaggccatcttcagcaagtacggcaagatcgtgggctgcagcgtgcacaagggcttcgccttctag

SEQ ID NO: 8305 - DNA, 882 bp, Artificial Sequence
  Description of Artificial Sequence: Synthetic coding sequence
atggccagcaacgtgaccaacaagatggacccccacagcatgaacagcagagtgttcatcggcaacctgaacaccctggtggtgaagaagagcgacgtggaggccatcttcagcaagtacggcaagatcgccggctgcagcgtgcacaagggcttcgccttcgtgcagtacgacaaggagaagaacgccagagccgccgtggccggcgaggacggcagaatgatcgccagccaggtggtggacatcaacctggccgccgagcccaaggtgaacagaggcaacgccggcgtgaagagaagcgccgccgagatgtacggcagcagcttcgacctggactacggcttccagagagactactacgacggcatgtacagcttccccgccagagtgcccccccccccccccatcgccctggccgtggtgcccagcaagagacagagactgagcggcaacaccagcagaagaggcaagagcggcttcaacagcaagagcggcaagagaggcagcagcaagagcggcaagctgaagggcgacgacctgcaggccatcaagcaggagctgacccagatcaagcagaaggtggacagcctgctggagaacctggagaagatcgagaaggagcagagcaagcaggaggtggaggtgaagaacgccaagagcgaggaggagcagagcagcagcagcatgaagaaggacgagacccacgtgaagatggagagcgagggcggcgccgaggacagcgccgaggagggcgaccccctggacgacgacgtgaacgaggaccagggcgacgaccagctggagctgatcaaggacgacgagaaggaggccgaggagggcgaggacgacagagacagcaccaacggccaggacgacagctag

SEQ ID NO: 8306 - DNA, 1041 bp, Artificial Sequence
  Description of Artificial Sequence: Synthetic coding sequence
atggactgggtgatgaagcacaacggccccaacgacgccagcgacggcaccgtgagactgagaggcctgcccttcggctgcagcaaggaggagatcgtgcagttcttccagggcctggagatcgtgcccaacggcatcaccctgaccatggactaccagggcagaagcaccggcgaggccttcgtgcagttcgccagcaaggagatcgccgagaacgccctgggcaagcacaaggagagaatcggccacagatacatcgagatcttcagaagcagcagaagcgagatcaagggcttctacgacccccccagaagactgctgggccagagacccggcccctacgacagacccatcggcggcagaggcggctactacggcgccggcagaggcagcatgtacgacagaatgagaagaggcggcgacggctacgacggcggctacggcggcttcgacgactacggcggctacaacaactacggctacggcaacgacggcttcgacgacagaatgagagacggcagaggcatgggcggccacggctacggcggcgccggcgacgccagcagcggcttccacggcggccacttcgtgcacatgagaggcctgcccttcagagccaccgagaacgacatcgccaacttcttcagccccctgaaccccatcagagtgcacatcgacatcggcgccgacggcagagccaccggcgaggccgacgtggagttcgtgacccacgaggacgccgtggccgccatgagcaaggacaagaacaacatgcagcacagatacatcgagctgttcctgaacagcacccccggcggcggcagcggcatgggcggcagcggcatgggcggctacggcagagacggcatggacaaccagggcggctacggcagcgtgggcagaatgggcatgggcaacaactacagcggcggctacggcacccccgacggcctgggcggctacggcagaggcggcggcggcagcggcggctactacggccagggcggcatgagcggcggcggctggagaggcatgtactag

SEQ ID NO: 8307 - DNA, 996 bp, Artificial Sequence
  Description of Artificial Sequence: Synthetic coding sequence
atggactgggtgatgaagcacaacggccccaacgacgccagcgacggcaccgtgagactgagaggcctgcccttcggctgcagcaaggaggagatcgtgcagttcttccagggcctggagatcgtgcccaacggcatcaccctgaccatggactaccagggcagaagcaccggcgaggccttcgtgcagttcgccagcaaggagatcgccgagaacgccctgggcaagcacaaggagagaatcggccacagatacatcgagatcttcagaagcagcagaagcgagatcaagggcttctacgacccccccagaagactgctgggccagagacccggcccctacgacagacccatcggcggcagaggcggctactacggcgccggcagaggcagctacggcggcttcgacgactacggcggctacaacaactacggctacggcaacgacggcttcgacgacagaatgagagacggcagaggcatgggcggccacggctacggcggcgccggcgacgccagcagcggcttccacggcggccacttcgtgcacatgagaggcctgcccttcagagccaccgagaacgacatcgccaacttcttcagccccctgaaccccatcagagtgcacatcgacatcggcgccgacggcagagccaccggcgaggccgacgtggagttcgtgacccacgaggacgccgtggccgccatgagcaaggacaagaacaacatgcagcacagatacatcgagctgttcctgaacagcacccccggcggcggcagcggcatgggcggcagcggcatgggcggctacggcagagacggcatggacaaccagggcggctacggcagcgtgggcagaatgggcatgggcaacaactacagcggcggctacggcacccccgacggcctgggcggctacggcagaggcggcggcggcagcggcggctactacggccagggcggcatgagcggcggcggctggagaggcatgtactag

SEQ ID NO: 8308 - DNA, 717 bp, Artificial Sequence
  Description of Artificial Sequence: Synthetic coding sequence
atggactgggtgatgaagcacaacggccccaacgacgccagcgacggcaccgtgagactgagaggcctgcccttcggctgcagcaaggaggagatcgtgcagttcttccagggctacggcggcttcgacgactacggcggctacaacaactacggctacggcaacgacggcttcgacgacagaatgagagacggcagaggcatgggcggccacggctacggcggcgccggcgacgccagcagcggcttccacggcggccacttcgtgcacatgagaggcctgcccttcagagccaccgagaacgacatcgccaacttcttcagccccctgaaccccatcagagtgcacatcgacatcggcgccgacggcagagccaccggcgaggccgacgtggagttcgtgacccacgaggacgccgtggccgccatgagcaaggacaagaacaacatgcagcacagatacatcgagctgttcctgaacagcacccccggcggcggcagcggcatgggcggcagcggcatgggcggctacggcagagacggcatggacaaccagggcggctacggcagcgtgggcagaatgggcatgggcaacaactacagcggcggctacggcacccccgacggcctgggcggctacggcagaggcggcggcggcagcggcggctactacggccagggcggcatgagcggcggcggctggagaggcatgtactag

SEQ ID NO: 8309 - DNA, 1392 bp, Artificial Sequence
  Description of Artificial Sequence: Synthetic coding sequence
atggagaccgagcagcccgaggagaccttccccaacaccgagaccaacggcgagttcggcaagagacccgccgaggacatggaggaggagcaggccttcaagagaagcagaaacaccgacgagatggtggagctgagaatcctgctgcagagcaagaacgccggcgccgtgatcggcaagggcggcaagaacatcaaggccctgagaaccgactacaacgccagcgtgagcgtgcccgacagcagcggccccgagagaatcctgagcatcagcgccgacatcgagaccatcggcgagatcctgaagaagatcatccccaccctggaggagggcctgcagctgcccagccccaccgccaccagccagctgcccctggagagcgacgccgtggagtgcctgaactaccagcactacaagggcagcgacttcgactgcgagctgagactgctgatccaccagagcctggccggcggcatcatcggcgtgaagggcgccaagatcaaggagctgagagagaacacccagaccaccatcaagctgttccaggagtgctgcccccacagcaccgacagagtggtgctgatcggcggcaagcccgacagagtggtggagtgcatcaagatcatcctggacctgatcagcgagagccccatcaagggcagagcccagccctacgaccccaacttctacgacgagacctacgactacggcggcttcaccatgatgttcgacgacagaagaggcagacccgtgggcttccccatgagaggcagaggcggcttcgacagaatgccccccggcagaggcggcagacccatgccccccagcagaagagactacgacgacatgagccccagaagaggcccccccccccccccccccggcagaggcggcagaggcggcagcagagccagaaacctgcccctgccccccccccccccccccagaggcggcgacctgatggcctacgacagaagaggcagacccggcgacagatacgacggcatggtgggcttcagcgccgacgagacctgggacagcgccatcgacacctggagccccagcgagtggcagatggcctacgagccccagggcggcagcggctacgactacagctacgccggcggcagaggcagctacggcgacctgggcggccccatcatcaccacccaggtgaccatccccaaggacctggccggcagcatcatcggcaagggcggccagagaatcaagcagatcagacacgagagcggcgccagcatcaagatcgacgagcccctggagggcagcgaggacagaatcatcaccatcaccggcacccaggaccagatccagaacgcccagtacctgctgcagaacagcgtgaagcagtacagcggcaagttcttctag

SEQ ID NO: 8310 - DNA, 1392 bp, Artificial Sequence; identical to SEQ ID NO: 8309
  Description of Artificial Sequence: Synthetic coding sequence

SEQ ID NO: 8311 - DNA, 921 bp, Artificial Sequence
  Description of Artificial Sequence: Synthetic coding sequence
atgcagtacaacgccagcgtgagcgtgcccgacagcagcggccccgagagaatcctgagcatcagcgccgacatcgagaccatcggcgagatcctgaagaagatcatccccaccctggaggagggcctgcagctgcccagccccaccgccaccagccagctgcccctggagagcgacgccgtggagtgcctgaactaccagcactacaagggcagcgacttcgactgcgagctgagactgctgatccaccagagcctggccggcggcatcatcggcgtgaagggcgccaagatcaaggagctgagagagaacacccagaccaccatcaagctgttccaggagtgctgcccccacagcaccgacagagtggtgctgatcggcggcaagcccgacagagtggtggagtgcatcaagatcatcctggacctgatcagcgagagccccatcaagggcagagcccagccctacgaccccaacttctacgacgagacctacgactacggcggcttcaccatgatgttcgacgacagaagaggcagacccgtgggcttccccatgagaggcagaggcggcttcgacagaatgccccccggcagaggcggcagacccatgccccccagcagaagagactacgacgacatgagccccagaagaggcccccccccccccccccccggcagaggcggcagaggcggcagcagagccagaaacctgcccctgccccccccccccccccccagaggcggcgacctgatggcctacgacagaagaggcagacccggcgacagatacgacggcatggtgggcttcagcgccgacgagacctgggacagcgccatcgacacctggagccccagcgagtggcagatggcctacgagccccaggtggagtaccacagctgcagctgcgtgtaccagtag

SEQ ID NO: 8312 - DNA, 1380 bp, Artificial Sequence
  Description of Artificial Sequence: Synthetic coding sequence
atggagaccgagcagcccgaggagaccttccccaacaccgagaccaacggcgagttcggcaagagacccgccgaggacatggaggaggagcaggccttcaagagaagcagaaacaccgacgagatggtggagctgagaatcctgctgcagagcaagaacgccggcgccgtgatcggcaagggcggcaagaacatcaaggccctgagaaccgactactacctggtgttcgtggtgttcgacagcatcctgagcatcagcgccgacatcgagaccatcggcgagatcctgaagaagatcatccccaccctggaggagggcctgcagctgcccagccccaccgccaccagccagctgcccctggagagcgacgccgtggagtgcctgaactaccagcactacaagggcagcgacttcgactgcgagctgagactgctgatccaccagagcctggccggcggcatcatcggcgtgaagggcgccaagatcaaggagctgagagagaacacccagaccaccatcaagctgttccaggagtgctgcccccacagcaccgacagagtggtgctgatcggcggcaagcccgacagagtggtggagtgcatcaagatcatcctggacctgatcagcgagagccccatcaagggcagagcccagccctacgaccccaacttctacgacgagacctacgactacggcggcttcaccatgatgttcgacgacagaagaggcagacccgtgggcttccccatgagaggcagaggcggcttcgacagaatgccccccggcagaggcggcagacccatgccccccagcagaagagactacgacgacatgagccccagaagaggcccccccccccccccccccggcagaggcggcagaggcggcagcagagccagaaacctgcccctgccccccccccccccccccagaggcggcgacctgatggcctacgacagaagaggcagacccggcgacagatacgacggcatggtgggcttcagcgccgacgagacctgggacagcgccatcgacacctggagccccagcgagtggcagatggcctacgagccccagggcggcagcggctacgactacagctacgccggcggcagaggcagctacggcgacctgggcggccccatcatcaccacccaggtgaccatccccaaggacctggccggcagcatcatcggcaagggcggccagagaatcaagcagatcagacacgagagcggcgccagcatcaagatcgacgagcccctggagggcagcgaggacagaatcatcaccatcaccggcacccaggaccagatccagaacgcccagtacctgctgcagaacagcgtgaagcagtacgccgacgtggagggcttctag

SEQ ID NO: 8313 - DNA, 1395 bp, Artificial Sequence
  Description of Artificial Sequence: Synthetic coding sequence
atggagaccgagcagcccgaggagaccttccccaacaccgagaccaacggcgagttcggcaagagacccgccgaggacatggaggaggagcaggccttcaagagaagcagaaacaccgacgagatggtggagctgagaatcctgctgcagagcaagaacgccggcgccgtgatcggcaagggcggcaagaacatcaaggccctgagaaccgactacaacgccagcgtgagcgtgcccgacagcagcggccccgagagaatcctgagcatcagcgccgacatcgagaccatcggcgagatcctgaagaagatcatccccaccctggaggagggcctgcagctgcccagccccaccgccaccagccagctgcccctggagagcgacgccgtggagtgcctgaactaccagcactacaagggcagcgacttcgactgcgagctgagactgctgatccaccagagcctggccggcggcatcatcggcgtgaagggcgccaagatcaaggagctgagagagaacacccagaccaccatcaagctgttccaggagtgctgcccccacagcaccgacagagtggtgctgatcggcggcaagcccgacagagtggtggagtgcatcaagatcatcctggacctgatcagcgagagccccatcaagggcagagcccagccctacgaccccaacttctacgacgagacctacgactacggcggcttcaccatgatgttcgacgacagaagaggcagacccgtgggcttccccatgagaggcagaggcggcttcgacagaatgccccccggcagaggcggcagacccatgccccccagcagaagagactacgacgacatgagccccagaagaggcccccccccccccccccccggcagaggcggcagaggcggcagcagagccagaaacctgcccctgccccccccccccccccccagaggcggcgacctgatggcctacgacagaagaggcagacccggcgacagatacgacggcatggtgggcttcagcgccgacgagacctgggacagcgccatcgacacctggagccccagcgagtggcagatggcctacgagccccagggcggcagcggctacgactacagctacgccggcggcagaggcagctacggcgacctgggcggccccatcatcaccacccaggtgaccatccccaaggacctggccggcagcatcatcggcaagggcggccagagaatcaagcagatcagacacgagagcggcgccagcatcaagatcgacgagcccctggagggcagcgaggacagaatcatcaccatcaccggcacccaggaccagatccagaacgcccagtacctgctgcagaacagcgtgaagcagtacgccgacgtggagggcttctag

SEQ ID NO: 8314 - DNA, 1392 bp, Artificial Sequence; identical to SEQ ID NO: 8309
  Description of Artificial Sequence: Synthetic coding sequence

SEQ ID NO: 8315 - DNA, 1395 bp, Artificial Sequence; identical to SEQ ID NO: 8313
  Description of Artificial Sequence: Synthetic coding sequence

SEQ ID NO: 8316 - DNA, 1395 bp, Artificial Sequence; identical to SEQ ID NO: 8313
  Description of Artificial Sequence: Synthetic coding sequence

SEQ ID NO: 8317 - DNA, 1287 bp, Artificial Sequence
  Description of Artificial Sequence: Synthetic coding sequence
atggagaccgagcagcccgaggagaccttccccaacaccgagaccaacggcgagttcggcaagagacccgccgaggacatggaggaggagcaggccttcaagagaagcagaaacaccgacgagatggtggagctgagaatcctgctgcagagcaagaacatcaaggccctgagaaccgactacaacgccagcgtgagcgtgcccgacagcagcggccccgagagaatcctgagcatcagcgccgacatcgagaccatcggcgagatcctgaagaagatcatccccaccctggaggagtaccagcactacaagggcagcgacttcgactgcgagctgagactgctgatccaccagagcctggccggcggcatcatcggcgtgaagggcgccaagatcaaggagctgagagagaacacccagaccaccatcaagctgttccaggagtgctgcccccacagcaccgacagagtggtgctgatcggcggcaagcccgacagagtggtggagtgcatcaagatcatcctggacctgatcagcgagagccccatcaagggcagagcccagccctacgaccccaacttctacgacgagacctacgactacggcggcttcaccatgatgttcgacgacagaagaggcagacccgtgggcttccccatgagaggcagaggcggcttcgacagaatgccccccggcagaggcggcagacccatgccccccagcagaagagactacgacgacatgagccccagaagaggcccccccccccccccccccggcagaggcggcagaggcggcagcagagccagaaacctgcccctgccccccccccccccccccagaggcggcgacctgatggcctacgacagaagaggcagacccggcgacagatacgacggcatggtgggcttcagcgccgacgagacctgggacagcgccatcgacacctggagccccagcgagtggcagatggcctacgagccccagggcggcagcggctacgactacagctacgccggcggcagaggcagctacggcgacctgggcggccccatcatcaccacccaggtgaccatccccaaggacctggccggcagcatcatcggcaagggcggccagagaatcaagcagatcagacacgagagcggcgccagcatcaagatcgacgagcccctggagggcagcgaggacagaatcatcaccatcaccggcacccaggaccagatccagaacgcccagtacctgctgcagaacagcgtgaagcagtacagcggcaagttcttctag

SEQ ID NO: 8318 - DNA, 1140 bp, Artificial Sequence
  Description of Artificial Sequence: Synthetic coding sequence
atggagaccgagcagcccgaggagaccttccccaacaccgagaccaacggcgagttcggcaagagacccgccgaggacatggaggaggagcaggccttcaagagaagcagaaacaccgacgagatggtggagctgagaatcctgctgcagagcaagaacgccggcgccgtgatcggcaagggcggcaagaacatcaaggccctgagaaccgactacaacgccagcgtgagcgtgcccgacagcagcggccccgagagaatcctgagcatcagcgccgacatcgagaccatcggcgagatcctgaagaagatcatccccaccctggaggagtaccagcactacaagggcagcgacttcgactgcgagctgagactgctgatccaccagagcctggccggcggcatcatcggcgtgaagggcgccaagatcaaggagctgagagagaacacccagaccaccatcaagctgttccaggagtgctgcccccacagcaccgacagagtggtgctgatcggcggcaagcccgacagagtggtggagtgcatcaagatcatcctggacctgatcagcgagagccccatcaagggcagagcccagccctacgaccccaacttctacgacgagacctacgactacggcggcttcaccatgatgttcgacgacagaagaggcagacccgtgggcttccccatgagaggcagaggcggcttcgacagaatgccccccggcagaggcggcagacccatgccccccagcagaagagactacgacgacatgagccccagaagaggcccccccccccccccccccggcagaggcggcagaggcggcagcagagccagaaacctgcccctgccccccccccccccccccagaggcggcgacctgatggcctacgacagaagaggcagacccggcgacagatacgacggcatggtgggcttcagcgccgacgagacctgggacagcgccatcgacacctggagccccagcgagtggcagatggcctacgagccccagggcggcagcggctacgactacagctacgccggcggcagaggcagctacggcgacctgggcggccccatcatcaccacccaggtgaccatccccaaggacctggccggcagcatcatctag

SEQ ID NO: 8319 - DNA, 987 bp, Artificial Sequence
  Description of Artificial Sequence: Synthetic coding sequence
atggccgccggcatcgtggccagcagaagactgagagacctgctgaccagaagactgaccggcagcaactaccccggcctgagcatcagcctgagactgaccggcagcagcgcccaggaggaggccagcggcgtggccctgggcgaggcccccgaccacagctacgagagcctgagagtgaccagcgcccagaagcacgtgctgcacgtgcagctgaacagacccaacaagagaaacgccatgaacaaggtgttctggagagagatggtggagtgcttcaacaagatcagcagagacgccgactgcagagccgtggtgatcagcggcgccggcaagatgttcaccgccggcatcgacctgatggacatggccagcgacatcctgcagcccaagggcgacgacgtggccagaatcagctggtacctgagagacatcatcaccagataccaggagaccttcaacgtgatcgagagatgccccaagcccgtgatcgccgccgtgcacggcggctgcatcggcggcggcgtggacctggtgaccgcctgcgacatcagatactgcgcccaggacgccttcttccaggtgaaggaggtggacgtgggcctggccgccgacgtgggcaccctgcagagactgcccaaggtgatcggcaaccagagcctggtgaacgagctggccttcaccgccagaaagatgatggccgacgaggccctgggcagcggcctggtgagcagagtgttccccgacaaggaggtgatgctggacgccgccctggccctggccgccgagatcagcagcaagagccccgtggccgtgcagagcaccaaggtgaacctgctgtacagcagagaccacagcgtggccgagagcctgaactacgtggccagctggaacatgagcatgctgcagacccaggacctggtgaagagcgtgcaggccaccaccgagaacaaggagctgaagaccgtgaccttcagcaagctgtag

SEQ ID NO: 8320 - DNA, 1371 bp, Artificial Sequence
  Description of Artificial Sequence: Synthetic coding sequence
atgcccaagaagagacaggccctggtggagttcgaggacgtgctgggcgcctgcaacgccgtgaactacgccgccgacaaccagatctacatcgccggccaccccgccttcgtgaactacagcaccagccagaagatcagcagacccggcgacagcgacgacagcagaagcgtgaacagcgtgctgctgttcaccatcctgaaccccatctacagcatcaccaccgacgtgctgtacaccatctgcaacccctgcggccccgtgcagagaatcgtgatcttcagaaagaacggcgtgcaggccatggtggagttcgacagcgtgcagagcgcccagagagccaaggccagcctgaacggcgccgacatctacagcggctgctgcaccctgaagatcgagtacgccaagcccaccagactgaacgtgttcaagaacgaccaggacacctgggactacaccaaccccaacctgagcggccagggcgaccccggcagcaaccccaacaagagacagagacagccccccctgctgggcgaccaccccgccgagtacggcggcccccacggcggctaccacagccactaccacgacgagggctacggccccccccccccccactacgagggcagaagaatgggcccccccgtgggcggccacagaagaggccccagcagatacggcccccagtacggccacccccccccccccccccccccccccgagtacggcccccacgccgacagccccgtgctgatggtgtacggcctggaccagagcaagatgaactgcgacagagtgttcaacgtgttctgcctgtacggcaacgtggagaaggtgaagttcatgaagagcaagcccggcgccgccatggtggagatggccgacggctacgccgtggacagagccatcacccacctgaacaacaacttcatgttcggccagaagctgaacgtgtgcgtgagcaagcagcccgccatcatgcccggccagagctacggcctggaggacggcagctgcagctacaaggacttcagcgagagcagaaacaacagattcagcacccccgagcaggccgccaagaacagaatccagcaccccagcaacgtgctgcacttcttcaacgcccccctggaggtgaccgaggagaacttcttcgagatctgcgacgagctgggcgtgaagagacccagcagcgtgaaggtgttcagcggcaagagcgagagaagcagcagcggcctgctggagtgggagagcaagagcgacgccctggagaccctgggcttcctgaaccactaccagatgaagaaccccaacggcccctacccctacaccctgaagctgtgcttcagcaccgcccagcacgccagctag

SEQ ID NO: 8321 - DNA, 1371 bp, Artificial Sequence; identical to SEQ ID NO: 8320
  Description of Artificial Sequence: Synthetic coding sequence

SEQ ID NO: 8322 - DNA, 540 bp, Artificial Sequence
  Description of Artificial Sequence: Synthetic coding sequence
atgcccaagaagagacaggccctggtggagttcgaggacgtgctgggcgcctgcaacgccgtgaactacgccgccgacaaccagatctacatcgccggccaccccgccttcgtgaactacagcaccagccagaagatcagcagacccggcgacagcgacgacagcagaagcgtgaacagcgtgctgctgttcaccatcctgaaccccatctacagcatcaccaccgacgtgctgtacaccatctgcaacccctgcggccccgtgcagagaatcgtgatcttcagaaagaacggcgtgcaggccatggtggagttcgacagcgtgcagagcgcccagagagccaaggccagcctgaacggcgccgacatctacagcggctgctgcaccctgaagatcgagtacgccaagcccaccagactgaacgtgttcaagaacgaccaggacacctgggactacaccaaccccaacctgagcggccagggcagccagtgcatgttcgacggcacccccagcttcagaaccgtgctgacccactgctag

SEQ ID NO: 8323 - DNA, 723 bp, Artificial Sequence
  Description of Artificial Sequence: Synthetic coding sequence
atggtgaagatggccgccgccggcggcggcggcggcggcggcagatactacggcggcggcagcgagggcggcagagcccccgccagccccgtggtgcacatcagaggcctgatcgacggcgtggtggaggccgacctggtggaggccctgcaggagttcggccccatcagctacgtggtggtgatgcccaagaagagacaggccctggtggagttcgaggacgtgctgggcgcctgcaacgccgtgaactacgccgccgacaaccagatctacatcgccggccaccccgccttcgtgaactacagcaccagccagaagatcagcagacccggcgacagcgacgacagcagaagcgtgaacagcgtgctgctgttcaccatcctgaaccccatctacagcatcaccaccgacgtgctgtacaccatctgcaacccctgcggccccgtgcagagaatcgtgatcttcagaaagaacggcgtgcaggccatggtggagttcgacagcgtgcagagcgcccagagagccaaggccagcctgaacggcgccgacatctacagcggctgctgcaccctgaagatcgagtacgccaagcccaccagactgaacgtgttcaagaacgaccaggacacctgggactacaccaaccccaacctgagcggccagggcagccagtgcatgttcgacggcacccccagcttcagaaccgtgctgacccactgctag

SEQ ID NO: 8324 - DNA, 849 bp, Artificial Sequence
  Description of Artificial Sequence: Synthetic coding sequence
atgagcagcagcagcagcagccccagagagacctacgaggaggacagagagtacgagagccaggccaagagactgaagaccgaggagggcgagatcgactacagcgccgaggagggcgagaacagaagagaggccacccccagaggcggcggcgacggcggcggcggcggcagaagcttcagccagcccgaggccggcggcagccaccacaaggtgagcgtgagccccgtggtgcacgtgagaggcctgtgcgagagcgtggtggaggccgacctggtggaggccctggagaagttcggcaccatctgctacgtgatgatgatgcccttcaagagacaggccctggtggagttcgagaacatcgacagcgccaaggagtgcgtgaccttcgccgccgacgagcccgtgtacatcgccggccagcaggccttcttcaactacagcaccagcaagagaatcaccagacccggcaacaccgacgaccccagcggcggcaacaaggtgctgctgctgagcatccagaaccccctgtaccccatcaccgtggacgtgctgtacaccgtgtgcaaccccgtgggcaaggtgcagagaatcgtgatcttcaagagaaacggcatccaggccatgctgatgttcgagagcgtgctgtgcgcccagaaggccaaggccgccctgaacggcgccgacatctacgccggctgctgcaccctgaagatcgagtacgccagacccaccagactgaacgtgatcagaaacgacaacgacagctgggactacaccaagccctacctgggcagaagaggctgctgctggctgatgctgaagctgctggagagaagccccctgtag

SEQ ID NO: 8325 - DNA, 1527 bp, Artificial Sequence
  Description of Artificial Sequence: Synthetic coding sequence
atgagcagcagcagcagcagccccagagagacctacgaggaggacagagagtacgagagccaggccaagagactgaagaccgaggagggcgagatcgactacagcgccgaggagggcgagaacagaagagaggccacccccagaggcggcggcgacggcggcggcggcggcagaagcttcagccagcccgaggccggcggcagccaccacaaggtgagcgtgagccccgtggtgcacgtgagaggcctgtgcgagagcgtggtggaggccgacctggtggaggccctggagaagttcggcaccatctgctacgtgatgatgatgcccttcaagagacaggccctggtggagttcgagaacatcgacagcgccaaggagtgcgtgaccttcgccgccgacgagcccgtgtacatcgccggccagcaggccttcttcaactacagcaccagcaagagaatcaccagacccggcaacaccgacgaccccagcggcggcaacaaggtgctgctgctgagcatccagaaccccctgtaccccatcaccgtggacgtgctgtacaccgtgtgcaaccccgtgggcaaggtgcagagaatcgtgatcttcaagagaaacggcatccaggccatgcccaccagactgaacgtgatcagaaacgacaacgacagctgggactacaccaagccctacctgggcagaagagacagaggcaagggcagacagagacaggccatcctgggcgagcaccccagcagcttcagacacgacggctacggcagccacggccccctgctgcccctgcccagcagatacagaatgggcagcagagacacccccgagctggtggcctaccccctgccccaggccagcagcagctacatgcacggcggcaaccccagcggcagcgtggtgatggtgagcggcctgcaccagctgaagatgaactgcagcagagtgttcaacctgttctgcctgtacggcaacatcgagaaggtgaagttcatgaagaccatccccggcaccgccctggtggagatgggcgacgagtacgccgtggagagagccgtgacccacctgaacaacgtgaagctgttcggcaagagactgaacgtgtgcgtgagcaagcagcacagcgtggtgcccagccagatcttcgagctggaggacggcaccagcagctacaaggacttcgccatgagcaagaacaacagattcaccagcgccggccaggccagcaagaacatcatccagccccccagctgcgtgctgcactactacaacgtgcccctgtgcgtgaccgaggagaccttcaccaagctgtgcaacgaccacgaggtgctgaccttcatcaagtacaaggtgttcgacgccaagcccagcgccaagaccctgagcggcctgctggagtgggagtgcaagaccgacgccgtggaggccctgaccgccctgaaccactaccagatcagagtgcccaacggcagcaacccctacaccctgaagctgtgcttcagcaccagcagccacctgtag

SEQ ID NO: 8326 - DNA, 1527 bp, Artificial Sequence
  Description of Artificial Sequence: Synthetic coding sequence
atgagcagcagcagcagcagccccagagagacctacgaggaggacagagagtacgagagccaggccaagagactgaagaccgaggagggcgagatcgactacagcgccgaggagggcgagaacagaagagaggccacccccagaggcggcggcgacggcggcggcggcggcagaagcttcagccagcccgaggccggcggcagccaccacaaggtgagcgtgagccccgtggtgcacgtgagaggcctgtgcgagagcgtggtggaggccgacctggtggaggccctggagaagttcggcaccatctgctacgtgatgatgatgcccttcaagagacaggccctggtggagttcgagaacatcgacagcgccaaggagtgcgtgaccttcgccgccgacgagcccgtgtacatcgccggccagcaggccttcttcaactacagcaccagcaagagaatcaccagacccggcaacaccgacgaccccagcggcggcaacaaggtgctgctgctgagcatccagaaccccctgtaccccatcaccgtggacgtgctgtacaccgtgtgcaaccccgtgggcaaggtgcagagaatcgtgatcttcaagagaaacggcatccaggccatggtggacagactgaacgtgatcagaaacgacaacgacagctgggactacaccaagccctacctgggcagaagagacagaggcaagggcagacagagacaggccatcctgggcgagcaccccagcagcttcagacacgacggctacggcagccacggccccctgctgcccctgcccagcagatacagaatgggcagcagagacacccccgagctggtggcctaccccctgccccaggccagcagcagctacatgcacggcggcaaccccagcggcagcgtggtgatggtgagcggcctgcaccagctgaagatgaactgcagcagagtgttcaacctgttctgcctgtacggcaacatcgagaaggtgaagttcatgaagaccatccccggcaccgccctggtggagatgggcgacgagtacgccgtggagagagccgtgacccacctgaacaacgtgaagctgttcggcaagagactgaacgtgtgcgtgagcaagcagcacagcgtggtgcccagccagatcttcgagctggaggacggcaccagcagctacaaggacttcgccatgagcaagaacaacagattcaccagcgccggccaggccagcaagaacatcatccagccccccagctgcgtgctgcactactacaacgtgcccctgtgcgtgaccgaggagaccttcaccaagctgtgcaacgaccacgaggtgctgaccttcatcaagtacaaggtgttcgacgccaagcccagcgccaagaccctgagcggcctgctggagtgggagtgcaagaccgacgccgtggaggccctgaccgccctgaaccactaccagatcagagtgcccaacggcagcaacccctacaccctgaagctgtgcttcagcaccagcagccacctgtag

SEQ ID NO: 8327 - DNA, 1614 bp, Artificial Sequence
  Description of Artificial Sequence: Synthetic coding sequence
atgctggccagagagacctacgaggaggacagagagtacgagagccaggccaagagactgaagaccgaggagggcgagatcgactacagcgccgaggagggcgagaacagaagagaggccacccccagaggcggcggcgacggcggcggcggcggcagaagcttcagccagcccgaggccggcggcagccaccacaaggtgagcgtgagccccgtggtgcacgtgagaggcctgtgcgagagcgtggtggaggccgacctggtggaggccctggagaagttcggcaccatctgctacgtgatgatgatgcccttcaagagacaggccctggtggagttcgagaacatcgacagcgccaaggagtgcgtgaccttcgccgccgacgagcccgtgtacatcgccggccagcaggccttcttcaactacagcaccagcaagagaatcaccagacccggcaacaccgacgaccccagcggcggcaacaaggtgctgctgctgagcatccagaaccccctgtaccccatcaccgtggacgtgctgtacaccgtgtgcaaccccgtgggcaaggtgcagagaatcgtgatcttcaagagaaacggcatccaggccatggtggagttcgagagcgtgctgtgcgcccagaaggccaaggccgccctgaacggcgccgacatctacgccggctgctgcaccctgaagatcgagtacgccagacccaccagactgaacgtgatcagaaacgacaacgacagctgggactacaccaagccctacctgggcagaagagacagaggcaagggcagacagagacaggccatcctgggcgagcaccccagcagcttcagacacgacggctacggcagccacggccccctgctgcccctgcccagcagatacagaatgggcagcagagacacccccgagctggtggcctaccccctgccccaggccagcagcagctacatgcacggcggcaaccccagcggcagcgtggtgatggtgagcggcctgcaccagctgaagatgaactgcagcagagtgttcaacctgttctgcctgtacggcaacatcgagaaggtgaagttcatgaagaccatccccggcaccgccctggtggagatgggcgacgagtacgccgtggagagagccgtgacccacctgaacaacgtgaagctgttcggcaagagactgaacgtgtgcgtgagcaagcagcacagcgtggtgcccagccagatcttcgagctggaggacggcaccagcagctacaaggacttcgccatgagcaagaacaacagattcaccagcgccggccaggccagcaagaacatcatccagccccccagctgcgtgctgcactactacaacgtgcccctgtgcgtgaccgaggagaccttcaccaagctgtgcaacgaccacgaggtgctgaccttcatcaagtacaaggtgttcgacgccaagcccagcgccaagaccctgagcggcctgctggagtgggagtgcaagaccgacgccgtggaggccctgaccgccctgaaccactaccagatcagagtgcccaacggcagcaacccctacaccctgaagctgtgcttcagcaccagcagccacctgtag

SEQ ID NO: 8328 - DNA, 828 bp, Artificial Sequence
  Description of Artificial Sequence: Synthetic coding sequence
atgctggccagagagacctacgaggaggacagagagtacgagagccaggccaagagactgaagaccgaggagggcgagatcgactacagcgccgaggagggcgagaacagaagagaggccacccccagaggcggcggcgacggcggcggcggcggcagaagcttcagccagcccgaggccggcggcagccaccacaaggtgagcgtgagccccgtggtgcacgtgagaggcctgtgcgagagcgtggtggaggccgacctggtggaggccctggagaagttcggcaccatctgctacgtgatgatgatgcccttcaagagacaggccctggtggagttcgagaacatcgacagcgccaaggagtgcgtgaccttcgccgccgacgagcccgtgtacatcgccggccagcaggccttcttcaactacagcaccagcaagagaatcaccagacccggcaacaccgacgaccccagcggcggcaacaaggtgctgctgctgagcatccagaaccccctgtaccccatcaccgtggacgtgctgtacaccgtgtgcaaccccgtgggcaaggtgcagagaatcgtgatcttcaagagaaacggcatccaggccatggtggagttcgagagcgtgctgtgcgcccagaaggccaaggccgccctgaacggcgccgacatctacgccggctgctgcaccctgaagatcgagtacgccagacccaccagactgaacgtgatcagaaacgacaacgacagctgggactacaccaagccctacctgggcagaagaggcagatacttcatccacttcagaatgtacctgatctgctag

SEQ ID NO: 8329 - DNA, 1629 bp, Artificial Sequence
  Description of Artificial Sequence: Synthetic coding sequence
atgagcagcagcagcagcagccccagagagacctacgaggaggacagagagtacgagagccaggccaagagactgaagaccgaggagggcgagatcgactacagcgccgaggagggcgagaacagaagagaggccacccccagaggcggcggcgacggcggcggcggcggcagaagcttcagccagcccgaggccggcggcagccaccacaaggtgagcgtgagccccgtggtgcacgtgagaggcctgtgcgagagcgtggtggaggccgacctggtggaggccctggagaagttcggcaccatctgctacgtgatgatgatgcccttcaagagacaggccctggtggagttcgagaacatcgacagcgccaaggagtgcgtgaccttcgccgccgacgagcccgtgtacatcgccggccagcaggccttcttcaactacagcaccagcaagagaatcaccagacccggcaacaccgacgaccccagcggcggcaacaaggtgctgctgctgagcatccagaaccccctgtaccccatcaccgtggacgtgctgtacaccgtgtgcaaccccgtgggcaaggtgcagagaatcgtgatcttcaagagaaacggcatccaggccatgctgatgttcgagagcgtgctgtgcgcccagaaggccaaggccgccctgaacggcgccgacatctacgccggctgctgcaccctgaagatcgagtacgccagacccaccagactgaacgtgatcagaaacgacaacgacagctgggactacaccaagccctacctgggcagaagagacagaggcaagggcagacagagacaggccatcctgggcgagcaccccagcagcttcagacacgacggctacggcagccacggccccctgctgcccctgcccagcagatacagaatgggcagcagagacacccccgagctggtggcctaccccctgccccaggccagcagcagctacatgcacggcggcaaccccagcggcagcgtggtgatggtgagcggcctgcaccagctgaagatgaactgcagcagagtgttcaacctgttctgcctgtacggcaacatcgagaaggtgaagttcatgaagaccatccccggcaccgccctggtggagatgggcgacgagtacgccgtggagagagccgtgacccacctgaacaacgtgaagctgttcggcaagagactgaacgtgtgcgtgagcaagcagcacagcgtggtgcccagccagatcttcgagctggaggacggcaccagcagctacaaggacttcgccatgagcaagaacaacagattcaccagcgccggccaggccagcaagaacatcatccagccccccagctgcgtgctgcactactacaacgtgcccctgtgcgtgaccgaggagaccttcaccaagctgtgcaacgaccacgaggtgctgaccttcatcaagtacaaggtgttcgacgccaagcccagcgccaagaccctgagcggcctgctggagtgggagtgcaagaccgacgccgtggaggccctgaccgccctgaaccactaccagatcagagtgcccaacggcagcaacccctacaccctgaagctgtgcttcagcaccagcagccacctgtag

SEQ ID NO: 8330 - DNA, 2244 bp, Artificial Sequence
  Description of Artificial Sequence: Synthetic coding sequence
atggaggtgaagagactgaaggtgaccgagctgagaagcgagctgcagagaagaggcctggacagcagaggcctgaaggtggacctggcccagagactgcaggaggccctggacgccgagatgctggaggacgaggccggcggcggcggcgccggccccggcggcgcctgcaaggccgagcccagacccgtggccgccagcggcggcggccccggcggcgacgaggaggaggacgaggaggaggaggaggaggacgaggaggccctgctggaggacgaggacgaggagcccccccccgcccaggccctgggccaggccgcccagcccccccccgagccccccgaggccgccgccatggaggccgccgccgagcccgacgccagcgagaagcccgccgaggccaccgccggcagcggcggcgtgaacggcggcgaggagcagggcctgggcaagagagaggaggacgagcccgaggagagaagcggcgacgagacccccggcagcgaggtgcccggcgacaaggccgccgaggagcagggcgacgaccaggacagcgagaagagcaagcccgccggcagcgacggcgagagaagaggcgtgaagagacagagagacgagaaggacgagcacggcagagcctactacgagttcagagaggaggcctaccacagcagaagcaagagccccctgccccccgaggaggaggccaaggacgaggaggaggaccagaccctggtgaacctggacacctacaccagcgacctgcacttccaggtgagcaaggacagatacggcggccagcccctgttcagcgagaagttccccaccctgtggagcggcgccagaagcacctacggcgtgaccaagggcaaggtgtgcttcgaggccaaggtgacccagaacctgcccatgaaggagggctgcaccgaggtgagcctgctgagagtgggctggagcgtggacttcagcagaccccagctgggcgaggacgagttcagctacggcttcgacggcagaggcctgaaggccgagaacggccagttcgaggagttcggccagaccttcggcgagaacgacgtgatcggctgcttcgccaacttcgagaccgaggaggtggagctgagcttcagcaagaacggcgaggacctgggcgtggccttctggatcagcaaggacagcctggccgacagagccctgctgccccacgtgctgtgcaagaactgcgtggtggagctgaacttcggccagaaggaggagcccttcttccccccccccgaggagttcgtgttcatccacgccgtgcccgtggaggagagagtgagaaccgccgtgccccccaagaccatcgaggagtgcgaggtgatcctgatggtgggcctgcccggcagcggcaagacccagtgggccctgaagtacgccaaggagaaccccgagaagagatacaacgtgctgggcgccgagaccgtgctgaaccagatgagaatgaagggcctggaggagcccgagatggaccccaagagcagagacctgctggtgcagcaggccagccagtgcctgagcaagctggtgcagatcgccagcagaaccaagagaaacttcatcctggaccagtgcaacgtgtacaacagcggccagagaagaaagctgctgctgttcaagaccttcagcagaaaggtggtggtggtggtgcccaacgaggaggactggaagaagagactggagctgagaaaggaggtggagggcgacgacgtgcccgagagcatcatgctggagatgaaggccaacttcagcctgcccgagaagtgcgactacatggacgaggtgacctacggcgagctggagaaggaggaggcccagcccatcgtgaccaagtacaaggaggaggccagaaagctgctgccccccagcgagaagagaaccaacagaagaaacaacagaaacaagagaaacagacagaacagaagcagaggccagggctacgtgggcggccagagaagaggctacgacaacagagcctacggccagcagtactggggccagcccggcaacagaggcggctacagaaacttctacgacagatacagaggcgactacgacagattctacggcagagactacgagtacaacagatacagagactactacagacagtacaacagagactggcagagctactactaccaccacccccaggacagagacagatactacagaaactactacggctaccagggctacagatag

SEQ ID NO: 8331 - DNA, 561 bp, Artificial Sequence
  Description of Artificial Sequence: Synthetic coding sequence
atgggcaaggagatccagctgaagcccaaggccaacgtgagcagctacgtgcacttcctgctgaactacagaaacaagttcaaggagcagcagcccaacacctacgtgggcttcaaggagttcagcagaaagtgcagcgagaagtggagaagcatcagcaagcacgagaaggccaagtacgaggccctggccaagctggacaaggccagataccaggaggagatgatgaactacgtgggcaagagaaagaagagaagaaagagagacccccaggagcccagaagaccccccagcagcttcctgctgttctgccaggaccactacgcccagctgaagagagagaaccccaactggagcgtggtgcaggtggccaaggccaccggcaagatgtggagcaccgccaccgacctggagaagcacccctacgagcagagagtggccctgctgagagccaagtacttcgaggagctggagctgtacagaaagcagtgcaacgccagaaagaagtacagaatgagcgccagaaacagatgcagaggcaagagagtgagacagagctag

SEQ ID NO: 8332 - DNA, 561 bp, Artificial Sequence; identical to SEQ ID NO: 8331
  Description of Artificial Sequence: Synthetic coding sequence

SEQ ID NO: 8333 - DNA, 273 bp, Artificial Sequence
  Description of Artificial Sequence: Synthetic coding sequence
atgcccaagagaaaggccaagggcgacgccaagggcgacaaggccaaggtgaaggacgagccccagagaagaagcgccagactgagcgccaagcccgccccccccaagcccgagcccagacccaagaaggccagcgccaagaagggcgagaagctgcccaagggcagaaagggcaaggccgacgccggcaaggacggcaacaaccccgccaagaacagagacgccagcaccctgcagagccagaaggccgagggcaccggcgacgccaagtag

SEQ ID NO: 8334 - DNA, 273 bp, Artificial Sequence; identical to SEQ ID NO: 8333
  Description of Artificial Sequence: Synthetic coding sequence

SEQ ID NO: 8335 - DNA, 849 bp, Artificial Sequence
  Description of Artificial Sequence: Synthetic coding sequence
atgcccaagagaaaggccgccggccagggcgacatgagacaggagcccaagagaagaagcgccagactgagcgccatgctggtgcccgtgacccccgaggtgaagcccaagagaaccagcagcagcagaaagatgaagaccaagagcgacatgatggaggagaacatcgacaccagcgcccaggccgtggccgagaccaagcaggaggccgtggtggaggaggactacaacgagaacgccaagaacggcgaggccaagatcaccgaggcccccgccagcgagaaggagatcgtggaggtgaaggaggagaacatcgaggacgccaccgagaagggcggcgagaagaaggaggccgtggccgccgaggtgaagaacgaggaggaggaccagaaggaggacgaggaggaccagaacgaggagaagggcgaggccggcaaggaggacaaggacgagaagggcgaggaggacggcaaggaggacaagaacggcaacgagaagggcgaggacgccaaggagaaggaggacggcaagaagggcgaggacggcaagggcaacggcgaggacggcaaggagaagggcgaggacgagaaggaggaggaggacagaaaggagaccggcgacggcaaggagaacgaggacggcaaggagaagggcgacaagaaggagggcaaggacgtgaaggtgaaggaggacgagaaggagagagaggacggcaaggaggacgagggcggcaacgaggaggaggccggcaaggagaaggaggacctgaaggaggaggaggagggcaaggaggaggacgagatcaaggaggacgacggcaagaaggaggagccccagagcatcgtgtag

SEQ ID NO: 8336 - DNA, 486 bp, Artificial Sequence
  Description of Artificial Sequence: Synthetic coding sequence
atgcccaagagaaagcccaagagaagaagcgccagactgagcgccatgctggtgcccgtgacccccgaggtgaagcccaagagaaccagcagcagcagaaagatgaagaccaagagcgacatgatggaggagaacatcgacaccagcgcccaggccgtggccgagaccaagcaggaggccgtggtggaggaggactacaacgagaacgccaagaacggcgaggccaagatcaccgaggcccccgccagcgagaaggagatcgtggaggtgaaggaggagaacatcgaggacgccaccgagaagggcggcgagaagaaggaggccgtggccgccgaggtgaagaacgaggaggaggaccagaaggaggacgaggaggaccagaacgaggagaagggcgaggccggcaaggaggacaaggacgagaagggcgaggaggacggcaaggaggacaagaacggcaacgagaagggcgaggacgccaagtag

SEQ ID NO: 8337 - DNA, 447 bp, Artificial Sequence
  Description of Artificial Sequence: Synthetic coding sequence
atgcccaagagaaaggccgccggccagggcgacatgagacaggagcccaagagaagaagcgccagactgagcgccatgctggtgcccgtgacccccgaggtgaagcccaagagaaccagcagcagcagaaagatgaagaccaagagcgacatgatggaggagaacatcgacaccagcgcccaggccgtggccgagaccaagcaggaggccgtggtggaggaggactacaacgagaacgccaagaacggcgaggccaagatcaccgaggcccccgccagcgagaaggagatcgtggaggtgaaggaggagaacatcgaggacgccaccgagaagggcggcgagaagaaggaggccgtggccgccgaggtgaagaacgaggaggaggaccagaaggaggacgaggaggaccagaacgaggagaagggcgaggccggcaaggaggactag

SEQ ID NO: 8338 - DNA, 309 bp, Artificial Sequence
  Description of Artificial Sequence: Synthetic coding sequence
atgcccaagagaaaggccgccggccagggcgacatgagacaggagcccaagagaagaagcgccagactgagcgccatgctggtgcccgtgacccccgaggtgaagcccaagagaaccagcagcagcagaaagatgaagaccaagagcgacatgatggaggagaacatcgacaccagcgcccaggccgtggccgagaccaagcaggaggccgtggtggaggaggactacaacgagaacgccaagaacggcgaggccaagatcaccgaggcccccgccagcgagaaggagatcgtggaggtgaaggagtag

SEQ ID NO: 8339 - DNA, 606 bp, Artificial Sequence
  Description of Artificial Sequence: Synthetic coding sequence
atgcccaagagaaagatgctggtgcccgtgacccccgaggtgaagcccaagagaaccagcagcagcagaaagatgaagaccaagagcgacatgatggaggagaacatcgacaccagcgcccaggccgtggccgagaccaagcaggaggccgtggtggaggaggactacaacgagaacgccaagaacggcgaggccaagatcaccgaggcccccgccagcgagaaggagatcgtggaggtgaaggaggagaacatcgaggacgccaccgagaagggcggcgagaagaaggaggccgtggccgccgaggtgaagaacgaggaggaggaccagaaggaggacgaggaggaccagaacgaggagaagggcgaggccggcaaggaggacaaggacgagaagggcgaggaggacggcaaggaggacaagaacggcaacgagaagggcgaggacgccaaggagaaggaggacggcaagaagggcgaggacggcaagggcaacggcgaggacggcaaggagaagggcgaggacgagaaggaggaggaggacagaaaggagaccggcgacggcaaggagaacgaggacggcaaggagaagggcgacaagaagtag

SEQ ID NO: 8340 - DNA, 270 bp, Artificial Sequence
  Description of Artificial Sequence: Synthetic coding sequence
atgcccaagagaaaggccgccggccagggcgacatgagacaggagcccaagagaagaagcgccagactgagcgccatgctggtgcccgtgacccccgaggtgaagcccaagagaaccagcagcagcagaaagatgaagaccaagagcgacatgatggaggagaacatcgacaccagcgcccaggccgtggccgagaccaagcaggaggccgtggtggaggaggactacaacgagaacgccaagaacggcgaggccaagatcaccgagtag

SEQ ID NO: 8341 - DNA, 2073 bp, Artificial Sequence
  Description of Artificial Sequence: Synthetic coding sequence
atgaacctgagaagcgtgttcaccgtggagcagcagagaatcctgcagagatactacgagaacggcatgaccaaccagagcaagaactgcttccagctgatcctgcagtgcgcccaggagaccaagctggacttcagcgtggtgagaacctgggtgggcaacaagagaagaaagatgagcagcaagaacagcgagagcggcaccgccaccaccggcaccagcctgagcgcccccgacatcaccgtgagaaacgtggtgaacatcgccagacccagcagccagcagagcagctggaccagcgccaacaacgacgtgatcgtgaccggcatctacagccccgccagcagcagcagcagacagggcaccaacaagcacaccgacacccagatcaccgaggcccacaagatccccatccagaagaccgccaccaagaacgacaccgagttccagctgcacatccccgtgcagagacaggtggcccactgcaagaacgccagcctgctgctgggcgagaagaccatcatcctgagcagacagaccagcgtgctgaacgccggcaacagcgtgttcaaccacgccaagaagaactacggcaacagcagcgtgcaggccagcgagatgaccgtgccccagaagcccagcgtgtgccacagaccctgcaagatcgagcccgtgggcatccagagaagctacaagcccgagcacaccggccccgccctgcacaacctgtgcggccagaagcccaccatcagagacccctactgcagaacccagaacctggagatcagagaggtgttcagcctggccgtgagcgactacccccagagaatcctgggcggcaacgccccccagaagcccagcagcgccgagggcaactgcctgagcatcgccatggagaccggcgacgccgaggacgagtacgccagagaggaggagctggccagcatgagagcccagatccccagctacagcagattctacgagagcggcagcagcctgagagccgagaaccagagcaccaccctgcccggccccggcagaaacatgcccaacagccagatggtgaacatcagagacatgagcgacaacgtgctgtaccagaacagaaactaccacctgacccccagaaccagcctgcacaccgccagcagcaccatgtacagcaacaccaaccccctgagaagcaacttcagcccccacttcgccagcagcaaccagctgagactgagccagaaccagaacaactaccagatcagcggcaacctgaccgtgccctggatcaccggctgcagcagaaagagagccctgcaggacagaacccagttcagcgacagagacctggccaccctgaagaagtactgggacaacggcatgaccagcctgggcagcgtgtgcagagagaagatcgaggccgtggccaccgagctgaacgtggactgcgagatcgtgagaacctggatcggcaacagaagaagaaagtacagactgatgggcatcgaggtgcccccccccagaggcggccccgccgacttcagcgagcagcccgagagcggcagcctgagcgccctgacccccggcgaggaggccggccccgaggtgggcgaggacaacgacagaaacgacgaggtgagcatctgcctgagcgagggcagcagccaggaggagcccaacgaggtggtgcccaacgacgccagagcccacaaggaggaggaccaccacgccgtgaccaccgacaacgtgaagatcgagatcatcgacgacgaggagagcgacatgatcagcaacagcgaggtggagcaggtgaacagcttcctggactacaagaacgaggaggtgaagttcatcgagaacgagctggagatccagaagcagaagtacttcaagctgcagaccttcgtgagaagcctgatcctggccatgaaggccgacgacaaggagcagcagcaggccctgctgagcgacctgccccccgagctggaggagatggacttcaaccacgccagcctggagcccgacgacaccagcttcagcgtgagcagcctgagcgagaagaacgtgagcgagagcctgtag

SEQ ID NO: 8342 - DNA, 1899 bp, Artificial Sequence
  Description of Artificial Sequence: Synthetic coding sequence
atgagcagcaagaacagcgagagcggcaccgccaccaccggcaccagcctgagcgcccccgacatcaccgtgagaaacgtggtgaacatcgccagacccagcagccagcagagcagctggaccagcgccaacaacgacgtgatcgtgaccggcatctacagccccgccagcagcagcagcagacagggcaccaacaagcacaccgacacccagatcaccgaggcccacaagatccccatccagaagaccgccaccaagaacgacaccgagttccagctgcacatccccgtgcagagacaggtggcccactgcaagaacgccagcctgctgctgggcgagaagaccatcatcctgagcagacagaccagcgtgctgaacgccggcaacagcgtgttcaaccacgccaagaagaactacggcaacagcagcgtgcaggccagcgagatgaccgtgccccagaagcccagcgtgtgccacagaccctgcaagatcgagcccgtgggcatccagagaagctacaagcccgagcacaccggccccgccctgcacaacctgtgcggccagaagcccaccatcagagacccctactgcagaacccagaacctggagatcagagaggtgttcagcctggccgtgagcgactacccccagagaatcctgggcggcaacgccccccagaagcccagcagcgccgagggcaactgcctgagcatcgccatggagaccggcgacgccgaggacgagtacgccagagaggaggagctggccagcatgagagcccagatccccagctacagcagattctacgagagcggcagcagcctgagagccgagaaccagagcaccaccctgcccggccccggcagaaacatgcccaacagccagatggtgaacatcagagacatgagcgacaacgtgctgtaccagaacagaaactaccacctgacccccagaaccagcctgcacaccgccagcagcaccatgtacagcaacaccaaccccctgagaagcaacttcagcccccacttcgccagcagcaaccagctgagactgagccagaaccagaacaactaccagatcagcggcaacctgaccgtgccctggatcaccggctgcagcagaaagagagccctgcaggacagaacccagttcagcgacagagacctggccaccctgaagaagtactgggacaacggcatgaccagcctgggcagcgtgtgcagagagaagatcgaggccgtggccaccgagctgaacgtggactgcgagatcgtgagaacctggatcggcaacagaagaagaaagtacagactgatgggcatcgaggtgcccccccccagaggcggccccgccgacttcagcgagcagcccgagagcggcagcctgagcgccctgacccccggcgaggaggccggccccgaggtgggcgaggacaacgacagaaacgacgaggtgagcatctgcctgagcgagggcagcagccaggaggagcccaacgaggtggtgcccaacgacgccagagcccacaaggaggaggaccaccacgccgtgaccaccgacaacgtgaagatcgagatcatcgacgacgaggagagcgacatgatcagcaacagcgaggtggagcaggtgaacagcttcctggactacaagaacgaggaggtgaagttcatcgagaacgagctggagatccagaagcagaagtacttcaagctgcagaccttcgtgagaagcctgatcctggccatgaaggccgacgacaaggagcagcagcaggccctgctgagcgacctgccccccgagctggaggagatggacttcaaccacgccagcctggagcccgacgacaccagcttcagcgtgagcagcctgagcgagaagaacgtgagcgagagcctgtag

SEQ ID NO: 8343 - DNA, 624 bp, Artificial Sequence
  Description of Artificial Sequence: Synthetic coding sequence
atgagcagcaagaacagcgagagcggcaccgccaccaccggcaccagcctgagcgcccccgacatcaccgtgagaaacgtggtgaacatcgccagacccagcagccagcagagcagctggaccagcgccaacaacgacgtgatcgtgaccggcatctacagccccgccagcagcagcagcagacagggcaccaacaagcacaccgacacccagatcaccgaggcccacaagatccccatccagaagaccgccaccaagaacgacaccgagttccagctgcacatccccgtgcagagacaggtggcccactgcaagaacgccagcctgctgctgggcgagaagaccatcatcctgagcagacagaccagcgtgctgaacgccggcaacagcgtgttcaaccacgccaagaagaactacggcaacagcagcgtgcaggccagcgagatgaccgtgccccagaagcccagcgtgtgccacagaccctgcaagatcgagcccgtgggcatccagagaagctacaagcccgagcacaccggccccgccctgcacaacctgtgcggccagaagcccaccatcagagacccctactgcagaacccagaacctggagatcagagaggtgtag

SEQ ID NO: 8344 - DNA, 2073 bp, Artificial Sequence; identical to SEQ ID NO: 8341
  Description of Artificial Sequence: Synthetic coding sequence

SEQ ID NO: 8345 - DNA, 1671 bp, Artificial Sequence
  Description of Artificial Sequence: Synthetic coding sequence
atggccagagagaaggagatgcaggagttcaccagaagcttcttcagaggcagacccgacctgagcaccctgacccacagcatcgtgagaagaagatacctggcccacagcggcagaagccacctggagcccgaggagaagcaggccctgaagagactggtggaggaggagctgctgaagatgcaggtggacgaggccgccagcagagaggacaagctggacctgaccaagaagggcaagagaccccccaccccctgcagcgaccccgagagaaagagattcagattcaacagcgagagcgagagcggcagcgaggccagcagccccgactacttcggcccccccgccaagaacggcgtggccgccgaggtgagccccgccaaggaggagaaccccagaagagccagcaaggccgtggaggagagcagcgacgaggagagacagagagacctgcccgcccagagaggcgaggagagcagcgaggaggaggagaagggctacaagggcaagaccagaaagaagcccgtggtgaagaagcaggcccccggcaaggccagcgtgagcagaaagcaggccagagaggagagcgaggagagcgaggccgagcccgtgcagagaaccgccaagaaggtggagggcaacaagggcaccaagagcctgaaggagagcgagcaggagagcgaggaggagatcctggcccagaagaaggagcagagagaggaggaggtggaggaggaggagaaggaggaggacgaggagaagggcgactggaagcccagaaccagaagcaacggcagaagaaagagcgccagagaggagagaagctgcaagcagaagagccaggccaagagactgctgggcgacagcgacagcgaggaggagcagaaggaggccgccagcagcggcgacgacagcggcagagacagagagccccccgtgcagagaaagagcgaggacagaacccagctgaagggcggcaagagactgagcggcagcagcgaggacgaggaggacagcggcaagggcgagcccaccgccaagggcagcagaaagatggccagactgggcagcaccagcggcgaggagagcgacctggagagagaggtgagcgacagcgaggccggcggcggcccccagggcgagagaaagaacagaagcagcaagaagagcagcagaaagggcagaaccagaagcagcagcagcagcagcgacggcagccccgaggccaagggcggcaaggccggcagcggcagaagaggcgaggaccaccccgccgtgatgagactgaagagatacatcagagcctgcggcgcccacagaaactacaagaagctgctgggcagctgctgcagccacaaggagagactgagcatcctgagagccgagctggaggccctgggcatgaagggcacccccagcctgggcaagtgcagagccctgaaggagcagagagaggaggccgccgaggtggccagcctggacgtggccaacatcatcagcggcagcggcagacccagaagaagaaccgcctggaaccccctgggcgaggccgccccccccggcgagctgtacagaagaaccctggacagcgacgaggagagacccagacccgccccccccgactggagccacatgagaggcatcatcagcagcgacggcgagagcaactag

SEQ ID NO: 8346 - DNA, 732 bp, Artificial Sequence
  Description of Artificial Sequence: Synthetic coding sequence
atggccagagagaaggagatgcaggagttcaccagaagcttcttcagaggcagacccgacctgagcaccctgacccacagcatcgtgagaagaagatacctggcccacagcggcagaagccacctggagcccgaggagaagcaggccctgaagagactggtggaggaggagctgctgaagatgcaggtggacgaggccgccagcagagaggacaagctggacctgaccaagaagggcaagagaccccccaccccctgcagcgaccccgagagaaagagattcagattcaacagcgagagcgccggcagcggcagaagaggcgaggaccaccccgccgtgatgagactgaagagatacatcagagcctgcggcgcccacagaaactacaagaagctgctgggcagctgctgcagccacaaggagagactgagcatcctgagagccgagctggaggccctgggcatgaagggcacccccagcctgggcaagtgcagagccctgaaggagcagagagaggaggccgccgaggtggccagcctggacgtggccaacatcatcagcggcagcggcagacccagaagaagaaccgcctggaaccccctgggcgaggccgccccccccggcgagctgtacagaagaaccctggacagcgacgaggagagacccagacccgccccccccgactggagccacatgagaggcatcatcagcagcgacggcgagagcaactag

SEQ ID NO: 8347 - DNA, 1362 bp, Artificial Sequence
  Description of Artificial Sequence: Synthetic coding sequence
atggagagagccccccccgacggccccctgaacgccagcggcgccctggccggcgaggccgccgccgccggcggcgccagaggcttcagcgccgcctggaccgccgtgctggccgccctgatggccctgctgatcgtggccaccgtgctgggcaacgccctggtgatgctggccttcgtggccgacagcagcctgagaacccagaacaacttcttcctgctgaacctggccatcagcgacttcctggtgggcgccttctgcatccccctgtacgtgccctacgtgctgaccggcagatggaccttcggcagaggcctgtgcaagctgtggctggtggtggactacctgctgtgcaccagcagcgccttcaacatcgtgctgatcagctacgacagattcctgagcgtgaccagagccgtgagctacagagcccagcagggcgacaccagaagagccgtgagaaagatgctgctggtgtgggtgctggccttcctgctgtacggccccgccatcctgagctgggagtacctgagcggcggcagcagcatccccgagggccactgctacgccgagttcttctacaactggtacttcctgatcaccgccagcaccctggagttcttcacccccttcctgagcgtgaccttcttcaacctgagcatctacctgaacatccagagaagaaccagactgagactggacggcgccagagaggccgccggccccgagcccccccccgaggcccagcccagccccccccccccccccggctgctggggctgctggcagaagggccacggcgaggccatgcccctgcacagatacggcgtgggcgaggccgccgtgggcgccgaggccggcgaggccaccctgggcggcggcggcggcggcggcagcgtggccagccccaccagcagcagcggcagcagcagcagaggcaccgagagacccagaagcctgaagagaggcagcaagcccagcgccagcagcgccagcctggagaagagaatgaagatggtgagccagagcttcacccagagattcagactgagcagagacagaaaggtggccaagagcctggccgtgatcgtgagcatcttcggcctgtgctgggccccctacaccctgctgatgatcatcagagccgcctgccacggccactgcgtgcccgactactggtacgagaccagcttctggctgctgtgggccaacagcgccgtgaaccccgtgctgtaccccctgtgccaccacagcttcagaagagccttcaccaagctgctgtgcccccagaagctgaagatccagccccacagcagcctggagcactgctggaagaagatgaagaagaagacctgcctgtag

SEQ ID NO: 8348 - DNA, 1338 bp, Artificial Sequence
  Description of Artificial Sequence: Synthetic coding sequence
atggagagagccccccccgacggccccctgaacgccagcggcgccctggccggcgaggccgccgccgccggcggcgccagaggcttcagcgccgcctggaccgccgtgctggccgccctgatggccctgctgatcgtggccaccgtgctgggcaacgccctggtgatgctggccttcgtggccgacagcagcctgagaacccagaacaacttcttcctgctgaacctggccatcagcgacttcctggtgggcgccttctgcatccccctgtacgtgccctacgtgctgaccggcagatggaccttcggcagaggcctgtgcaagctgtggctggtggtggactacctgctgtgcaccagcagcgccttcaacatcgtgctgatcagctacgacagattcctgagcgtgaccagagccgtgagctacagagcccagcagggcgacaccagaagagccgtgagaaagatgctgctggtgtgggtgctggccttcctgctgtacggccccgccatcctgagctgggagtacctgagcggcggcagcagcatccccgagggccactgctacgccgagttcttctacaactggtacttcctgatcaccgccagcaccctggagttcttcacccccttcctgagcgtgaccttcttcaacctgagcatctacctgaacatccagagaagaaccagactgagactggacggcgccagagaggccgccggccccgagcccccccccgaggcccagcccagccccccccccccccccggctgctggggctgctggcagaagggccacggcgaggccatgcccctgcacagatacggcgtgggcgaggccgccgtgggcgccgaggccggcgaggccaccctgggcggcggcggcggcggcggcagcgtggccagccccaccagcagcagcggcagcagcagcagaggcaccgagagacccagaagcctgaagagaggcagcaagcccagcgccagcagcgccagcctggagaagagaatgaagatggtgagccagagcttcacccagagattcagactgagcagagacagaaaggtggccaagagcctggccgtgatcgtgagcatcttcggcctgtgctgggccccctacaccctgctgatgatcatcagagccgcctgccacggccactgcgtgcccgactactggtacgagaccagcttctggctgctgtgggccaacagcgccgtgaaccccgtgctgtaccccctgtgccaccacagcttcagaagagccttcaccaagctgctgtgcccccagaagctgaagatccagccccacagcagcctggagcactgctggaagtag

SEQ ID NO: 8349 - DNA, 1248 bp, Artificial Sequence
  Description of Artificial Sequence: Synthetic coding sequence
atggagagagccccccccgacggccccctgaacgccagcggcgccctggccggcgaggccgccgccgccggcggcgccagaggcttcagcgccgcctggaccgccgtgctggccgccctgatggccctgctgatcgtggccaccgtgctgggcaacgccctggtgatgctggccttcgtggccgacagcagcctgagaacccagaacaacttcttcctgctgaacctggccatcagcgacttcctggtgggcgccttctgcatccccctgtacgtgccctacgtgctgaccggcagatggaccttcggcagaggcctgtgcaagctgtggctggtggtggactacctgctgtgcaccagcagcgccttcaacatcgtgctgatcagctacgacagattcctgagcgtgaccagagccgtgagctacagagcccagcagggcgacaccagaagagccgtgagaaagatgctgctggtgtgggtgctggccttcctgctgtacggccccgccatcctgagctgggagtacctgagcggcggcagcagcatccccgagggccactgctacgccgagttcttctacaactggtacttcctgatcaccgccagcaccctggagttcttcacccccttcctgagcgtgaccttcttcaacctgagcatctacctgaacatccagagaagaaccagactgagactgaagggccacggcgaggccatgcccctgcacagatacggcgtgggcgaggccgccgtgggcgccgaggccggcgaggccaccctgggcggcggcggcggcggcggcagcgtggccagccccaccagcagcagcggcagcagcagcagaggcaccgagagacccagaagcctgaagagaggcagcaagcccagcgccagcagcgccagcctggagaagagaatgaagatggtgagccagagcttcacccagagattcagactgagcagagacagaaaggtggccaagagcctggccgtgatcgtgagcatcttcggcctgtgctgggccccctacaccctgctgatgatcatcagagccgcctgccacggccactgcgtgcccgactactggtacgagaccagcttctggctgctgtgggccaacagcgccgtgaaccccgtgctgtaccccctgtgccaccacagcttcagaagagccttcaccaagctgctgtgcccccagaagctgaagatccagccccacagcagcctggagcactgctggaagtag

SEQ ID NO: 8350 - DNA, 396 bp, Artificial Sequence
  Description of Artificial Sequence: Synthetic coding sequence
atgagcggcagaggcaagcagggcggcaaggccagagccaagagcaagagcagaagcagcagagccggcctgcagttccccgtgggcagaatccacagactgctgagaaagggcaactacgccgagagaatcggcgccggcgcccccgtgtacctggccgccgtgctggagtacctgaccgccgagatcctggagctggccggcaacgccagcagagacaacaagaagaccagaatcatccccagacacctgcagctggccatcagaaacgacgaggagctgaacaagctgctgggcggcgtgaccatcgcccagggcggcgtgctgcccaacatccaggccgtgctgctgcccaagaagaccgagagccaccaccacaaggcccagagcaagtag

SEQ ID NO: 8351 - DNA, 393 bp, Artificial Sequence
  Description of Artificial Sequence: Synthetic coding sequence
atgagcggcagaggcaagcagggcggcaaggccagagccaaggccaagaccagaagcagcagagccggcctgcagttccccgtgggcagagtgcacagactgctgagaaagggcaactacgccgagagagtgggcgccggcgcccccgtgtacctggccgccgtgctggagtacctgaccgccgagatcctggagctggccggcaacgccgccagagacaacaagaagaccagaatcatccccagacacctgcagctggccatcagaaacgacgaggagctgaacaagctgctgggcaaggtgaccatcgcccagggcggcgtgctgcccaacatccaggccgtgctgctgcccaagaagaccgagagccaccacaaggccaagggcaagtag

SEQ ID NO: 8352 - DNA, 387 bp, Artificial Sequence
  Description of Artificial Sequence: Synthetic coding sequence
atgagcggcagaggcaagcagggcggcaaggccagagccaaggccaagaccagaagcagcagagccggcctgcagttccccgtgggcagagtgcacagactgctgagaaagggcaactacgccgagagagtgggcgccggcgcccccgtgtacctggccgccgtgctggagtacctgaccgccgagatcctggagctggccggcaacgccgccagagacaacaagaagaccagaatcatccccagacacctgcagctggccatcagaaacgacgaggagctgaacaagctgctgggcaaggtgaccatcgcccagggcggcgtgctgcccaacatccaggccgtgctgctgcccaagaagaccgagagccaccacaaggccaagtag

SEQ ID NO: 8353 - DNA, 381 bp, Artificial Sequence
  Description of Artificial Sequence: Synthetic coding sequence
atgcccgagcccgccaagagcgcccccgcccccaagaagggcagcaagaaggccgtgaccaaggcccagaagaaggacggcaagaagagaaagagaagcagaaaggagagctacagcatctacgtgtacaaggtgctgaagcaggtgcaccccgacaccggcatcagcagcaaggccatgggcatcatgaacagcttcgtgaacgacatcttcgagagaatcgccggcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcgccaagtag

SEQ ID NO: 8354 - DNA, 381 bp, Artificial Sequence; identical to SEQ ID NO: 8353
  Description of Artificial Sequence: Synthetic coding sequence

SEQ ID NO: 8355 - DNA, 381 bp, Artificial Sequence
  Description of Artificial Sequence: Synthetic coding sequence
atgcccgagcccgccaagagcgcccccgcccccaagaagggcagcaagaaggccgtgaccaaggcccagaagaaggacggcaagaagagaaagagaagcagaaaggagagctacagcgtgtacgtgtacaaggtgctgaagcaggtgcaccccgacaccggcatcagcagcaaggccatgggcatcatgaacagcttcgtgaacgacatcttcgagagaatcgccggcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcgccaagtag

SEQ ID NO: 8356 - DNA, 381 bp, Artificial Sequence; identical to SEQ ID NO: 8355
  Description of Artificial Sequence: Synthetic coding sequence

SEQ ID NO: 8357 - DNA, 393 bp, Artificial Sequence
  Description of Artificial Sequence: Synthetic coding sequence
atgagcggcagaggcaagcagggcggcaaggccagagccaaggccaagagcagaagcagcagagccggcctgcagttccccgtgggcagagtgcacagactgctgagaaagggcaactacgccgagagagtgggcgccggcgcccccgtgtacatggccgccgtgctggagtacctgaccgccgagatcctggagctggccggcaacgccgccagagacaacaagaagaccagaatcatccccagacacctgcagctggccatcagaaacgacgaggagctgaacaagctgctgggcaaggtgaccatcgcccagggcggcgtgctgcccaacatccaggccgtgctgctgcccaagaagaccgagagccaccacaaggccaagggcaagtag

SEQ ID NO: 8358 - DNA, 393 bp, Artificial Sequence; identical to SEQ ID NO: 8357
  Description of Artificial Sequence: Synthetic coding sequence

SEQ ID NO: 8359 - DNA, 393 bp, Artificial Sequence
  Description of Artificial Sequence: Synthetic coding sequence
atgagcggcagaggcaagcagggcggcaaggccagagccaaggccaagagcagaagcagcagagccggcctgcagttccccgtgggcagagtgcacagactgctgagaaagggcaactacgccgagagagtgggcgccggcgcccccgtgtacctggccgccgtgctggagtacctgaccgccgagatcctggagctggccggcaacgccgccagagacaacaagaagaccagaatcatccccagacacctgcagctggccgtgagaaacgacgaggagctgaacaagctgctgggcggcgtgaccatcgcccagggcggcgtgctgcccaacatccaggccgtgctgctgcccaagaagaccgagagccacaagcccggcaagaacaagtag

SEQ ID NO: 8360 - DNA, 381 bp, Artificial Sequence
  Description of Artificial Sequence: Synthetic coding sequence
atgcccgaccccgccaagagcgcccccgcccccaagaagggcagcaagaaggccgtgaccaaggtgcagaagaaggacggcaagaagagaaagagaagcagaaaggagagctacagcgtgtacgtgtacaaggtgctgaagcaggtgcaccccgacaccggcatcagcagcaaggccatgggcatcatgaacagcttcgtgaacgacatcttcgagagaatcgccggcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcagcaagtag

SEQ ID NO: 8361 - DNA, 501 bp, Artificial Sequence
  Description of Artificial Sequence: Synthetic coding sequence
atgcccgaccccgccaagagcgcccccgcccccaagaagggcagcaagaaggccgtgaccaaggtgcagaagaaggacggcaagaagagaaagagaagcagaaaggagagctacagcgtgtacgtgtacaaggtgctgaagcaggtgcaccccgacaccggcatcagcagcaaggccatgggcatcatgaacagcttcgtgaacgacatcttcgagagaatcgccggcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcagcaaccccagaaacctgagccccaccaagcccggcggcagcgaggacagacagcccccccccagccagctgagcgccatcccccccttctgcctggtgctgagagccggcatcgccggccaggtgtag

SEQ ID NO: 8362 - DNA, 405 bp, Artificial Sequence
  Description of Artificial Sequence: Synthetic coding sequence
atgcccgaccccgccaagagcgcccccgcccccaagaagggcagcaagaaggccgtgaccaaggtgcagaagaaggacggcaagaagagaaagagaagcagaaaggagagctacagcgtgtacgtgtacaaggtgctgaagcaggtgcaccccgacaccggcatcagcagcaaggccatgggcatcatgaacagcttcgtgaacgacatcttcgagagaatcgccggcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcagcaagctgatcggccccatcctgtggaagtag

SEQ ID NO: 8363 - DNA, 411 bp, Artificial Sequence
  Description of Artificial Sequence: Synthetic coding sequence
atggccagaaccaagcagaccgccagaaagagcaccggcggcaaggcccccagaaagcagctggccaccaaggccgccagaaagagcgcccccgccaccggcggcgtgaagaagccccacagatacagacccggcaccgtggccctgagagagatcagaagataccagaagagcaccgagctgctgatcagaaagctgcccttccagagactggtgagagagatcgcccaggagttcaagaccgacctgagattccagagcagcgccgtgatggccctgcaggaggccagagaggcctacctggtgggcctgttcgaggacaccaacctgtgcgccatccacgccaagagagtgaccatcatgcccaaggacatccagctggtgagcagaatcagaggcgagagagcctag

SEQ ID NO: 8364 - DNA, 393 bp, Artificial Sequence
  Description of Artificial Sequence: Synthetic coding sequence
atgagcggcagaggcaagcagggcggcaaggccagagccaaggccaagagcagaagcagcagagccggcctgcagttccccgtgggcagagtgcacagactgctgagaaagggcaactacagcgagagagtgggcgccggcgcccccgtgtacctggccgccgtgctggagtacctgaccgccgagatcctggagctggccggcaacgccgccagagacaacaagaagaccagaatcatccccagacacctgcagctggccatcagaaacgacgaggagctgaacaagctgctgggcagagtgaccatcgcccagggcggcgtgctgcccaacatccaggccgtgctgctgcccaagaagaccgagagccaccacaaggccaagggcaagtag

SEQ ID NO: 8365 - DNA, 381 bp, Artificial Sequence
  Description of Artificial Sequence: Synthetic coding sequence
atgcccgaccccagcaagagcgcccccgcccccaagaagggcagcaagaaggccgtgaccaaggcccagaagaaggacggcaagaagagaaagagaggcagaaaggagagctacagcatctacgtgtacaaggtgctgaagcaggtgcaccccgacaccggcatcagcagcaaggccatgggcatcatgaacagcttcgtgaacgacatcttcgagagaatcgccagcgaggccagcagactggcccactacaacaagagaagcaccatcaccagcagagaggtgcagaccgccgtgagactgctgctgcccggcgagctggccaagcacgccgtgagcgagggcaccaaggccgtgaccaagtacaccagcagcaagtag

SEQ ID NO: 8366 - DNA, 1554 bp, Artificial Sequence
  Description of Artificial Sequence: Synthetic coding sequence
atgcccccccccggcaaggtgcccagaaaggagaacctgtggctgcagtgcgagtggggcagctgcagcttcgtgtgcagcaccatggagaagttcttcgagcacgtgacccagcacctgcagcagcacctgcacggcagcggcgaggaggaggaggaggaggaggaggacgaccccctggaggaggagttcagctgcctgtggcaggagtgcggcttctgcagcctggacagcagcgccgacctgatcagacacgtgtacttccactgctaccacaccaagctgaagcagtggggcctgcaggccctgcagagccaggccgacctgggcccctgcatcctggacttccagagcagaaacgtgatccccgacatccccgaccacttcctgtgcctgtgggagcactgcgagaacagcttcgacaaccccgagtggttctacagacacgtggaggcccacagcctgtgctgcgagtacgaggccgtgggcaaggacaaccccgtggtgctgtgcggctggaagggctgcacctgcaccttcaaggacagaagcaagctgagagagcacctgagaagccacacccaggagaaggtggtggcctgccccacctgcggcggcatgttcgccaacaacaccaagttcctggaccacatcagaagacagaccagcctggaccagcagcacttccagtgcagccactgcagcaagagattcgccaccgagagactgctgagagaccacatgagaaaccacgtgaaccactacaagtgccccctgtgcgacatgacctgccccctgcccagcagcctgagaaaccacatgagattcagacacagcgaggacagacccttcaagtgcgactgctgcgactacagctgcaagaacctgatcgacctgcagaagcacctggacacccacagcgaggagcccgcctacagatgcgacttcgagaactgcaccttcagcgccagaagcctgtgcagcatcaagagccactacagaaaggtgcacgagggcgacagcgagcccagatacaagtgccacgtgtgcgacaagtgcttcaccagaggcaacaacctgaccgtgcacctgagaaagaagcaccagttcaagtggcccagcggccaccccagattcagatacaaggagcacgaggacggctacatgagactgcagctggtgagatacgagagcgtggagctgacccagcagctgctgagacagccccaggagggcagcggcctgggcaccagcctgaacgagagcagcctgcagggcatcatcctggagaccgtgcccggcgagcccggcagaaaggaggaggaggaggagggcaagggcagcgagggcaccgccctgagcgccagccaggacaaccccagcagcgtgatccacgtggtgaaccagaccaacgcccagggccagcaggagatcgtgtactacgtgctgagcgaggcccccggcgagcccccccccgcccccgagccccccagcggcggcatcatggagaagctgcagggcatcgccgaggagcccgagatccagatggtgtag

SEQ ID NO: 8367 - DNA, 1260 bp, Artificial Sequence
  Description of Artificial Sequence: Synthetic coding sequence
atgcccccccccggcaaggtgcccagaaaggagaacctgtggctgcagtgcgagtggggcagctgcagcttcgtgtgcagcaccatggagaagttcttcgagcacgtgacccagcacctgcagcagcacctgcacggcagcggcgaggaggaggaggaggaggaggaggacgaccccctggaggaggagttcagctgcctgtggcaggagtgcggcttctgcagcctggacagcagcgccgacctgatcagacacgtgtacttccactgctaccacaccaagctgaagcagtggggcctgcaggccctgcagagccaggccgacctgggcccctgcatcctggacttccagagcagaaacgtgatccccgacatccccgaccacttcctgtgcctgtgggagcactgcgagaacagcttcgacaaccccgagtggttctacagacacgtggaggcccacagcctgtgctgcgagtacgaggccgtgggcaaggacaaccccgtggtgctgtgcggctggaagggctgcacctgcaccttcaaggacagaagcaagctgagagagcacctgagaagccacacccaggagaaggtggtggcctgccccacctgcggcggcatgttcgccaacaacaccaagttcctggaccacatcagaagacagaccagcctggaccagcagcacttccagtgcagccactgcagcaagagattcgccaccgagagactgctgagagaccacatgagaaaccacgtgaaccactacaagtgccccctgtgcgacatgacctgccccctgcccagcagcctgagaaaccacatgagattcagacacagcgaggacagacccttcaagtgcgactgctgcgactacagctgcaagaacctgatcgacctgcagaagcacctggacacccacagcgaggagcccgcctacagatgcgacttcgagaactgcaccttcagcgccagaagcctgtgcagcatcaagagccactacagaaaggtgcacgagggcgacagcgagcccagatacaagtgccacgtgtgcgacaagtgcttcaccagaggcaacaacctgaccgtgcacctgagaaagaagcaccagttcaagtggcccagcggccaccccagattcagactgggccacttctgcatccccctgcccggcttcgccgccctgtacgcccccaccagccccggcaccagaaacatgaagatggccatctgcggctgcagctggttcgccaccagagtgtag

SEQ ID NO: 8368 - DNA, 306 bp, Artificial Sequence
  Description of Artificial Sequence: Synthetic coding sequence
atgaacctggagagagtgagcaacgaggagaagctgaacctgtgcagaaagtactacctgggcggcttcgccttcctgcccttcctgtggctggtgaacatcttctggttcttcagagaggccttcctggtgcccgcctacaccgagcagagccagatcaagggctacgtgtggagaagcgccgtgggcttcctgttctgggtgatcgtgctgaccagctggatcaccatcttccagatctacagacccagatggggcgccctgggcgactacctgagcttcaccatccccctgggcaccccctag

SEQ ID NO: 8369 - DNA, 1749 bp, Artificial Sequence
  Description of Artificial Sequence: Synthetic coding sequence
atggccgccgccgccggcggcggcagctgccccggccccggcagcgccagaggcagattccccggcagacccagaggcgccggcggcggcggcggcagaggcggcagaggcaacggcgccgagagagtgagagtggccctgagaagaggcggcggcgccaccggccccggcggcgccgagcccggcgaggacaccgccctgctgagactgctgggcctgagaagaggcctgagaagactgagaagactgtgggccggccccagagtgcagagaggcagaggcagaggcagaggcagaggctggggccccagcagaggctgcgtgcccgaggaggagagcagcgacggcgagagcgacgaggaggagttccagggcttccacagcgacgaggacgtggcccccagcagcctgagaagcgccctgagaagccagagaggcagagcccccagaggcagaggcagaaagcacaagaccacccccctgcccccccccagactggccgacgtggcccccaccccccccaagacccccgccagaaagagaggcgaggagggcaccgagagaatggtgcaggccctgaccgagctgctgagaagagcccaggccccccaggcccccagaagcagagcctgcgagcccagcacccccagaagaagcagaggcagaccccccggcagacccgccggcccctgcagaagaaagcagcaggccgtggtggtggccgaggccgccgtgaccatccccaagcccgagccccccccccccgtggtgcccgtgaagcaccagaccggcagctggaagtgcaaggagggccccggccccggccccggcacccccagaagaggcggccagagcagcagaggcggcagaggcggcagaggcagaggcagaggcggcggcctgcccttcgtgatcaagttcgtgagcagagccaagaaggtgaagatgggccagctgagcctgggcctggagagcggccagggccagggccagcacgaggagagctggcaggacgtgccccagagaagagtgggcagcggccagggcggcagcccctgctggaagaagcaggagcagaagctggacgacgaggaggaggagaagaaggaggaggaggagaaggacaaggagggcgaggagaaggaggagagagccgtggccgaggagatgatgcccgccgccgagaaggaggaggccaagctgccccccccccccctgaccccccccgcccccagcccccccccccccctgcccccccccagcaccagcccccccccccccctgtgcccccccccccccccccccgtgagccccccccccctgcccagccccccccccccccccgcccaggaggagcaggaggagagccccccccccgtggtgcccgccacctgcagcagaaagagaggcagaccccccctgacccccagccagagagccgagagagaggccgccagagccggccccgagggcaccagcccccccacccccacccccagcaccgccaccggcggcccccccgaggacagccccaccgtggcccccaagagcaccaccttcctgaagaacatcagacagttcatcatgcccgtgcccctgagccagagcctgctgctgcccatgaccctgcagctgagcctgagcctgggccagtgggccgcccccaccaccagcgcctgcctggacagccccctgtggagccccctgctgctgagacccagatgccccctgaccggcctgcagctgtag

SEQ ID NO: 8370 - DNA, 8148 bp, Artificial Sequence
  Description of Artificial Sequence: Synthetic coding sequence
atggccgccgccgccggcggcggcagctgccccggccccggcagcgccagaggcagattccccggcagacccagaggcgccggcggcggcggcggcagaggcggcagaggcaacggcgccgagagagtgagagtggccctgagaagaggcggcggcgccaccggccccggcggcgccgagcccggcgaggacaccgccctgctgagactgctgggcctgagaagaggcctgagaagactgagaagactgtgggccggccccagagtgcagagaggcagaggcagaggcagaggcagaggctggggccccagcagaggctgcgtgcccgaggaggagagcagcgacggcgagagcgacgaggaggagttccagggcttccacagcgacgaggacgtggcccccagcagcctgagaagcgccctgagaagccagagaggcagagcccccagaggcagaggcagaaagcacaagaccacccccctgcccccccccagactggccgacgtggcccccaccccccccaagacccccgccagaaagagaggcgaggagggcaccgagagaatggtgcaggccctgaccgagctgctgagaagagcccaggccccccaggcccccagaagcagagcctgcgagcccagcacccccagaagaagcagaggcagaccccccggcagacccgccggcccctgcagaagaaagcagcaggccgtggtggtggccgaggccgccgtgaccatccccaagcccgagccccccccccccgtggtgcccgtgaagcaccagaccggcagctggaagtgcaaggagggccccggccccggccccggcacccccagaagaggcggccagagcagcagaggcggcagaggcggcagaggcagaggcagaggcggcggcctgcccttcgtgatcaagttcgtgagcagagccaagaaggtgaagatgggccagctgagcctgggcctggagagcggccagggccagggccagcacgaggagagctggcaggacgtgccccagagaagagtgggcagcggccagggcggcagcccctgctggaagaagcaggagcagaagctggacgacgaggaggaggagaagaaggaggaggaggagaaggacaaggagggcgaggagaaggaggagagagccgtggccgaggagatgatgcccgccgccgagaaggaggaggccaagctgccccccccccccctgaccccccccgcccccagcccccccccccccctgcccccccccagcaccagcccccccccccccctgtgcccccccccccccccccccgtgagccccccccccctgcccagccccccccccccccccgcccaggaggagcaggaggagagccccccccccgtggtgcccgccacctgcagcagaaagagaggcagaccccccctgacccccagccagagagccgagagagaggccgccagagccggccccgagggcaccagcccccccacccccacccccagcaccgccaccggcggcccccccgaggacagccccaccgtggcccccaagagcaccaccttcctgaagaacatcagacagttcatcatgcccgtggtgagcgccagaagcagcagagtgatcaagacccccagaagattcatggacgaggacccccccaagccccccaaggtggaggtgagccccgtgctgagaccccccatcaccaccagcccccccgtgccccaggagcccgcccccgtgcccagcccccccagagcccccaccccccccagcacccccgtgcccctgcccgagaagagaagaagcatcctgagagagcccaccttcagatggaccagcctgaccagagagctgcccccccccccccccgcccccccccccccccccgcccccagccccccccccgcccccgccaccagcagcagaagacccctgctgctgagagccccccagttcacccccagcgaggcccacctgaagatctacgagagcgtgctgacccccccccccctgggcgcccccgaggcccccgagcccgagcccccccccgccgacgacagccccgccgagcccgagcccagagccgtgggcagaaccaaccacctgagcctgcccagattcgcccccgtggtgaccacccccgtgaaggccgaggtgagcccccacggcgcccccgccctgagcaacggcccccagacccaggcccagctgctgcagcccctgcaggccctgcagacccagctgctgccccaggccctgccccccccccagccccagctgcagcccccccccagcccccagcagatgccccccctggagaaggccagaatcgccggcgtgggcagcctgcccctgagcggcgtggaggagaagatgttcagcctgctgaagagagccaaggtgcagctgttcaagatcgaccagcagcagcagcagaaggtggccgccagcatgcccctgagccccggcggccagatggaggaggtggccggcgccgtgaagcagatcagcgacagaggccccgtgagaagcgaggacgagagcgtggaggccaagagagagagacccagcggccccgagagccccgtgcagggccccagaatcaagcacgtgtgcagacacgccgccgtggccctgggccaggccagagccatggtgcccgaggacgtgcccagactgagcgccctgcccctgagagacagacaggacctggccaccgaggacaccagcagcgccagcgagaccgagagcgtgcccagcagaagcagaagaggcaaggtggaggccgccggccccggcggcgagagcgagcccaccggcagcggcggcaccctggcccacacccccagaagaagcctgcccagccaccacggcaagaagatgagaatggccagatgcggccactgcagaggctgcctgagagtgcaggactgcggcagctgcgtgaactgcctggacaagcccaagttcggcggccccaacaccaagaagcagtgctgcgtgtacagaaagtgcgacaagatcgaggccagaaagatggagagactggccaagaagggcagaaccatcgtgaagaccctgctgccctgggacagcgacgagagccccgaggccagccccggcccccccggccccagaagaggcgccggcgccggcggccccagagaggaggtggtggcccaccccggccccgaggagcaggacagcctgctgcagagaaagagcgccagaagatgcgtgaagcagagacccagctacgacatcttcgaggacagcgacgacagcgagcccggcggcccccccgcccccagaagaagaacccccagagagaacgagctgcccctgcccgagcccgaggagcagagcagacccagaaagcccaccctgcagcccgtgctgcagctgaaggccagaagaagactggacaaggacgccctggcccccggccccttcgccagcttccccaacggctggaccggcaagcagaagagccccgacggcgtgcacagagtgagagtggacttcaaggaggactgcgacctggagaacgtgtggctgatgggcggcctgagcgtgctgaccagcgtgcccggcggcccccccatggtgtgcctgctgtgcgccagcaagggcctgcacgagctggtgttctgccaggtgtgctgcgaccccttccaccccttctgcctggaggaggccgagagacccctgccccagcaccacgacacctggtgctgcagaagatgcaagttctgccacgtgtgcggcagaaagggcagaggcagcaagcacctgctggagtgcgagagatgcagacacgcctaccaccccgcctgcctgggccccagctaccccaccagagccaccagaaagagaagacactggatctgcagcgcctgcgtgagatgcaagagctgcggcgccacccccggcaagaactgggacgtggagtggagcggcgactacagcctgtgccccagatgcacccagctgtacgagaagggcaactactgccccatctgcaccagatgctacgaggacaacgactacgagagcaagatgatgcagtgcgcccagtgcgaccactgggtgcacgccaagtgcgagggcctgagcgacgaggactacgagatcctgagcggcctgcccgacagcgtgctgtacacctgcggcccctgcgccggcgccgcccagcccagatggagagaggccctgagcggcgccctgcagggcggcctgagacaggtgctgcagggcctgctgagcagcaaggtggtgggccccctgctgctgtgcacccagtgcggccccgacggcaagcagctgcaccccggcccctgcggcctgcaggccgtgagccagagattcgaggacggccactacaagagcgtgcacagcttcatggaggacatggtgggcatcctgatgagacacagcgaggagggcgagacccccgacagaagagccggcggccagatgaagggcctgctgctgaagctgctggagagcgccttcggctggttcgacgcccacgaccccaagtactggagaagaagcaccagactgcccaacggcgtgctgcccaacgccgtgctgccccccagcctggaccacgtgtacgcccagtggagacagcaggagcccgagacccccgagagcggccagccccccggcgaccccagcgccgccttccagggcaaggaccccgccgccttcagccacctggaggaccccagacagtgcgccctgtgcctgaagtacggcgacgccgacagcaaggaggccggcagactgctgtacatcggccagaacgagtggacccacgtgaactgcgccatctggagcgccgaggtgttcgaggagaacgacggcagcctgaagaacgtgcacgccgccgtggccagaggcagacagatgagatgcgagctgtgcctgaagcccggcgccaccgtgggctgctgcctgagcagctgcctgagcaacttccacttcatgtgcgccagagccagctactgcatcttccaggacgacaagaaggtgttctgccagaagcacaccgacctgctggacggcaaggagatcgtgaaccccgacggcttcgacgtgctgagaagagtgtacgtggacttcgagggcatcaacttcaagagaaagttcctgaccggcctggagcccgacgccatcaacgtgctgatcggcagcatcagaatcgacagcctgggcaccctgagcgacctgagcgactgcgagggcagactgttccccatcggctaccagtgcagcagactgtactggagcaccgtggacgccagaagaagatgctggtacagatgcagaatcctggagtacagaccctggggccccagagaggagcccgcccacctggaggccgccgaggagaaccagaccatcgtgcacagccccgcccccagcagcgagccccccggcggcgaggacccccccctggacaccgacgtgctggtgcccggcgcccccgagagacacagccccatccagaacctggacccccccctgagacccgacagcggcagcgcccccccccccgcccccagaagcttcagcggcgccagaatcaaggtgcccaactacagccccagcagaagacccctgggcggcgtgagcttcggccccctgcccagccccggcagccccagcagcctgacccaccacatccccaccgtgggcgaccccgacttccccgccccccccagaagaagcagaagacccagccccctggcccccagacccccccccagcagatgggccagcccccccctgaagaccagcccccagctgagagtgcccccccccaccagcgtggtgaccgccctgacccccaccagcggcgagctggccccccccggccccgcccccagcccccccccccccgaggacctgggccccgacttcgaggacatggaggtggtgagcggcctgagcgccgccgacctggacttcgccgccagcctgctgggcaccgagcccttccaggaggagatcgtggccgccggcgccatgggcagcagccacggcggccccggcgacagcagcgaggaggagagcagccccaccagcagatacatccacttccccgtgaccgtggtgagcgcccccggcctggcccccagcgccacccccggcgcccccagaatcgagcagctggacggcgtggacgacggcaccgacagcgaggccgaggccgtgcagcagcccagaggccagggcaccccccccagcggccccggcgtggtgagagccggcgtgctgggcgccgccggcgacagagccagaccccccgaggacctgcccagcgagatcgtggacttcgtgctgaagaacctgggcggccccggcgacggcggcgccggccccagagaggagagcctgccccccgccccccccctggccaacggcagccagcccagccagggcctgaccgccagccccgccgaccccaccagaaccttcgcctggctgcccggcgcccccggcgtgagagtgctgagcctgggccccgcccccgagccccccaagcccgccaccagcaagatcatcctggtgaacaagctgggccaggtgttcgtgaagatggccggcgagggcgagcccgtgcccccccccgtgaagcagccccccctgccccccaccatcagccccaccgcccccaccagctggaccctgccccccggccccctgctgggcgtgctgcccgtggtgggcgtggtgagacccgcccccccccccccccccccccccctgaccctggtgctgagcagcggccccgccagcccccccagacaggccatcagagtgaagagagtgagcaccttcagcggcagaagcccccccgccccccccccctacaaggcccccagactggacgaggacggcgaggccagcgaggacaccccccaggtgcccggcctgggcagcggcggcttcagcagagtgagaatgaagacccccaccgtgagaggcgtgctggacctggacagacccggcgagcccgccggcgaggagagccccggccccctgcaggagagaagccccctgctgcccctgcccgaggacggccccccccaggtgcccgacggcccccccgacctgctgctggagagccagtggcaccactacagcggcgaggccagcagcagcgaggaggagccccccagccccgacgacaaggagaaccaggcccccaagagaaccggcccccacctgagattcgagatcagcagcgaggacggcttcagcgtggaggccgagagcctggagggcgcctggagaaccctgatcgagaaggtgcaggaggccagaggccacgccagactgagacacctgagcttcagcggcatgagcggcgccagactgctgggcatccaccacgacgccgtgatcttcctggccgagcagctgcccggcgcccagagatgccagcactacaagttcagataccaccagcagggcgagggccaggaggagccccccctgaacccccacggcgccgccagagccgaggtgtacctgagaaagtgcaccttcgacatgttcaacttcctggccagccagcacagagtgctgcccgagggcgccacctgcgacgaggaggaggacgaggtgcagctgagaagcaccagaagagccaccagcctggagctgcccatggccatgagattcagacacctgaagaagaccagcaaggaggccgtgggcgtgtacagaagcgccatccacggcagaggcctgttctgcaagagaaacatcgacgccggcgagatggtgatcgagtacagcggcatcgtgatcagaagcgtgctgaccgacaagagagagaagttctacgacggcaagggcatcggctgctacatgttcagaatggacgacttcgacgtggtggacgccaccatgcacggcaacgccgccagattcatcaaccacagctgcgagcccaactgcttcagcagagtgatccacgtggagggccagaagcacatcgtgatcttcgccctgagaagaatcctgagaggcgaggagctgacctacgactacaagttccccatcgaggacgccagcaacaagctgccctgcaactgcggcgccaagagatgcagaagattcctgaactag

SEQ ID NO: 8371 - DNA, 2892 bp, Artificial Sequence
  Description of Artificial Sequence: Synthetic coding sequence
atggccgtggcccccagactgttcggcggcctgtgcttcagattcagagaccagaaccccgaggtggccgtggagggcagactgcccatcagccacagctgcgtgggctgcagaagagagagaaccgccatggccaccgtggccgccaaccccgccgccgccgccgccgccgtggccgccgccgccgccgtgaccgaggacagagagccccagcacgaggagctgcccggcctggacagccagtggagacagatcgagaacggcgagagcggcagagagagacccctgagagccggcgagagctggttcctggtggagaagcactggtacaagcagtgggaggcctacgtgcagggcggcgaccaggacagcagcaccttccccggctgcatcaacaacgccaccctgttccaggacgagatcaactggagactgaaggagggcctggtggagggcgaggactacgtgctgctgcccgccgccgcctggcactacctggtgagctggtacggcctggagcacggccagccccccatcgagagaaaggtgatcgagctgcccaacatccagaaggtggaggtgtaccccgtggagctgctgctggtgagacacaacgacctgggcaagagccacaccgtgcagttcagccacaccgacagcatcggcctggtgctgagaaccgccagagagagattcctggtggagccccaggaggacaccagactgtgggccaagaacagcgagggcagcctggacagactgtacgacacccacatcaccgtgctggacgccgccctggagaccggccagctgatcatcatggagaccagaaagaaggacggcacctggcccagcgcccagctgcacgtgatgaacaacaacatgagcgaggaggacgaggacttcaagggccagcccggcatctgcggcctgaccaacctgggcaacacctgcttcatgaacagcgccctgcagtgcctgagcaacgtgccccagctgaccgagtacttcctgaacaactgctacctggaggagctgaacttcagaaaccccctgggcatgaagggcgagatcgccgaggcctacgccgacctggtgaagcaggcctggagcggccaccacagaagcatcgtgccccacgtgttcaagaacaaggtgggccacttcgccagccagttcctgggctaccagcagcacgacagccaggagctgctgagcttcctgctggacggcctgcacgaggacctgaacagagtgaagaagaaggagtacgtggagctgtgcgacgccgccggcagacccgaccaggaggtggcccaggaggcctggcagaaccacaagagaagaaacgacagcgtgatcgtggacaccttccacggcctgttcaagagcaccctggtgtgccccgactgcggcaacgtgagcgtgaccttcgaccccttctgctacctgagcgtgcccctgcccatcagccacaagagagtgctggaggtgttcttcatccccatggaccccagaagaaagcccgagcagcacagactggtggtgcccaagaagggcaagatcagcgacctgtgcgtggccctgagcaagcacaccggcatcagccccgagagaatgatggtggccgacgtgttcagccacagattctacaagctgtaccagctggaggagcccctgagcagcatcctggacagagacgacatcttcgtgtacgaggtgagcggcagaatcgaggccatcgagggcagcagagaggacatcgtggtgcccgtgtacctgagagagagaacccccgccagagactacaacaacagctactacggcctgatgctgttcggccaccccctgctggtgagcgtgcccagagacagattcacctgggagggcctgtacaacgtgctgatgtacagactgagcagatacgtgaccaagcccaacagcgacgacgaggacgacggcgacgagaaggaggacgacgaggaggacaaggacgacgtgcccggccccagcaccggcggcagcctgagagaccccgagcccgagcaggccggccccagcagcggcgtgaccaacagatgccccttcctgctggacaactgcctgggcaccagccagtggccccccagaagaagaagaaagcagctgttcaccctgcagaccgtgaacagcaacggcaccagcgacagaaccaccagccccgaggaggtgcacgcccagccctacatcgccatcgactgggagcccgagatgaagaagagatactacgacgaggtggaggccgagggctacgtgaagcacgactgcgtgggctacgtgatgaagaaggcccccgtgagactgcaggagtgcatcgagctgttcaccaccgtggagaccctggagaaggagaacccctggtactgccccagctgcaagcagcaccagctggccaccaagaagctggacctgtggatgctgcccgagatcctgatcatccacctgaagagattcagctacaccaagttcagcagagagaagctggacaccctggtggagttccccatcagagacctggacttcagcgagttcgtgatccagccccagaacgagagcaaccccgagctgtacaagtacgacctgatcgccgtgagcaaccactacggcggcatgagagacggccactacaccaccttcgcctgcaacaaggacagcggccagtggcactacttcgacgacaacagcgtgagccccgtgaacgagaaccagatcgagagcaaggccgcctacgtgctgttctaccagagacaggacgtggccagaagactgctgagccccgccggcagcagcggcgcccccgccagccccgcctgcagcagcccccccagcagcgagttcatggacgtgaactag

SEQ ID NO: 8372 - DNA, 2166 bp, Artificial Sequence
  Description of Artificial Sequence: Synthetic coding sequence
atgagcggcaccaacctggacggcaacgacgagttcgacgagcagctgagaatgcaggagctgtacggcgacggcaaggacggcgacacccagaccgacgccggcggcgagcccgacagcctgggccagcagcccaccgacaccccctacgagtgggacctggacaagaaggcctggttccccaagatcaccgaggacttcatcgccacctaccaggccaactacggcttcagcaacgacggcgccagcagcagcaccgccaacgtggaggacgtgcacgccagaaccgccgaggagcccccccaggagaaggcccccgagcccaccgacgccagaaagaagggcgagaagagaaaggccgagagcggctggttccacgtggaggaggacagaaacaccaacgtgtacgtgagcggcctgccccccgacatcaccgtggacgagttcatccagctgatgagcaagttcggcatcatcatgagagacccccagaccgaggagttcaaggtgaagctgtacaaggacaaccagggcaacctgaagggcgacggcctgtgctgctacctgaagagagagagcgtggagctggccctgaagctgctggacgaggacgagatcagaggctacaagctgcacgtggaggtggccaagttccagctgaagggcgagtacgacgccagcaagaagaagaagaagtgcaaggactacaagaagaagctgagcatgcagcagaagcagctggactggagacccgagagaagagccggccccagcagaatgagacacgagagagtggtgatcatcaagaacatgttccaccccatggacttcgaggacgaccccctggtgctgaacgagatcagagaggacctgagagtggagtgcagcaagttcggccagatcagaaagctgctgctgttcgacagacaccccgacggcgtggccagcgtgagcttcagagaccccgaggaggccgactactgcatccagaccctggacggcagatggttcggcggcagacagatcaccgcccaggcctgggacggcaccaccgactaccaggtggaggagaccagcagagagagagaggagagactgagaggctgggaggccttcctgaacgcccccgaggccaacagaggcctgagaagaagcgacagcgtgagcgccagcgagagagccggccccagcagagccagacacttcagcgagcaccccagcaccagcaagatgaacgcccaggagaccgccaccggcatggccttcgaggagcccatcgacgagaagaagttcgagaagaccgaggacggcggcgagttcgaggagggcgccagcgagaacaacgccaaggagagcagccccgagaaggaggccgaggagggctgccccgagaaggagagcgaggagggctgccccaagagaggcttcgagggcagctgcagccagaaggagagcgaggagggcaaccccgtgagaggcagcgaggaggacagccccaagaaggagagcaagaagaagaccctgaagaacgactgcgaggagaacggcctggccaaggagagcgaggacgacctgaacaaggagagcgaggaggaggtgggccccaccaaggagagcgaggaggacgacagcgagaaggagagcgacgaggactgcagcgagaagcagagcgaggacggcagcgagagagagttcgaggagaacggcctggagaaggacctggacgaggagggcagcgagaaggagctgcacgagaacgtgctggacaaggagctggaggagaacgacagcgagaacagcgagttcgaggacgacggcagcgagaaggtgctggacgaggagggcagcgagagagagttcgacgaggacagcgacgagaaggaggaggaggaggacacctacgagaaggtgttcgacgacgagagcgacgagaaggaggacgaggacgccgacggcaaggaggtggaggacgccgacgagaagctgttcgaggacgacgacagcaacgagaagctgttcgacgaggaggaggacagcagcgagaagctgttcgacgacagcgacgagagaggcaccctgggcggcttcggcagcgtggaggagggccccctgagcaccggcagcagcttcatcctgagcagcgacgacgacgacgacgacatctag

SEQ ID NO: 8373 - DNA, 672 bp, Artificial Sequence
  Description of Artificial Sequence: Synthetic coding sequence
atgagcggcaccaacctggacggcaacgacgagttcgacgagcagctgagaatgcaggagctgtacggcgacggcaaggacggcgacacccagaccgacgccggcggcgagcccgacagcctgggccagcagcccaccgacaccccctacgagtgggacctggacaagaaggcctggttccccaagatcaccgaggacttcatcgccacctaccaggccaactacggcttcagcaacgacggcgccagcagcagcaccgccaacgtggaggacgtgcacgccagaaccgccgaggagcccccccaggagaaggcccccgagcccaccgacgccagaaagaagggcgagaagagaaaggccgagagcggctggttccacgtggaggaggacagaaacaccaacgtgtacgtgagcggcctgccccccgacatcaccgtggacgagttcatccagctgatgagcaagttcggcatcatcatgagagacccccagaccgaggagttcaaggtgaagctgtacaaggacaaccagggcaacctgaagggcgacggcctgtgctgctacctgaagagagagagcgtggagctggccctgaagctgctggacgaggacgagatcagaggctacaagctgcacgtggaggtggccaagttccagctgaagggcgagtag

SEQ ID NO: 8374 - DNA, 735 bp, Artificial Sequence
  Description of Artificial Sequence: Synthetic coding sequence
atgagcggcaccaacctggacggcaacgacgagttcgacgagcagctgagaatgcaggagctgtacggcgacggcaaggacggcgacacccagaccgacgccggcggcgagcccgacagcctgggccagcagcccaccgacaccccctacgagtgggacctggacaagaaggcctggttccccaagatcaccgaggacttcatcgccacctaccaggccaactacggcttcagcaacgacggcgccagcagcagcaccgccaacgtggaggacgtgcacgccagaaccgccgaggagcccccccaggagaaggcccccgagcccaccgacgccagaaagaagggcgagaagagaaaggccgagagcggctggttccacgtggaggaggacagaaacaccaacgtgtacgtgagcggcctgccccccgacatcaccgtggacgagttcatccagctgatgagcaagttcggcatcatcatgagagacccccagaccgaggagttcaaggtgaagctgtacaaggacaaccagggcaacctgaagggcgacggcctgtgctgctacctgaagagagagagcgtggagctggccctgaagctgctggacgaggacgagatcagaggctacaagctgcacgtggaggtggccaagttccagctgaagggcgagtacgacgccagcaagaagaagaagaagtgcaaggactacaagaagaagctgagcatgcagcagtag

SEQ ID NO: 8375 - DNA, 2268 bp, Artificial Sequence
  Description of Artificial Sequence: Synthetic coding sequence
atgagcggcaccaacctggacggcaacgacgagttcgacgagcagctgagaatgcaggagctgtacggcgacggcaaggacggcgacacccagaccgacgccggcggcgagcccgacagcctgggccagcagcccaccgacaccccctacgagtgggacctggacaagaaggcctggttccccaagatcaccgaggacttcatcgccacctaccaggccaactacggcttcagcaacgacggcgccagcagcagcaccgccaacgtggaggacgtgcacgccagaaccgccgaggagcccccccaggagaaggcccccgagcccaccgacgccagaaagaagggcgagaagagaaaggccgagagcggctggttccacgtggaggaggacagaaacaccaacgtgtacgtgagcggcctgccccccgacatcaccgtggacgagttcatccagctgatgagcaagttcggcatcatcatgagagacccccagaccgaggagttcaaggtgaagctgtacaaggacaaccagggcaacctgaagggcgacggcctgtgctgctacctgaagagagagagcgtggagctggccctgaagctgctggacgaggacgagatcagaggctacaagctgcacgtggaggtggccaagttccagctgaagggcgagtacgacgccagcaagaagaagaagaagtgcaaggactacaagaagaagctgagcatgcagcagaagcagctggactggagacccgagagaagagccggccccagcagaatgagacacgagagagtggtgatcatcaagaacatgttccaccccatggacttcgaggacgaccccctggtgctgaacgagatcagagaggacctgagagtggagtgcagcaagttcggccagatcagaaagctgctgctgttcgacagacaccccgacggcgtggccagcgtgagcttcagagaccccgaggaggccgactactgcatccagaccctggacggcagatggttcggcggcagacagatcaccgcccaggcctgggacggcaccaccgactaccaggtggaggagaccagcagagagagagaggagagactgagaggctgggaggccttcctgaacgcccccgaggccaacagaggcctgagaagaagcgacagcgtgagcgccagcgagagagccggccccagcagagccagacacttcagcgagcaccccagcaccagcaagatgaacgcccaggagaccgccaccggcatggccttcgaggagcccatcgacgagaagaagttcgagaagaccgaggacggcggcgagttcgaggagggcgccagcgagaacaacgccaaggagagcagccccgagaaggaggccgaggagggctgccccgagaaggagagcgaggagggctgccccaagagaggcttcgagggcagctgcagccagaaggagagcgaggagggcaaccccgtgagaggcagcgaggaggacagccccaagaaggagagcaagaagaagaccctgaagaacgactgcgaggagaacggcctggccaaggagagcgaggacgacctgaacaaggagagcgaggaggaggtgggccccaccaaggagagcgaggaggacgacagcgagaaggagagcgacgaggactgcagcgagaagcagagcgaggacggcagcgagagagagttcgaggagaacggcctggagaaggacctggacgaggagggcagcgagaaggagctgcacgagaacgtgctggacaaggagctggaggagaacgacagcgagaacagcgagttcgaggacgacggcagcgagaaggtgctggacgaggagggcagcgagagagagttcgacgaggacagcgacgagaaggaggaggaggaggacacctacgagaaggtgttcgacgacgagagcgacgagaaggaggacgaggagtacgccgacgagaagggcctggaggccgccgacaagaaggccgaggagggcgacgccgacgagaagctgttcgaggagagcgacgacaaggaggacgaggacgccgacggcaaggaggtggaggacgccgacgagaagctgttcgaggacgacgacagcaacgagaagctgttcgacgaggaggaggacagcagcgagaagctgttcgacgacagcgacgagagaggcaccctgggcggcttcggcagcgtggaggagggccccctgagcaccggcagcagcttcatcctgagcagcgacgacgacgacgacgacatctag

SEQ ID NO: 8376 - DNA, 3879 bp, Artificial Sequence
  Description of Artificial Sequence: Synthetic coding sequence
atggacgccagctacgacggcaccgaggtgaccgtggtgatggaggagatcgaggaggcctactgctacaccagccccggcccccccaagaagaagaagaagtacaagatccacggcgagaagaccaagaagcccagaagcgcctacctgctgtactactacgacatctacctgaaggtgcagcaggagctgccccacctgccccagagcgagatcaacaagaagatcagcgagagctggagactgctgagcgtggccgagagaagctactacctggagaaggccaagctggagaaggagggcctggaccccaacagcaagctgagcgccctgaccgccgtggtgcccgacatccccggcttcagaaagatcctgcccagaagcgactacatcatcatccccaagagcagcctgcaggaggacagaagctgcccccagctggagctgtgcgtggcccagaaccagatgagccccaagggcccccccctggtgagcaacaccgcccccgagaccgtgcccagccacgccggcatggccgagcagtgcctggccgtggaggccctggccgaggaggtgggcgccctgacccagagcggcgccgtgcaggagatcgccaccagcgagatcctgagccaggacgtgctgctggaggacgccagcctggaggtgggcgagagccaccagccctaccagaccagcctggtgatcgaggagaccctggtgaacggcagccccgacctgcccaccggcagcctggccgtgccccacccccaggtgggcgagagcgtgagcgtggtgaccgtgatgagagacagcagcgagagcagcagcagcgcccccgccacccagttcatcatgctgcccctgcccgcctacagcgtggtggagaaccccaccagcatcaagctgaccaccacctacaccagaagaggccacggcacctgcaccagccccggctgcagcttcacctacgtgaccagacacaagccccccaagtgccccacctgcggcaacttcctgggcggcaagtggatccccaaggagaagcccgccaaggtgaaggtggagctggccagcggcgtgagcagcaagggcagcgtggtgaagagaaaccagcagcccgtgaccaccgagcagaacagcagcaaggagaacgccagcaagctgaccctggagaacagcgaggccgtgagccagctgctgaacgtggccccccccagagaggtgggcgaggagagcgagtgggaggaggtgatcatcagcgacgcccacgtgctggtgaaggaggcccccggcaactgcggcaccgccgtgaccaagacccccgtggtgaagagcggcgtgcagcccgaggtgaccctgggcaccaccgacaacgacagccccggcgccgacgtgcccacccccagcgagggcaccagcaccagcagccccctgcccgcccccaagaagcccaccggcgccgacctgctgacccccggcagcagagcccccgagctgaagggcagagccagaggcaagcccagcctgctggccgccgccagacccatgagagccatcctgcccgcccccgtgaacgtgggcagaggcagcagcatgggcctgcccagagccagacaggccttcagcctgagcgacaagacccccagcgtgagaacctgcggcctgaagcccagcaccctgaagcagctgggccagcccatccagcagcccagcggccccggcgaggtgaagctgcccagcggccccagcaacagaaccagccaggtgaaggtggtggaggtgaagcccgacatgttccccccctacaagtacagctgcaccgtgaccctggacctgggcctggccaccagcagaggcagaggcaagtgcaagaaccccagctgcagctacgtgtacaccaacagacacaagcccagaatctgccccagctgcggcgtgaacctggccaaggacagaaccgagaagaccaccaaggccatcgaggtgagcagccccctgcccgacgtgctgaacgccaccgagcccctgagcaccgcccagagagagatccagagacagagcaccctgcagctgctgagaaaggtgctgcagatccccgagaacgagagcgagctggccgaggtgttcgccctgatccacgagctgaacagcagcagactgatcctgagcaacgtgagcgaggagaccgtgaccatcgagcagaccagctggagcaactactacgagagccccagcacccagtgcctgctgtgcagcagccccctgttcaagggcggccagaacagcctggccggcccccaggagtgctggctgctgaccgccagcagactgcagaccgtgaccgcccaggtgaagatgtgcctgaacccccactgcctggccctgcacagcttcatcgacatctacaccggcctgttcaacgtgggcaacaagctgctggtgagcctggacctgctgttcgccatcagaaaccagatcaagctgggcgaggaccccagagtgagcatcaacgtggtgctgaagagcgtgcaggagcagaccgagaagaccctgaccagcgaggagctgagccagctgcaggagctgctgtgcaacggctactgggccttcgagtgcctgaccgtgagagactacaacgacatgatctgcggcatctgcggcgtggcccccaaggtggagatggcccagagaagcgaggagaacgtgctggccctgaagagcgtggagttcacctggcccgagttcctgggcagcaacgaggtgaacgtggaggacttctgggccaccatggagaccgaggtgatcgagcaggtggccttccccgccagcatccccatcaccaagttcgacgccagcgtgatcgcccccttcttcccccccctgatgagaggcgccgtggtggtgaacaccgagaaggacaagaacctggacgtgcagcccgtgcccggcagcggcagcgccctggtgagactgctgcaggagggcacctgcaagctggacgagatcggcagctacagcgaggagaagctgcagcacctgctgagacagtgcggcatccccttcggcgccgaggacagcaaggaccagctgtgcttcagcctgctggccctgtacgagagcgtgcagaacggcgccagagccatcagaccccccagacacttcaccggcggcaagatctacaaggtgtgcccccaccaggtggtgtgcggcagcaagtacctggtgagaggcgagagcgccagagaccacgtggacctgctggccagcagcagacactggccccccgtgtacgtggtggacatggccaccagcgtggccctgtgcgccgacctgtgctaccccgagctgaccaaccagatgtggggcagaaaccagggctgcttcagcagccccaccgagccccccgtgagcgtgagctgccccgagctgctggaccagcactacaccgtggacatgaccgagaccgagcacagcatccagcaccccgtgaccaagaccgccaccagaagaatcgtgcacgccggcctgcagcccaaccccggcgaccccagcgccggccaccacagcctggccctgtgccccgagctggccccctacgccaccatcctggccagcatcgtggacagcaagcccaacggcgtgagacagagacccatcgccttcgacaacgccacccactactacctgtacaacagactgatggacttcctgaccagcagagagatcgtgaacagacagatccacgacatcgtgcagagctgccagcccggcgaggtggtgatcagagacaccctgtacagactgggcgtggcccagatcaagaccgagaccgaggaggagggcgaggaggaggaggtggccgccgtggccgagtag

SEQ ID NO: 8377 - DNA, 2310 bp, Artificial Sequence
  Description of Artificial Sequence: Synthetic coding sequence
atgtgcggcagcgccctggccttcttcaccgccgccttcgtgtgcctgcagaacgacagaagaggccccgccagcttcctgtgggccgcctgggtgttcagcctggtgctgggcctgggccagggcgaggacaacagatgcgccagcagcaacgccgccagctgcgccagatgcctggccctgggccccgagtgcggctggtgcgtgcaggaggacttcatcagcggcggcagcagaagcgagagatgcgacatcgtgagcaacctgatcagcaagggctgcagcgtggacagcatcgagtaccccagcgtgcacgtgatcatccccaccgagaacgagatcaacacccaggtgacccccggcgaggtgagcatccagctgagacccggcgccgaggccaacttcatgctgaaggtgcaccccctgaagaagtaccccgtggacctgtactacctggtggacgtgagcgccagcatgcacaacaacatcgagaagctgaacagcgtgggcaacgacctgagcagaaagatggccttcttcagcagagacttcagactgggcttcggcagctacgtggacaagaccgtgagcccctacatcagcatccaccccgagagaatccacaaccagtgcagcgactacaacctggactgcatgcccccccacggctacatccacgtgctgagcctgaccgagaacatcaccgagttcgagaaggccgtgcacagacagaagatcagcggcaacatcgacacccccgagggcggcttcgacgccatgctgcaggccgccgtgtgcgagagccacatcggctggagaaaggaggccaagagactgctgctggtgatgaccgaccagaccagccacctggccctggacagcaagctggccggcatcgtggtgcccaacgacggcaactgccacctgaagaacaacgtgtacgtgaagagcaccaccatggagcaccccagcctgggccagctgagcgagaagctgatcgacaacaacatcaacgtgatcttcgccgtgcagggcaagcagttccactggtacaaggacctgctgcccctgctgcccggcaccatcgccggcgagatcgagagcaaggccgccaacctgaacaacctggtggtggaggcctaccagaagctgatcagcgaggtgaaggtgcaggtggagaaccaggtgcagggcatctacttcaacatcaccgccatctgccccgacggcagcagaaagcccggcatggagggctgcagaaacgtgaccagcaacgacgaggtgctgttcaacgtgaccgtgaccatgaagaagtgcgacgtgaccggcggcaagaactacgccatcatcaagcccatcggcttcaacgagaccgccaagatccacatccacagaaactgcagctgccagtgcgaggacaacagaggccccaagggcaagtgcgtggacgagaccttcctggacagcaagtgcttccagtgcgacgagaacaagtgccacttcgacgaggaccagttcagcagcgagagctgcaagagccacaaggaccagcccgtgtgcagcggcagaggcgtgtgcgtgtgcggcaagtgcagctgccacaagatcaagctgggcaaggtgtacggcaagtactgcgagaaggacgacttcagctgcccctaccaccacggcaacctgtgcgccggccacggcgagtgcgaggccggcagatgccagtgcttcagcggctgggagggcgacagatgccagtgccccagcgccgccgcccagcactgcgtgaacagcaagggccaggtgtgcagcggcagaggcacctgcgtgtgcggcagatgcgagtgcaccgaccccagaagcatcggcagattctgcgagcactgccccacctgctacaccgcctgcaaggagaactggaactgcatgcagtgcctgcacccccacaacctgagccaggccatcctggaccagtgcaagaccagctgcgccctgatggagcagcagcactacgtggaccagaccagcgagtgcttcagcagccccagctacctgagaatcttcttcatcatcttcatcgtgaccttcctgatcggcctgctgaaggtgctgatcatcagacaggtgatcctgcagtggaacagcaacaagatcaagagcagcagcgactacagagtgagcgccagcaagaaggacaagctgatcctgcagagcgtgtgcaccagagccgtgacctacagaagagagaagcccgaggagatcaagatggacatcagcaagctgaacgcccacgagaccttcagatgcaacttctag

SEQ ID NO: 8378 - DNA, 375 bp, Artificial Sequence
  Description of Artificial Sequence: Synthetic coding sequence
atggtgtgggaggtgaagaccaaccagatgcccaacgccgtgcagaagctgctgctggtgatggacaagagagccagcggcatgaacgacagcctggagctgctgcagtgcaacgagaacctgcccagcagccccggctacaacagctgcgacgagcacatggagctggacgacctgcccgagctgcaggccgtgcagagcgaccccacccagagcggcatgtaccagctgagcagcgacgtgagccaccaggagtaccccagaagcagctggaaccagaacaccagcgacatccccgagaccacctacagagagaacgaggtggactggctgaccgagctggccaacatcgccaccagcccccagagcccctag

SEQ ID NO: 8379 - DNA, 87 bp, Artificial Sequence
  Description of Artificial Sequence: Synthetic coding sequence
atggtgtgggaggtgaagaccaaccagatgcccaacgccgtgcagaagctgctgctggtgatggacaagagagccagcggcatgtag

SEQ ID NO: 8380 - DNA, 1545 bp, Artificial Sequence
  Description of Artificial Sequence: Synthetic coding sequence
atggtgtgggaggtgaagaccaaccagatgcccaacgccgtgcagaagctgctgctggtgatggacaagagagccagcggcatgaacgacagcctggagctgctgcagtgcaacgagaacctgcccagcagccccggctacaacagctgcgacgagcacatggagctggacgacctgcccgagctgcaggccgtgcagagcgaccccacccagagcggcatgtaccagctgagcagcgacgtgagccaccaggagtaccccagaagcagctggaaccagaacaccagcgacatccccgagaccacctacagagagaacgaggtggactggctgaccgagctggccaacatcgccaccagcccccagagccccctgatgcagtgcagcttctacaacagaagcagccccgtgcacatcatcgccaccagcaagagcctgcacagctacgccagacccccccccgtgagcagcagcagcaagagcgagcccgccttcccccaccaccactggaaggaggagacccccgtgagacacgagagagccaacagcgagagcgagagcggcatcttctgcatgagcagcctgagcgacgacgacgacctgggctggtgcaacagctggcccagcaccgtgtggcactgcttcctgaagggcaccagactgtgcttccacaagggcagcaacaaggagtggcaggacgtggaggacttcgccagagccgagggctgcgacaacgaggaggacctgcagatgggcatccacaagggctacggcagcgacggcctgaagctgctgagccacgaggagagcgtgagcttcggcgagagcgtgctgaagctgaccttcgaccccggcaccgtggaggacggcctgctgaccgtggagtgcaagctggaccaccccttctacgtgaagaacaagggctggagcagcttctaccccagcctgaccgtggtgcagcacggcatcccctgctgcgaggtgcacatcggcgacgtgtgcctgccccccggccaccccgacgccatcaacttcgacgacagcggcgtgttcgacaccttcaagagctacgacttcacccccatggacagcagcgccgtgtacgtgctgagcagcatggccagacagagaagagccagcctgagctgcggcggccccggcggccaggacttcgccagaagcggcttcagcaagaactgcggcagccccggcagcagccagctgagcagcaacagcctgtacgccaaggccgtgaagaaccacagcagcggcaccgtgagcgccaccagccccaacaagtgcaagagacccatgaacgccttcatgctgttcgccaagaagtacagagtggagtacacccagatgtaccccggcaaggacaacagagccatcagcgtgatcctgggcgacagatggaagaagatgaagaacgaggagagaagaatgtacaccctggaggccaaggccctggccgaggagcagaagagactgaaccccgactgctggaagagaaagagaaccaacagcggcagccagcagcactag

SEQ ID NO: 8381 - DNA, 213 bp, Artificial Sequence
  Description of Artificial Sequence: Synthetic coding sequence
atggtgtgggaggtgaagaccaaccagatgcccaacgccgtgcagaagctgctgctggtgatggacaagagagccagcggcatgaacgacagcctggagctgctgcagtgcaacgagaacctgcccagcagccccggctacaacagctgcgacgagcacatggagctggacgacctgcccgagctgcaggccgtgcagagcgaccccacctag

SEQ ID NO: 8382 - DNA, 336 bp, Artificial Sequence
  Description of Artificial Sequence: Synthetic coding sequence
atggtgtgggaggtgaagaccaaccagatgcccaacgccgtgcagaagctgctgctggtgatggacaagagagccagcggcatgaacgacagcctggagctgctgcagtgcaacgagaacctgcccagcagccccggctacaacagctgcgacgagcacatggagctggacgacctgcccgagctgcaggccgtgcagagcgaccccacccagagcggcatgtaccagctgagcagcgacgtgagccaccaggagtaccccagaagcagctggaaccagaacaccagcgacatccccgagaccacctacagagagaacgaggtggactggctgtag

SEQ ID NO: 8383 - DNA, 1545 bp, Artificial Sequence; identical to SEQ ID NO: 8380
  Description of Artificial Sequence: Synthetic coding sequence

SEQ ID NO: 8384 - DNA, 327 bp, Artificial Sequence
  Description of Artificial Sequence: Synthetic coding sequence
atggtgtgggaggtgaagaccaaccagatgcccaacgccgtgcagaagctgctgctggtgatggacaagagagccagcggcatgaacgacagcctggagctgctgcagtgcaacgagaacctgcccagcagccccggctacaacagctgcgacgagcacatggagctggacgacctgcccgagctgcaggccgtgcagagcgaccccacccagagcggcatgtaccagctgagcagcgacgtgagccaccaggagtaccccagaagcagctggaaccagaacaccagcgacatccccgagaccacctacagagagaacgaggtgtag

SEQ ID NO: 8385 - DNA, 1365 bp, Artificial Sequence
  Description of Artificial Sequence: Synthetic coding sequence
cagatgcccaacgccgtgcagaagctgctgctggtgatggacaagagagccagcggcatgaacgacagcctggagctgctgcagtgcaacgagaacctgcccagcagccccggctacaacagctgcgacgagcacatggagctggacgacctgcccgagctgcaggccgtgcagagcgaccccacccagagcggcatgtaccagctgagcagcgacgtgagccaccaggagtaccccagaagcagctggaaccagaacaccagcgacatccccgagaccacctacagagagaacgaggtggactggctgaccgagctggccaacatcgccaccagcccccagagccccctgatgcagtgcagcttctacaacagaagcagccccgtgcacatcatcgccaccagcaagagcctgcacagctacgccagacccccccccgtgagcagcagcagcaagagcgagcccgccttcccccaccaccactggaaggaggagacccccgtgagacacgagagagccaacagcgagagcgagagcggcatcttctgcatgagcagcctgagcgacgacgacgacctgggctggtgcaacagctggcccagcaccgtgtggcactgcttcctgaagggcaccagactgtgcttccacaagggcagcaacaaggagtggcaggacgtggaggacttcgccagagccgagggctgcgacaacgaggaggacctgcagatgggcatccacaagggctacggcagcgacggcctgaagctgctgagccacgaggagagcgtgagcttcggcgagagcgtgctgaagctgaccttcgaccccggcaccgtggaggacggcctgctgaccgtggagtgcaagctggaccaccccttctacgtgaagaacaagggctggagcagcttctaccccagcctgaccgtggtgcagcacggcatcccctgctgcgaggtgcacatcggcgacgtgtgcctgccccccggccaccccgacgccatcaacttcgacgacagcggcgtgttcgacaccttcaagagctacgacttcacccccatggacagcagcgccgtgtacgtgctgagcagcatggccagacagagaagagccagcctgagctgcggcggccccggcggccaggacttcgccagaagcggcttcagcaagaactgcggcagccccggcagcagccagctgagcagcaacagcctgtacgccaaggccgtgaagaaccacagcagcggcaccgtgagcgccaccagccccaacaagtgcaagagacccatgaacgccttcatgctgttcgccaagaagtacagagtggagtacacccagatgtaccccggcaaggacaacagatag

SEQ ID NO: 8386 - DNA, 1332 bp, Artificial Sequence
  Description of Artificial Sequence: Synthetic coding sequence
atgcagaaggccacctactacgacagcagcgccatctacggcggctacccctaccaggccgccaacggcttcgcctacaacgccaaccagcagccctaccccgccagcgccgccctgggcgccgacggcgagtaccacagacccgcctgcagcctgcagagccccagcagcgccggcggccaccccaaggcccacgagctgagcgaggcctgcctgagaaccctgagcgccccccccagccagccccccagcctgggcgagccccccctgcaccccccccccccccaggccgccccccccgccccccagcccccccagcccgccccccagccccccgcccccacccccgccgccccccccccccccagcagcgccagccccccccagaacgccagcaacaaccccacccccgccaacgccgccaagagccccctgctgaacagccccaccgtggccaagcagatcttcccctggatgaaggagagcagacagaacaccaagcagaagaccagcagcagcagcagcggcgagagctgcgccggcgacaagagcccccccggccaggccagcagcaagagagccagaaccgcctacaccagcgcccagctggtggagctggagaaggagttccacttcaacagatacctgtgcagacccagaagagtggagatggccaacctgctgaacctgaccgagagacagatcaagatctggttccagaacagaagaatgaagtacaagaaggaccagaagggcaagggcatgctgaccagcagcggcggccagagccccagcagaagccccgtgccccccggcgccggcggctacctgaacagcatgcacagcctggtgaacagcgtgccctacgagccccagagccccccccccttcagcaagcccccccagggcacctacggcctgccccccgccagctaccccgccagcctgcccagctgcgccccccccccccccccccagaagagatacaccgccgccggcgccggcgccggcggcacccccgactacgacccccacgcccacggcctgcagggcaacggcagctacggcaccccccacatccagggcagccccgtgttcgtgggcggcagctacgtggagcccatgagcaacagcggccccgccctgttcggcctgacccacctgccccacgccgccagcggcgccatggactacggcggcgccggccccctgggcagcggccaccaccacggccccggccccggcgagccccaccccacctacaccgacctgaccggccaccaccccagccagggcagaatccaggaggcccccaagctgacccacctgtag

SEQ ID NO: 8387 - DNA, 858 bp, Artificial Sequence
  Description of Artificial Sequence: Synthetic coding sequence
atgaaggagagcagacagaacaccaagcagaagaccagcagcagcagcagcggcgagagctgcgccggcgacaagagcccccccggccaggccagcagcaagagagccagaaccgcctacaccagcgcccagctggtggagctggagaaggagttccacttcaacagatacctgtgcagacccagaagagtggagatggccaacctgctgaacctgaccgagagacagatcaagatctggttccagaacagaagaatgaagtacaagaaggaccagaagggcaagggcatgctgaccagcagcggcggccagagccccagcagaagccccgtgccccccggcgccggcggctacctgaacagcatgcacagcctggtgaacagcgtgccctacgagccccagagccccccccccttcagcaagcccccccagggcacctacggcctgccccccgccagctaccccgccagcctgcccagctgcgccccccccccccccccccagaagagatacaccgccgccggcgccggcgccggcggcacccccgactacgacccccacgcccacggcctgcagggcaacggcagctacggcaccccccacatccagggcagccccgtgttcgtgggcggcagctacgtggagcccatgagcaacagcggccccgccctgttcggcctgacccacctgccccacgccgccagcggcgccatggactacggcggcgccggccccctgggcagcggccaccaccacggccccggccccggcgagccccaccccacctacaccgacctgaccggccaccaccccagccagggcagaatccaggaggcccccaagctgacccacctgtag

SEQ ID NO: 8388 - DNA, 1332 bp, Artificial Sequence; identical to SEQ ID NO: 8386
  Description of Artificial Sequence: Synthetic coding sequence

SEQ ID NO: 8389 - DNA, 39 bp, Artificial Sequence
  Description of Artificial Sequence: Synthetic coding sequence
atgcagaaggccacctactacgacagcagcgccatctag

SEQ ID NO: 8390 - DNA, 165 bp, Artificial Sequence
  Description of Artificial Sequence: Synthetic coding sequence
atgcagaaggccacctactacgacagcagcgccatctacggcggctacccctaccaggccgccaacggcttcgcctacaacgccaaccagcagccctaccccgccagcgccgccctgggcgccgacggcgagtaccacagacccgcctgcagcctgcagagctag

SEQ ID NO: 8391 - DNA, 255 bp, Artificial Sequence
  Description of Artificial Sequence: Synthetic coding sequence
atgcagaaggccacctactacgacagcagcgccatctacggcggctacccctaccaggccgccaacggcttcgcctacaacgccaaccagcagccctaccccgccagcgccgccctgggcgccgacggcgagtaccacagacccgcctgcagcctgcagagccccagcagcgccggcggccaccccaaggcccacgagctgagcgaggcctgcctgagaaccctgagcgccccccccagccagccccccagctag

SEQ ID NO: 8392 - DNA, 1653 bp, Artificial Sequence
  Description of Artificial Sequence: Synthetic coding sequence
atggtgagaggctgggagcccccccccggcctggactgcgccatcagcgagggccacaagagcgagggcaccatgccccccaacaaggaggccagcggcctgagcagcagccccgccggcctgatctgcctgccccccatcagcgaggagctgcagctggtgtggacccaggccgcccagaccagcgagctggacagcaacgagcacctgctgaagaccttcagctacttcccctaccccagcctggccgacatcgccctgctgtgcctgagatacggcctgcagatggagaaggtgaagacctggttcatggcccagagactgagatgcggcatcagctggagcagcgaggagatcgaggagaccagagccagagtggtgtacagaagagaccagctgcacttcaagagcctgctgagcttcacccaccacgccggcagaccccccgaggaggtgccccccccccccgtgcccgcccccgagcaggtgggcatcggcatcggcccccccaccctgagcaagcccacccagaccaagggcctgaaggtggagcccgaggagcccagccagatgccccccctgccccagagccaccagaagctgaaggagagcctgatgacccccggcagcggcgccttcccctaccagagcgacttctggcagcacctgcagagcagcggcctgagcaaggagcaggccggcagaggccccaaccagagccacggcatcggcaccgccagctggaaccacagcaccaccgtgccccagccccaggccagagacaagcccccccccatcgccctgatcgccagcagctgcaaggaggagagcgccagcagcgtgacccccagcagcagcagcaccagcagcagcttccaggtgctggccaacggcgccaccgccgccagcaagcccctgcagcccctgggctgcgtgccccagagcgtgagccccagcgagcaggccctgcccccccacctggagcccgcctggccccagggcctgagacacaacagcgtgcccggcagagtgggccccaccgagtacctgagccccgacatgcagagacagagaaagaccaagagaaagaccaaggagcagctggccatcctgaagagcttcttcctgcagtgccagtgggccagaagagaggactaccagaagctggagcagatcaccggcctgcccagacccgagatcatccagtggttcggcgacaccagatacgccctgaagcacggccagctgaagtggttcagagacaacgccgtgcccggcgcccccagcttccaggaccccgccatccccacccccccccccagcaccagaagcctgaacgagagagccgagaccccccccctgcccatccccccccccccccccgacatccagcccctggagagatactgggccgcccaccagcagctgagagagaccgacatcccccagctgagccaggccagcagactgagcacccagcaggtgctggactggttcgacagcagactgccccagcccgccgaggtggtggtgtgcctggacgaggaggaggaggaggaggaggaggagctgcccgaggacgacgaggaggaggaggaggaggaggaggaggacgacgacgacgacgacgacgacgtgatcatccaggactag

SEQ ID NO: 8393 - DNA, 1032 bp, Artificial Sequence
  Description of Artificial Sequence: Synthetic coding sequence
atgagcagagccggcagctgggacatggacggcctgagagccgacggcggcggcgccggcggcgcccccgccagcagcagcagcagcagcgtggccgccgccgccgccagcggccagtgcagaggcttcctgagcgcccccgtgttcgccggcacccacagcggcagagccgccgccgccgccgccgccgccgccgccgccgccgccgccgccagcggcttcgcctaccccggcaccagcgagagaaccggcagcagcagcagcagcagcagcagcgccgtggtggccgccagacccgaggccccccccgccaaggagtgccccgcccccacccccgccgccgccgccgccgccccccccagcgcccccgccctgggctacggctaccacttcggcaacggctactacagctgcagaatgagccacggcgtgggcctgcagcagaacgccctgaagagcagcccccacgccagcctgggcggcttccccgtggagaagtacatggacgtgagcggcctggccagcagcagcgtgcccgccaacgaggtgcccgccagagccaaggaggtgagcttctaccagggctacaccagcccctaccagcacgtgcccggctacatcgacatggtgagcaccttcggcagcggcgagcccagacacgaggcctacatcagcatggagggctaccagagctggaccctggccaacggctggaacagccaggtgtactgcaccaaggaccagccccagggcagccacttctggaagagcagcttccccggcgacgtggccctgaaccagcccgacatgtgcgtgtacagaagaggcagaaagaagagagtgccctacaccaagctgcagctgaaggagctggagaacgagtacgccatcaacaagttcatcaacaaggacaagagaagaagaatcagcgccgccaccaacctgagcgagagacaggtgaccatctggttccagaacagaagagtgaaggacaagaagatcgtgagcaagctgaaggacaccgtgagctag

SEQ ID NO: 8394 - DNA, 924 bp, Artificial Sequence
  Description of Artificial Sequence: Synthetic coding sequence
atggccaccgcccagctgagccactgcatcaccatccacaaggccagcaaggagaccgtgttccccagccagatcaccaacgagcacgagagcctgaagatggtgaagaagctgttcgccaccagcatcagctgcatcacctacctgagaggcctgttccccgagagcagctacggcgagagacacctggacgacctgagcctgaagatcctgagagaggacaagaagtgccccggcagcctgcacatcatcagatggatccagggctgcttcgacgccctggagaagagatacctgagaatggccgtgctgaccctgtacaccgaccccatgggcagcgagaaggtgaccgagatgtaccagttcaagttcaagtacaccaaggagggcgccaccatggacttcgacagccacagcagcagcaccagcttcgagagcggcaccaacaacgaggacatcaagaaggccagcgtgctgctgatcagaaagctgtacatcctgatgcaggacctggagcccctgcccaacaacgtggtgctgaccatgaagctgcactactacaacgccgtgaccccccacgactaccagcccctgggcttcaaggagggcgtgaacagccacttcctgctgttcgacaaggagcccatcaacgtgcaggtgggcttcgtgagcaccggcttccacagcatgaaggtgaaggtgatgaccgaggccaccaaggtgatcgacctggagaacaacctgttcagagagaacagcaccaccgagatcgcccaccagggcctggactgcgacgaggaggaggagtgcaacgaccacatccagagaatgaacttcgtgtgcagccagcagagcagcgagtgcagcagaaagaagagaaaggtgagcgagcccgtgaaggtgttcatccccaacagaaagtag

SEQ ID NO: 8395 - DNA, 924 bp, Artificial Sequence; identical to SEQ ID NO: 8394
  Description of Artificial Sequence: Synthetic coding sequence

SEQ ID NO: 8396 - DNA, 1074 bp, Artificial Sequence
  Description of Artificial Sequence: Synthetic coding sequence
atgcaggccagagccctgctgctggccgccctggccgccctggccctggccagagagccccccgccgccccctgccccgccagatgcgacgtgagcagatgccccagccccagatgccccggcggctacgtgcccgacctgtgcaactgctgcctggtgtgcgccgccagcgagggcgagccctgcggcggccccctggacagcccctgcggcgagagcctggagtgcgtgagaggcctgtgcagatgcagatggagccacgccgtgtgcggcaccgacggccacacctacgccaacgtgtgcgccctgcaggccgccagcagaagagccctgcagctgagcggcacccccgtgagacagctgcagaagggcgcctgccccctgggcctgcaccagctgagcagccccagatacaagttcaacttcatcgccgacgtggtggagaagatcgcccccgccgtggtgcacatcgagctgttcctgagacaccccctgttcggcagaaacgtgcccctgagcagcggcagcggcttcatcatgagcgaggccggcctgatcatcaccaacgcccacgtggtgagcagcaacagcgccgcccccggcagacagcagctgaaggtgcagctgcagaacggcgacagctacgaggccaccatcaaggacatcgacaagaagagcgacatcgccaccatcaagatccaccccaagaagaagctgcccgtgctgctgctgggccacagcgccgacctgagacccggcgagttcgtggtggccatcggcagccccttcgccctgcagaacaccgtgaccaccggcatcgtgagcaccgcccagagagagggcagagagctgggcctgagagacagcgacatggactacatccagaccgacgccatcatcaactacggcaacagcggcggccccctggtgaacctggacggcgaggtgatcggcatcaacaccctgaaggtgaccgccggcatcagcttcgccatccccagcgacagaatcaccagattcctgaccgagttccaggacaagcagatcaaggcccccagcctggccgtgcactag

SEQ ID NO: 8397 - DNA, 1599 bp, Artificial Sequence
  Description of Artificial Sequence: Synthetic coding sequence
atgcactgcaccctgaccatggagaccgaggccatcgacggctacatcacctgcgacaacgagctgagccccgagagagagcacagcaacatggccatcgacctgaccagcagcacccccaacggccagcacgccagccccagccacatgaccagcaccaacagcgtgaagctggagatgcagagcgacgaggagtgcgacagaaagcccctgagcagagaggacgagatcagaggccacgacgagggcagcagcctggaggagcccctgatcgagagcagcgaggtggccgacaacagaaaggtgcaggagctgcagggcgagggcggcatcagactgcccaacggcaagctgaagtgcgacgtgtgcggcatggtgtgcatcggccccaacgtgctgatggtgcacaagagaagccacaccggcgagagacccttccactgcaaccagtgcggcgccagcttcacccagaagggcaacctgctgagacacatcaagctgcacagcggcgagaagcccttcaagtgccccttctgcagctacgcctgcagaagaagagacgccctgaccggccacctgagaacccacagcgtgggcaagccccacaagtgcaactactgcggcagaagctacaagcagagaagcagcctggaggagcacaaggagagatgccacaactacctgcagaacgtgagcatggaggccgccggccaggtgatgagccaccacgtgccccccatggaggactgcaaggagcaggagcccatcatggacaacaacatcagcctggtgcccttcgagagacccgccgtgatcgagaagctgaccggcaacatgggcaagagaaagagcagcaccccccagaagttcgtgggcgagaagctgatgagattcagctaccccgacatccacttcgacatgaacctgacctacgagaaggaggccgagctgatgcagagccacatgatggaccaggccatcaacaacgccatcacctacctgggcgccgaggccctgcaccccctgatgcagcacccccccagcaccatcgccgaggtggcccccgtgatcagcagcgcctacagccaggtgtaccaccccaacagaatcgagagacccatcagcagagagaccgccgacagccacgagaacaacatggacggccccatcagcctgatcagacccaagagcagaccccaggagagagaggccagccccagcaacagctgcctggacagcaccgacagcgagagcagccacgacgaccaccagagctaccagggccaccccgccctgaaccccaagagaaagcagagccccgcctacatgaaggaggacgtgaaggccctggacaccaccaaggcccccaagggcagcctgaaggacatctacaaggtgttcaacggcgagggcgagcagatcagagccttcaagtgcgagcactgcagagtgctgttcctggaccacgtgatgtacaccatccacatgggctgccacggctacagagaccccctggagtgcaacatctgcggctacagaagccaggacagatacgagttcagcagccacatcgtgagaggcgagcacaccttccactag

SEQ ID NO: 8398 - DNA, 1503 bp, Artificial Sequence
  Description of Artificial Sequence: Synthetic coding sequence
atggagaccgaggccatcgacggctacatcacctgcgacaacgagctgagccccgagagagagcacagcaacatggccatcgacctgaccagcagcacccccaacggccagcacgccagccccagccacatgaccagcaccaacagcgtgaagctggagatgcagagcgacgaggagtgcgacagaaagcccctgagcagagaggacgagatcagaggccacgacgagggcagcagcctggaggagcccctgatcgagagcagcgaggtggccgacaacagaaaggtgcaggagctgcagggcgagggcggcatcagactgcccaacggcgagagacccttccactgcaaccagtgcggcgccagcttcacccagaagggcaacctgctgagacacatcaagctgcacagcggcgagaagcccttcaagtgccccttctgcagctacgcctgcagaagaagagacgccctgaccggccacctgagaacccacagcgtgggcaagccccacaagtgcaactactgcggcagaagctacaagcagagaagcagcctggaggagcacaaggagagatgccacaactacctgcagaacgtgagcatggaggccgccggccaggtgatgagccaccacgtgccccccatggaggactgcaaggagcaggagcccatcatggacaacaacatcagcctggtgcccttcgagagacccgccgtgatcgagaagctgaccggcaacatgggcaagagaaagagcagcaccccccagaagttcgtgggcgagaagctgatgagattcagctaccccgacatccacttcgacatgaacctgacctacgagaaggaggccgagctgatgcagagccacatgatggaccaggccatcaacaacgccatcacctacctgggcgccgaggccctgcaccccctgatgcagcacccccccagcaccatcgccgaggtggcccccgtgatcagcagcgcctacagccaggtgtaccaccccaacagaatcgagagacccatcagcagagagaccgccgacagccacgagaacaacatggacggccccatcagcctgatcagacccaagagcagaccccaggagagagaggccagccccagcaacagctgcctggacagcaccgacagcgagagcagccacgacgaccaccagagctaccagggccaccccgccctgaaccccaagagaaagcagagccccgcctacatgaaggaggacgtgaaggccctggacaccaccaaggcccccaagggcagcctgaaggacatctacaaggtgttcaacggcgagggcgagcagatcagagccttcaagtgcgagcactgcagagtgctgttcctggaccacgtgatgtacaccatccacatgggctgccacggctacagagaccccctggagtgcaacatctgcggctacagaagccaggacagatacgagttcagcagccacatcgtgagaggcgagcacaccttccactag

SEQ ID NO: 8399 - DNA, 1146 bp, Artificial Sequence
  Description of Artificial Sequence: Synthetic coding sequence
atggagaccgaggccatcgacggctacatcacctgcgacaacgagctgagccccgagagagagcacagcaacatggccatcgacctgaccagcagcacccccaacggccagcacgccagccccagccacatgaccagcatgggcaagccccacaagtgcaactactgcggcagaagctacaagcagagaagcagcctggaggagcacaaggagagatgccacaactacctgcagaacgtgagcatggaggccgccggccaggtgatgagccaccacgtgccccccatggaggactgcaaggagcaggagcccatcatggacaacaacatcagcctggtgcccttcgagagacccgccgtgatcgagaagctgaccggcaacatgggcaagagaaagagcagcaccccccagaagttcgtgggcgagaagctgatgagattcagctaccccgacatccacttcgacatgaacctgacctacgagaaggaggccgagctgatgcagagccacatgatggaccaggccatcaacaacgccatcacctacctgggcgccgaggccctgcaccccctgatgcagcacccccccagcaccatcgccgaggtggcccccgtgatcagcagcgcctacagccaggtgtaccaccccaacagaatcgagagacccatcagcagagagaccgccgacagccacgagaacaacatggacggccccatcagcctgatcagacccaagagcagaccccaggagagagaggccagccccagcaacagctgcctggacagcaccgacagcgagagcagccacgacgaccaccagagctaccagggccaccccgccctgaaccccaagagaaagcagagccccgcctacatgaaggaggacgtgaaggccctggacaccaccaaggcccccaagggcagcctgaaggacatctacaaggtgttcaacggcgagggcgagcagatcagagccttcaagtgcgagcactgcagagtgctgttcctggaccacgtgatgtacaccatccacatgggctgccacggctacagagaccccctggagtgcaacatctgcggctacagaagccaggacagatacgagttcagcagccacatcgtgagaggcgagcacaccttccactag

SEQ ID NO: 8400 - DNA, 720 bp, Artificial Sequence
  Description of Artificial Sequence: Synthetic coding sequence
atggagaccgaggccatcgacggctacatcacctgcgacaacgagctgagccccgagagagagcacagcaacatggccatcgacctgaccagcagcacccccaacggccagcacgccagccccagccacatgaccagcaccaacagcgtgaagctggagatgcagagcgacgaggagtgcgacagaaagcccctgagcagagaggacgagatcagaggccacgacgagggcagcagcctggaggagcccctgatcgagagcagcgaggtggccgacaacagaaaggtgcaggagctgcagggcgagggcggcatcagactgcccaacggcaagctgaagtgcgacgtgtgcggcatggtgtgcatcggccccaacgtgctgatggtgcacaagagaagccacaccggcgagagacccttccactgcaaccagtgcggcgccagcttcacccagaagggcaacctgctgagacacatcaagctgcacagcggcgagaagcccttcaagtgccccttctgcagctacgcctgcagaagaagagacgccctgaccggccacctgagaacccacagcgtgggcaagccccacaagtgcaactactgcggcagaagctacaagcagagaagcagcctggaggagcacaaggagagatgccacaactacctgcagaacgtgagcatggaggccgccggccaggtgatgagccaccacgacagctag

SEQ ID NO: 8401 - DNA, 1359 bp, Artificial Sequence
  Description of Artificial Sequence: Synthetic coding sequence
atggagaccgaggccatcgacggctacatcacctgcgacaacgagctgagccccgagagagagcacagcaacatggccatcgacctgaccagcagcacccccaacggccagcacgccagccccagccacatgaccagcaccaacagcgtgaagctggagatgcagagcgacgaggagtgcgacagaaagcccctgagcagagaggacgagatcagaggccacgacgagggcagcagcctggaggagcccctgatcgagagcagcgaggtggccgacaacagaaaggtgcaggagctgcagggcgagggcggcatcagactgcccaacggcgagagacccttccactgcaaccagtgcggcgccagcttcacccagaagggcaacctgctgagacacatcaagctgcacagcggcgagaagcccttcaagtgccccttctgcagctacgcctgcagaagaagagacgccctgaccggccacctgagaacccacagcgtgggcaagccccacaagtgcaactactgcggcagaagctacaagcagagaagcagcctggaggagcacaaggagagatgccacaactacctgcagaacgtgagcatggaggccgccggccaggtgatgagccaccacggcgagaagctgatgagattcagctaccccgacatccacttcgacatgaacctgacctacgagaaggaggccgagctgatgcagagccacatgatggaccaggccatcaacaacgccatcacctacctgggcgccgaggccctgcaccccctgatgcagcacccccccagcaccatcgccgaggtggcccccgtgatcagcagcgcctacagccaggtgtaccaccccaacagaatcgagagacccatcagcagagagaccgccgacagccacgagaacaacatggacggccccatcagcctgatcagacccaagagcagaccccaggagagagaggccagccccagcaacagctgcctggacagcaccgacagcgagagcagccacgacgaccaccagagctaccagggccaccccgccctgaaccccaagagaaagcagagccccgcctacatgaaggaggacgtgaaggccctggacaccaccaaggcccccaagggcagcctgaaggacatctacaaggtgttcaacggcgagggcgagcagatcagagccttcaagtgcgagcactgcagagtgctgttcctggaccacgtgatgtacaccatccacatgggctgccacggctacagagaccccctggagtgcaacatctgcggctacagaagccaggacagatacgagttcagcagccacatcgtgagaggcgagcacaccttccactag

SEQ ID NO: 8402 - DNA, 720 bp, Artificial Sequence; identical to SEQ ID NO: 8400
  Description of Artificial Sequence: Synthetic coding sequence

SEQ ID NO: 8403 - DNA, 381 bp, Artificial Sequence
  Description of Artificial Sequence: Synthetic coding sequence
atgcactgcaccctgaccatggagaccgaggccatcgacggctacatcacctgcgacaacgagctgagccccgagagagagcacagcaacatggccatcgacctgaccagcagcacccccaacggccagcacgccagccccagccacatgaccagcaccaacagcgtgaagctggagatgcagagcgacgaggagtgcgacagaaagcccctgagcagagaggacgagatcagaggccacgacgagggcagcagcctggaggagcccctgatcgagagcagcgaggtggccgacaacagaaaggtgcaggagctgcagggcgagggcggcatcagactgcccaacggcgagagacccttccactgcaaccagtgcggctag

SEQ ID NO: 8404 - DNA, 1581 bp, Artificial Sequence
  Description of Artificial Sequence: Synthetic coding sequence
atggagaccgaggccatcgacggctacatcacctgcgacaacgagctgagccccgagagagagcacagcaacatggccatcgacctgaccagcagcacccccaacggccagcacgccagccccagccacatgaccagcaccaacagcgtgaagctggagatgcagagcgacgaggagtgcgacagaaagcccctgagcagagaggacgagatcagaggccacgacgagggcagcagcctggaggagcccctgatcgagagcagcgaggtggccgacaacagaaaggtgcaggagctgcagggcgagggcggcatcagactgcccaacggcaagctgaagtgcgacgtgtgcggcatggtgtgcatcggccccaacgtgctgatggtgcacaagagaagccacaccggcgagagacccttccactgcaaccagtgcggcgccagcttcacccagaagggcaacctgctgagacacatcaagctgcacagcggcgagaagcccttcaagtgccccttctgcagctacgcctgcagaagaagagacgccctgaccggccacctgagaacccacagcgtgggcaagccccacaagtgcaactactgcggcagaagctacaagcagagaagcagcctggaggagcacaaggagagatgccacaactacctgcagaacgtgagcatggaggccgccggccaggtgatgagccaccacgtgccccccatggaggactgcaaggagcaggagcccatcatggacaacaacatcagcctggtgcccttcgagagacccgccgtgatcgagaagctgaccggcaacatgggcaagagaaagagcagcaccccccagaagttcgtgggcgagaagctgatgagattcagctaccccgacatccacttcgacatgaacctgacctacgagaaggaggccgagctgatgcagagccacatgatggaccaggccatcaacaacgccatcacctacctgggcgccgaggccctgcaccccctgatgcagcacccccccagcaccatcgccgaggtggcccccgtgatcagcagcgcctacagccaggtgtaccaccccaacagaatcgagagacccatcagcagagagaccgccgacagccacgagaacaacatggacggccccatcagcctgatcagacccaagagcagaccccaggagagagaggccagccccagcaacagctgcctggacagcaccgacagcgagagcagccacgacgaccaccagagctaccagggccaccccgccctgaaccccaagagaaagcagagccccgcctacatgaaggaggacgtgaaggccctggacaccaccaaggcccccaagggcagcctgaaggacatctacaaggtgttcaacggcgagggcgagcagatcagagccttcaagtgcgagcactgcagagtgctgttcctggaccacgtgatgtacaccatccacatgggctgccacggctacagagaccccctggagtgcaacatctgcggctacagaagccaggacagatacgagttcagcagccacatcgtgagaggcgagcacaccttccactag

SEQ ID NO: 8405 - DNA, 447 bp, Artificial Sequence
  Description of Artificial Sequence: Synthetic coding sequence
atggagaccgaggccatcgacggctacatcacctgcgacaacgagctgagccccgagagagagcacagcaacatggccatcgacctgaccagcagcacccccaacggccagcacgccagccccagccacatgaccagcaccaacagcgtgaagctggagatgcagagcgacgaggagtgcgacagaaagcccctgagcagagaggacgagatcagaggccacgacgagggcagcagcctggaggagcccctgatcgagagcagcgaggtggccgacaacagaaaggtgcaggagctgcagggcgagggcggcatcagactgcccaacggcaagctgaagtgcgacgtgtgcggcatggtgtgcatcggccccaacgtgctgatggtgcacaagagaagccacaccggcgtggccgtggtgaagaccaccttcagcgagttctgctag

SEQ ID NO: 8406 - DNA, 1365 bp, Artificial Sequence
  Description of Artificial Sequence: Synthetic coding sequence
atggagaccgaggccatcgacggctacatcacctgcgacaacgagctgagccccgagagagagcacagcaacatggccatcgacctgaccagcagcacccccaacggccagcacgccagccccagccacatgaccagcaccaacagcgtgaagctggagatgcagagcgacgaggagtgcgacagaaagcccctgagcagagaggacgagatcagaggccacgacgagggcagcagcctggaggagcccctgatcgagagcagcgaggtggccgacaacagaaaggtgcaggagctgcagggcgagggcggcatcagactgcccaacggcgagagacccttccactgcaaccagtgcggcgccagcttcacccagaagggcaacctgctgagacacatcaagctgcacagcggcgagaagcccttcaagtgccccttctgcagctacgcctgcagaagaagagacgccctgaccggccacctgagaacccacagcgtgccccccatggaggactgcaaggagcaggagcccatcatggacaacaacatcagcctggtgcccttcgagagacccgccgtgatcgagaagctgaccggcaacatgggcaagagaaagagcagcaccccccagaagttcgtgggcgagaagctgatgagattcagctaccccgacatccacttcgacatgaacctgacctacgagaaggaggccgagctgatgcagagccacatgatggaccaggccatcaacaacgccatcacctacctgggcgccgaggccctgcaccccctgatgcagcacccccccagcaccatcgccgaggtggcccccgtgatcagcagcgcctacagccaggtgtaccaccccaacagaatcgagagacccatcagcagagagaccgccgacagccacgagaacaacatggacggccccatcagcctgatcagacccaagagcagaccccaggagagagaggccagccccagcaacagctgcctggacagcaccgacagcgagagcagccacgacgaccaccagagctaccagggccaccccgccctgaaccccaagagaaagcagagccccgcctacatgaaggaggacgtgaaggccctggacaccaccaaggcccccaagggcagcctgaaggacatctacaaggtgttcaacggcgagggcgagcagatcagagccttcaagtgcgagcactgcagagtgctgttcctggaccacgtgatgtacaccatccacatgggctgccacggctacagagaccccctggagtgcaacatctgcggctacagaagccaggacagatacgagttcagcagccacatcgtgagaggcgagcacaccttccactag

SEQ ID NO: 8407 - DNA, 252 bp, Artificial Sequence
  Description of Artificial Sequence: Synthetic coding sequence
atggagaccgaggccatcgacggctacatcacctgcgacaacgagctgagccccgagagagagcacagcaacatggccatcgacctgaccagcagcacccccaacggccagcacgccagccccagccacatgaccagcaccaacagcgtgaagctggagatgcagagcgacgaggagtgcgacagaaagcccctgagcagagaggacgagatcagaggccacgacgagggcagcagcctggaggagccctag

SEQ ID NO: 8408 - DNA, 1581 bp, Artificial Sequence; identical to SEQ ID NO: 8404
  Description of Artificial Sequence: Synthetic coding sequence

SEQ ID NO: 8409 - DNA, 693 bp, Artificial Sequence
  Description of Artificial Sequence: Synthetic coding sequence
atggagaccgaggccatcgacggctacatcacctgcgacaacgagctgagccccgagagagagcacagcaacatggccatcgacctgaccagcagcacccccaacggccagcacgccagccccagccacatgaccagcaccatcgccgaggtggcccccgtgatcagcagcgcctacagccaggtgtaccaccccaacagaatcgagagacccatcagcagagagaccgccgacagccacgagaacaacatggacggccccatcagcctgatcagacccaagagcagaccccaggagagagaggccagccccagcaacagctgcctggacagcaccgacagcgagagcagccacgacgaccaccagagctaccagggccaccccgccctgaaccccaagagaaagcagagccccgcctacatgaaggaggacgtgaaggccctggacaccaccaaggcccccaagggcagcctgaaggacatctacaaggtgttcaacggcgagggcgagcagatcagagccttcaagtgcgagcactgcagagtgctgttcctggaccacgtgatgtacaccatccacatgggctgccacggctacagagaccccctggagtgcaacatctgcggctacagaagccaggacagatacgagttcagcagccacatcgtgagaggcgagcacaccttccactag

SEQ ID NO: 8410 - DNA, 1260 bp, Artificial Sequence
  Description of Artificial Sequence: Synthetic coding sequence
atgggcgagaagaagcccgagcccctggacttcgtgaaggacttccaggagtacctgacccagcagacccaccacgtgaacatgatcagcggcagcgtgagcggcgacaaggaggccgaggccctgcagggcgccggcaccgacggcgaccagaacggcctggaccaccccagcgtggaggtgagcctggacgagaacagcggcatgctggtggacggcttcgagagaaccttcgacggcaagctgaagtgcagatactgcaactacgccagcaagggcaccgccagactgatcgagcacatcagaatccacaccggcgagaagccccacagatgccacctgtgccccttcgccagcgcctacgagagacacctggaggcccacatgagaagccacaccggcgagaagccctacaagtgcgagctgtgcagcttcagatgcagcgacagaagcaacctgagccaccacagaagaagaaagcacaagatggtgcccatcaagggcaccagaagcagcctgagcagcaagaagatgtggggcgtgctgcagaagaagaccagcaacctgggctacagcagaagagccctgatcaacctgagcccccccagcatggtggtgcagaagcccgactacctgaacgacttcacccacgagatccccaacatccagaccgacagctacgagagcatggccaagaccacccccaccggcggcctgcccagagacccccaggagctgatggtggacaaccccctgaaccagctgagcaccctggccggccagctgagcagcctgccccccgagaaccagaaccccgccagccccgacgtggtgccctgccccgacgagaagcccttcatgatccagcagcccagcacccaggccgtggtgagcgccgtgagcgccagcatcccccagagcagcagccccaccagccccgagcccagacccagccacagccagagaaactacagccccgtggccggccccagcagcgagcccagcgcccacaccagcacccccagcatcggcaacagccagcccagcacccccgcccccgccctgcccgtgcaggacccccagctgctgcaccactgccagcactgcgacatgtacttcgccgacaacatcctgtacaccatccacatgggctgccacggctacgagaaccccttccagtgcaacatctgcggctgcaagtgcaagaacaagtacgacttcgcctgccacttcgccagaggccagcacaaccagcactag

SEQ ID NO: 8411 - DNA, 1542 bp, Artificial Sequence
  Description of Artificial Sequence: Synthetic coding sequence
atgagagagggcgcctgcaagctgctggccgcctgcagccagagagagcaggccctggaggccaccaagagcctgctggtgtgcaacagcagaatcctgagctacatgggcgagctgcagagaagaaaggaggcccaggtgctgggcaagaccagcagaagacccagcgacagcggcccccccgccgagagaagcccctgcagaggcagagtgtgcatcagcgacctgagaatccccctgatgtggaaggacaccgagtacttcaagaacaagggcgacctgcacagatgggccgtgttcctgctgctgcagctgggcgagcacatccaggacaccgagatgatcctggtggacagaaccctgaccgacatcagcttccagagcaacgtgctgttcgccgaggccggccccgacttcgagctgagactggagctgtacggcgcctgcgtggaggaggagggcgccctgaccggcggccccaagagactggccaccaagctgagcagcagcctgggcagaagcagcggcagaagagtgagagccagcctggacagcgccggcggcagcggcagcagccccatcctgctgcccacccccgtggtgggcggccccagataccacctgctggcccacaccaccctgaccctggccgccgtgcaggacggcttcagaacccacgacctgaccctggccagccacgaggagaaccccgcctggctgcccctgtacggcagcgtgtgctgcagactggccgcccagcccctgtgcatgacccagcccaccgccagcggcaccctgagagtgcagcaggccggcgagatgcagaactgggcccaggtgcacggcgtgctgaagggcaccaacctgttctgctacagacagcccgaggacgccgacaccggcgaggagcccctgctgaccatcgccgtgaacaaggagaccagagtgagagccggcgagctggaccaggccctgggcagacccttcaccctgagcatcagcaaccagtacggcgacgacgaggtgacccacaccctgcagaccgagagcagagaggccctgcagagctggatggaggccctgtggcagctgttcttcgacatgagccagtggaagcagtgctgcgacgagatcatgaagatcgagacccccgcccccagaaagcccccccaggccctggccaagcagggcagcctgtaccacgagatggccatcgagcccctggacgacatcgccgccgtgaccgacatcctgacccagagagagggcgccagactggagaccccccccccctggctggccatgttcaccgaccagcccgccctgcccaacccctgcagccccgccagcgtggcccccgcccccgactggacccaccccctgccctggggcagacccagaaccttcagcctggacgccgtgccccccgaccacagccccagagccagaagcgtggcccccctgcccccccagagaagccccagaaccagaggcctgtgcagcaagggccagcccagaacctggctgcagagccccgtgtag

SEQ ID NO: 8412 - DNA, 1092 bp, Artificial Sequence
  Description of Artificial Sequence: Synthetic coding sequence
atgagcaagctgtggagaagaggcagcaccagcggcgccatggaggcccccgagcccggcgaggccctggagctgagcctggccggcgcccacggccacggcgtgcacaagaagaagcacaagaagcacaagaagaagcacaagaagaagcaccaccaggaggaggacgccggccccacccagcccagccccgccaagccccagctgaagctgaagatcaagctgggcggccaggtgctgggcaccaagagcgtgcccaccttcaccgtgatccccgagggccccagaagccccagccccctgatggtggtggacaacgaggaggagcccatggagggcgtgcccctggagcagtacagagcctggctggacgaggacagcaacctgagccccagccccctgagagacctgagcggcggcctgggcggccaggaggaggaggaggagcagagatggctggacgccctggagaagggcgagctggacgacaacggcgacctgaagaaggagatcaacgagagactgctgaccgccagacagagagccctgctgcagaaggccagaagccagcccagccccatgctgcccctgcccgtggccgagggctgccccccccccgccctgaccgaggagatgctgctgaagagagaggagagagccagaaagagaagactgcaggccgccagaagagccgaggagcacaagaaccagaccatcgagagactgaccaagaccgccgccaccagcggcagaggcggcagaggcggcgccagaggcgagagaagaggcggcagagccgccgcccccgcccccatggtgagatactgcagcggcgcccagggcagcaccctgagcttcccccccggcgtgcccgcccccaccgccgtgagccagagacccagccccagcggccccccccccagatgcagcgtgcccggctgcccccaccccagaagatacgcctgcagcagaaccggccaggccctgtgcagcctgcagtgctacagaatcaacctgcagatgagactgggcggccccgagggccccggcagccccctgctggccaccttcgagagctgcgcccaggagtag

SEQ ID NO: 8413 - DNA, 594 bp, Artificial Sequence
  Description of Artificial Sequence: Synthetic coding sequence
atggccgcccagatccccatcgtggccaccaccagcacccccggcatcgtgagaaacagcaagaagagacccgccagccccagccacaacggcagcagcggcggcggctacggcgccagcaagaagaagaaggccagcgccagcagcttcgcccagggcatcagcatggaggccatgagcgagaacaagatggtgcccagcgagttcagcaccggccccgtggagaaggccgccaagcccctgcccttcaaggaccccaacttcgtgcacagcggccacggcggcgccgtggccggcaagaagaacagaacctggaagaacctgaagcagatcctggccagcgagagagccctgccctggcagctgaacgaccccaactacttcagcatcgacgccccccccagcttcaagcccgccaagaagtacagcgacgtgagcggcctgctggagccccccaactgcttcccccagagactgcaccagctgaccttccccctggccatggacgagggcagcaacttcagcagatgcagccccaccctggtgaacttcggcttcgtgttcatcatggccatcctggtgggcgtgaagtag

SEQ ID NO: 8414 - DNA, 579 bp, Artificial Sequence
  Description of Artificial Sequence: Synthetic coding sequence
atggccgcccagatccccatcgtggccaccaccagcacccccggcatcgtgagaaacagcaagaagagacccgccagccccagccacaacggcagcagcggcggcggctacggcgccagcaagaagaagaaggccagcgccagcagcttcgcccagggcatcagcatggaggccatgagcgagaacaagatggtgcccagcgagttcagcaccggccccgtggagaaggccgccaagcccctgcccttcaaggaccccaacttcgtgcacagcggccacggcggcgccgtggccggcaagaagaacagaacctggaagaacctgaagcagatcctggccagcgagagagccctgccctggcagctgaacgaccccaactacttcagcatcgacgccccccccagcttcaagcccgccaagaagtacagcgacgtgagcggcctgctggccaactacaccgacccccagagcaagctgagattcagcaccatcgaggagttcagctacatcagaagactgcccagcgacgtggtgaccggctacctggccctgagaaaggccaccagcatcgtgccctag

SEQ ID NO: 8415 - DNA, 687 bp, Artificial Sequence
  Description of Artificial Sequence: Synthetic coding sequence
atggccgcccagatccccatcgtggccaccaccagcacccccggcatcgtgagaaacagcaagaagagacccgccagccccagccacaacggcagcagcggcggcggctacggcgccagcaagaagaagaaggccagcgccagcagcttcgcccagacctgcctgagccccagcaccatgatcgtgagacccccccagcccagaggcaccacctgcctgctgcccagcgccatgatcgtgagacccccccagcccagaggcaacggcatcagcatggaggccatgagcgagaacaagatggtgcccagcgagttcagcaccggccccgtggagaaggccgccaagcccctgcccttcaaggaccccaacttcgtgcacagcggccacggcggcgccgtggccggcaagaagaacagaacctggaagaacctgaagcagatcctggccagcgagagagccctgccctggcagctgaacgaccccaactacttcagcatcgacgccccccccagcttcaagcccgccaagaagtacagcgacgtgagcggcctgctggccaactacaccgacccccagagcaagctgagattcagcaccatcgaggagttcagctacatcagaagactgcccagcgacgtggtgaccggctacctggccctgagaaaggccaccagcatcgtgccctag

SEQ ID NO: 8416 - DNA, 13692 bp, Artificial Sequence
  Description of Artificial Sequence: Synthetic coding sequence
atggacccccccagacccgccctgctggccctgctggccctgcccgccctgctgctgctgctgctggccggcgccagagccgaggaggagatgctggagaacgtgagcctggtgtgccccaaggacgccaccagattcaagcacctgagaaagtacacctacaactacgaggccgagagcagcagcggcgtgcccggcaccgccgacagcagaagcgccaccagaatcaactgcaaggtggagctggaggtgccccagctgtgcagcttcatcctgaagaccagccagtgcaccctgaaggaggtgtacggcttcaaccccgagggcaaggccctgctgaagaagaccaagaacagcgaggagttcgccgccgccatgagcagatacgagctgaagctggccatccccgagggcaagcaggtgttcctgtaccccgagaaggacgagcccacctacatcctgaacatcaagagaggcatcatcagcgccctgctggtgccccccgagaccgaggaggccaagcaggtgctgttcctggacaccgtgtacggcaactgcagcacccacttcaccgtgaagaccagaaagggcaacgtggccaccgagatcagcaccgagagagacctgggccagtgcgacagattcaagcccatcagaaccggcatcagccccctggccctgatcaagggcatgaccagacccctgagcaccctgatcagcagcagccagagctgccagtacaccctggacgccaagagaaagcacgtggccgaggccatctgcaaggagcagcacctgttcctgcccttcagctacaagaacaagtacggcatggtggcccaggtgacccagaccctgaagctggaggacacccccaagatcaacagcagattcttcggcgagggcaccaagaagatgggcctggccttcgagagcaccaagagcaccagcccccccaagcaggccgaggccgtgctgaagaccctgcaggagctgaagaagctgaccatcagcgagcagaacatccagagagccaacctgttcaacaagctggtgaccgagctgagaggcctgagcgacgaggccgtgaccagcctgctgccccagctgatcgaggtgagcagccccatcaccctgcaggccctggtgcagtgcggccagccccagtgcagcacccacatcctgcagtggctgaagagagtgcacgccaaccccctgctgatcgacgtggtgacctacctggtggccctgatccccgagcccagcgcccagcagctgagagagatcttcaacatggccagagaccagagaagcagagccaccctgtacgccctgagccacgccgtgaacaactaccacaagaccaaccccaccggcacccaggagctgctggacatcgccaactacctgatggagcagatccaggacgactgcaccggcgacgaggactacacctacctgatcctgagagtgatcggcaacatgggccagaccatggagcagctgacccccgagctgaagagcagcatcctgaagtgcgtgcagagcaccaagcccagcctgatgatccagaaggccgccatccaggccctgagaaagatggagcccaaggacaaggaccaggaggtgctgctgcagaccttcctggacgacgccagccccggcgacaagagactggccgcctacctgatgctgatgagaagccccagccaggccgacatcaacaagatcgtgcagatcctgccctgggagcagaacgagcaggtgaagaacttcgtggccagccacatcgccaacatcctgaacagcgaggagctggacatccaggacctgaagaagctggtgaaggaggccctgaaggagagccagctgcccaccgtgatggacttcagaaagttcagcagaaactaccagctgtacaagagcgtgagcctgcccagcctggaccccgccagcgccaagatcgagggcaacctgatcttcgaccccaacaactacctgcccaaggagagcatgctgaagaccaccctgaccgccttcggcttcgccagcgccgacctgatcgagatcggcctggagggcaagggcttcgagcccaccctggaggccctgttcggcaagcagggcttcttccccgacagcgtgaacaaggccctgtactgggtgaacggccaggtgcccgacggcgtgagcaaggtgctggtggaccacttcggctacaccaaggacgacaagcacgagcaggacatggtgaacggcatcatgctgagcgtggagaagctgatcaaggacctgaagagcaaggaggtgcccgaggccagagcctacctgagaatcctgggcgaggagctgggcttcgccagcctgcacgacctgcagctgctgggcaagctgctgctgatgggcgccagaaccctgcagggcatcccccagatgatcggcgaggtgatcagaaagggcagcaagaacgacttcttcctgcactacatcttcatggagaacgccttcgagctgcccaccggcgccggcctgcagctgcagatcagcagcagcggcgtgatcgcccccggcgccaaggccggcgtgaagctggaggtggccaacatgcaggccgagctggtggccaagcccagcgtgagcgtggagttcgtgaccaacatgggcatcatcatccccgacttcgccagaagcggcgtgcagatgaacaccaacttcttccacgagagcggcctggaggcccacgtggccctgaaggccggcaagctgaagttcatcatccccagccccaagagacccgtgaagctgctgagcggcggcaacaccctgcacctggtgagcaccaccaagaccgaggtgatcccccccctgatcgagaacagacagagctggagcgtgtgcaagcaggtgttccccggcctgaactactgcaccagcggcgcctacagcaacgccagcagcaccgacagcgccagctactaccccctgaccggcgacaccagactggagctggagctgagacccaccggcgagatcgagcagtacagcgtgagcgccacctacgagctgcagagagaggacagagccctggtggacaccctgaagttcgtgacccaggccgagggcgccaagcagaccgaggccaccatgaccttcaagtacaacagacagagcatgaccctgagcagcgaggtgcagatccccgacttcgacgtggacctgggcaccatcctgagagtgaacgacgagagcaccgagggcaagaccagctacagactgaccctggacatccagaacaagaagatcaccgaggtggccctgatgggccacctgagctgcgacaccaaggaggagagaaagatcaagggcgtgatcagcatccccagactgcaggccgaggccagaagcgagatcctggcccactggagccccgccaagctgctgctgcagatggacagcagcgccaccgcctacggcagcaccgtgagcaagagagtggcctggcactacgacgaggagaagatcgagttcgagtggaacaccggcaccaacgtggacaccaagaagatgaccagcaacttccccgtggacctgagcgactaccccaagagcctgcacatgtacgccaacagactgctggaccacagagtgccccagaccgacatgaccttcagacacgtgggcagcaagctgatcgtggccatgagcagctggctgcagaaggccagcggcagcctgccctacacccagaccctgcaggaccacctgaacagcctgaaggagttcaacctgcagaacatgggcctgcccgacttccacatccccgagaacctgttcctgaagagcgacggcagagtgaagtacaccctgaacaagaacagcctgaagatcgagatccccctgcccttcggcggcaagagcagcagagacctgaagatgctggagaccgtgagaacccccgccctgcacttcaagagcgtgggcttccacctgcccagcagagagttccaggtgcccaccttcaccatccccaagctgtaccagctgcaggtgcccctgctgggcgtgctggacctgagcaccaacgtgtacagcaacctgtacaactggagcgccagctacagcggcggcaacaccagcaccgaccacttcagcctgagagccagataccacatgaaggccgacagcgtggtggacctgctgagctacaacgtgcagggcagcggcgagaccacctacgaccacaagaacaccttcaccctgagctacgacggcagcctgagacacaagttcctggacagcaacatcaagttcagccacgtggagaagctgggcaacaaccccgtgagcaagggcctgctgatcttcgacgccagcagcagctggggcccccagatgagcgccagcgtgcacctggacagcaagaagaagcagcacctgttcgtgaaggaggtgaagatcgacggccagttcagagtgagcagcttctacgccaagggcacctacggcctgagctgccagagagaccccaacaccggcagactgaacggcgagagcaacctgagattcaacagcagctacctgcagggcaccaaccagatcaccggcagatacgaggacggcaccctgagcctgaccagcaccagcgacctgcagagcggcatcatcaagaacaccgccagcctgaagtacgagaactacgagctgaccctgaagagcgacaccaacggcaagtacaagaacttcgccaccagcaacaagatggacatgaccttcagcaagcagaacgccctgctgagaagcgagtaccaggccgactacgagagcctgagattcttcagcctgctgagcggcagcctgaacagccacggcctggagctgaacgccgacatcctgggcaccgacaagatcaacagcggcgcccacaaggccaccctgagaatcggccaggacggcatcagcaccagcgccaccaccaacctgaagtgcagcctgctggtgctggagaacgagctgaacgccgagctgggcctgagcggcgccagcatgaagctgaccaccaacggcagattcagagagcacaacgccaagttcagcctggacggcaaggccgccctgaccgagctgagcctgggcagcgcctaccaggccatgatcctgggcgtggacagcaagaacatcttcaacttcaaggtgagccaggagggcctgaagctgagcaacgacatgatgggcagctacgccgagatgaagttcgaccacaccaacagcctgaacatcgccggcctgagcctggacttcagcagcaagctggacaacatctacagcagcgacaagttctacaagcagaccgtgaacctgcagctgcagccctacagcctggtgaccaccctgaacagcgacctgaagtacaacgccctggacctgaccaacaacggcaagctgagactggagcccctgaagctgcacgtggccggcaacctgaagggcgcctaccagaacaacgagatcaagcacatctacgccatcagcagcgccgccctgagcgccagctacaaggccgacaccgtggccaaggtgcagggcgtggagttcagccacagactgaacaccgacatcgccggcctggccagcgccatcgacatgagcaccaactacaacagcgacagcctgcacttcagcaacgtgttcagaagcgtgatggcccccttcaccatgaccatcgacgcccacaccaacggcaacggcaagctggccctgtggggcgagcacaccggccagctgtacagcaagttcctgctgaaggccgagcccctggccttcaccttcagccacgactacaagggcagcaccagccaccacctggtgagcagaaagagcatcagcgccgccctggagcacaaggtgagcgccctgctgacccccgccgagcagaccggcacctggaagctgaagacccagttcaacaacaacgagtacagccaggacctggacgcctacaacaccaaggacaagatcggcgtggagctgaccggcagaaccctggccgacctgaccctgctggacagccccatcaaggtgcccctgctgctgagcgagcccatcaacatcatcgacgccctggagatgagagacgccgtggagaagccccaggagttcaccatcgtggccttcgtgaagtacgacaagaaccaggacgtgcacagcatcaacctgcccttcttcgagaccctgcaggagtacttcgagagaaacagacagaccatcatcgtggtgctggagaacgtgcagagaaacctgaagcacatcaacatcgaccagttcgtgagaaagtacagagccgccctgggcaagctgccccagcaggccaacgactacctgaacagcttcaactgggagagacaggtgagccacgccaaggagaagctgaccgccctgaccaagaagtacagaatcaccgagaacgacatccagatcgccctggacgacgccaagatcaacttcaacgagaagctgagccagctgcagacctacatgatccagttcgaccagtacatcaaggacagctacgacctgcacgacctgaagatcgccatcgccaacatcatcgacgagatcatcgagaagctgaagagcctggacgagcactaccacatcagagtgaacctggtgaagaccatccacgacctgcacctgttcatcgagaacatcgacttcaacaagagcggcagcagcaccgccagctggatccagaacgtggacaccaagtaccagatcagaatccagatccaggagaagctgcagcagctgaagagacacatccagaacatcgacatccagcacctggccggcaagctgaagcagcacatcgaggccatcgacgtgagagtgctgctggaccagctgggcaccaccatcagcttcgagagaatcaacgacatcctggagcacgtgaagcacttcgtgatcaacctgatcggcgacttcgaggtggccgagaagatcaacgccttcagagccaaggtgcacgagctgatcgagagatacgaggtggaccagcagatccaggtgctgatggacaagctggtggagctggcccaccagtacaagctgaaggagaccatccagaagctgagcaacgtgctgcagcaggtgaagatcaaggactacttcgagaagctggtgggcttcatcgacgacgccgtgaagaagctgaacgagctgagcttcaagaccttcatcgaggacgtgaacaagttcctggacatgctgatcaagaagctgaagagcttcgactaccaccagttcgtggacgagaccaacgacaagatcagagaggtgacccagagactgaacggcgagatccaggccctggagctgccccagaaggccgaggccctgaagctgttcctggaggagaccaaggccaccgtggccgtgtacctggagagcctgcaggacaccaagatcaccctgatcatcaactggctgcaggaggccctgagcagcgccagcctggcccacatgaaggccaagttcagagagaccctggaggacaccagagacagaatgtaccagatggacatccagcaggagctgcagagatacctgagcctggtgggccaggtgtacagcaccctggtgacctacatcagcgactggtggaccctggccgccaagaacctgaccgacttcgccgagcagtacagcatccaggactgggccaagagaatgaaggccctggtggagcagggcttcaccgtgcccgagatcaagaccatcctgggcaccatgcccgccttcgaggtgagcctgcaggccctgcagaaggccaccttccagacccccgacttcatcgtgcccctgaccgacctgagaatccccagcgtgcagatcaacttcaaggacctgaagaacatcaagatccccagcagattcagcacccccgagttcaccatcctgaacaccttccacatccccagcttcaccatcgacttcgtggagatgaaggtgaagatcatcagaaccatcgaccagatgctgaacagcgagctgcagtggcccgtgcccgacatctacctgagagacctgaaggtggaggacatccccctggccagaatcaccctgcccgacttcagactgcccgagatcgccatccccgagttcatcatccccaccctgaacctgaacgacttccaggtgcccgacctgcacatccccgagttccagctgccccacatcagccacaccatcgaggtgcccaccttcggcaagctgtacagcatcctgaagatccagagccccctgttcaccctggacgccaacgccgacatcggcaacggcaccaccagcgccaacgaggccggcatcgccgccagcatcaccgccaagggcgagagcaagctggaggtgctgaacttcgacttccaggccaacgcccagctgagcaaccccaagatcaaccccctggccctgaaggagagcgtgaagttcagcagcaagtacctgagaaccgagcacggcagcgagatgctgttcttcggcaacgccatcgagggcaagagcaacaccgtggccagcctgcacaccgagaagaacaccctggagctgagcaacggcgtgatcgtgaagatcaacaaccagctgaccctggacagcaacaccaagtacttccacaagctgaacatccccaagctggacttcagcagccaggccgacctgagaaacgagatcaagaccctgctgaaggccggccacatcgcctggaccagcagcggcaagggcagctggaagtgggcctgccccagattcagcgacgagggcacccacgagagccagatcagcttcaccatcgagggccccctgaccagcttcggcctgagcaacaagatcaacagcaagcacctgagagtgaaccagaacctggtgtacgagagcggcagcctgaacttcagcaagctggagatccagagccaggtggacagccagcacgtgggccacagcgtgctgaccgccaagggcatggccctgttcggcgagggcaaggccgagttcaccggcagacacgacgcccacctgaacggcaaggtgatcggcaccctgaagaacagcctgttcttcagcgcccagcccttcgagatcaccgccagcaccaacaacgagggcaacctgaaggtgagattccccctgagactgaccggcaagatcgacttcctgaacaactacgccctgttcctgagccccagcgcccagcaggccagctggcaggtgagcgccagattcaaccagtacaagtacaaccagaacttcagcgccggcaacaacgagaacatcatggaggcccacgtgggcatcaacggcgaggccaacctggacttcctgaacatccccctgaccatccccgagatgagactgccctacaccatcatcaccaccccccccctgaaggacttcagcctgtgggagaagaccggcctgaaggagttcctgaagaccaccaagcagagcttcgacctgagcgtgaaggcccagtacaagaagaacaagcacagacacagcatcaccaaccccctggccgtgctgtgcgagttcatcagccagagcatcaagagcttcgacagacacttcgagaagaacagaaacaacgccctggacttcgtgaccaagagctacaacgagaccaagatcaagttcgacaagtacaaggccgagaagagccacgacgagctgcccagaaccttccagatccccggctacaccgtgcccgtggtgaacgtggaggtgagccccttcaccatcgagatgagcgccttcggctacgtgttccccaaggccgtgagcatgcccagcttcagcatcctgggcagcgacgtgagagtgcccagctacaccctgatcctgcccagcctggagctgcccgtgctgcacgtgcccagaaacctgaagctgagcctgcccgacttcaaggagctgtgcaccatcagccacatcttcatccccgccatgggcaacatcacctacgacttcagcttcaagagcagcgtgatcaccctgaacaccaacgccgagctgttcaaccagagcgacatcgtggcccacctgctgagcagcagcagcagcgtgatcgacgccctgcagtacaagctggagggcaccaccagactgaccagaaagagaggcctgaagctggccaccgccctgagcctgagcaacaagttcgtggagggcagccacaacagcaccgtgagcctgaccaccaagaacatggaggtgagcgtggccaccaccaccaaggcccagatccccatcctgagaatgaacttcaagcaggagctgaacggcaacaccaagagcaagcccaccgtgagcagcagcatggagttcaagtacgacttcaacagcagcatgctgtacagcaccgccaagggcgccgtggaccacaagctgagcctggagagcctgaccagctacttcagcatcgagagcagcaccaagggcgacgtgaagggcagcgtgctgagcagagagtacagcggcaccatcgccagcgaggccaacacctacctgaacagcaagagcaccagaagcagcgtgaagctgcagggcaccagcaagatcgacgacatctggaacctggaggtgaaggagaacttcgccggcgaggccaccctgcagagaatctacagcctgtgggagcacagcaccaagaaccacctgcagctggagggcctgttcttcaccaacggcgagcacaccagcaaggccaccctggagctgagcccctggcagatgagcgccctggtgcaggtgcacgccagccagcccagcagcttccacgacttccccgacctgggccaggaggtggccctgaacgccaacaccaagaaccagaagatcagatggaagaacgaggtgagaatccacagcggcagcttccagagccaggtggagctgagcaacgaccaggagaaggcccacctggacatcgccggcagcctggagggccacctgagattcctgaagaacatcatcctgcccgtgtacgacaagagcctgtgggacttcctgaagctggacgtgaccaccagcatcggcagaagacagcacctgagagtgagcaccgccttcgtgtacaccaagaaccccaacggctacagcttcagcatccccgtgaaggtgctggccgacaagttcatcatccccggcctgaagctgaacgacctgaacagcgtgctggtgatgcccaccttccacgtgcccttcaccgacctgcaggtgcccagctgcaagctggacttcagagagatccagatctacaagaagctgagaaccagcagcttcgccctgaacctgcccaccctgcccgaggtgaagttccccgaggtggacgtgctgaccaagtacagccagcccgaggacagcctgatccccttcttcgagatcaccgtgcccgagagccagctgaccgtgagccagttcaccctgcccaagagcgtgagcgacggcatcgccgccctggacctgaacgccgtggccaacaagatcgccgacttcgagctgcccaccatcatcgtgcccgagcagaccatcgagatccccagcatcaagttcagcgtgcccgccggcatcgtgatccccagcttccaggccctgaccgccagattcgaggtggacagccccgtgtacaacgccacctggagcgccagcctgaagaacaaggccgactacgtggagaccgtgctggacagcacctgcagcagcaccgtgcagttcctggagtacgagctgaacgtgctgggcacccacaagatcgaggacggcaccctggccagcaagaccaagggcaccttcgcccacagagacttcagcgccgagtacgaggaggacggcaagtacgagggcctgcaggagtgggagggcaaggcccacctgaacatcaagagccccgccttcaccgacctgcacctgagataccagaaggacaagaagggcatcagcaccagcgccgccagccccgccgtgggcaccgtgggcatggacatggacgaggacgacgacttcagcaagtggaacttctactacagcccccagagcagccccgacaagaagctgaccatcttcaagaccgagctgagagtgagagagagcgacgaggagacccagatcaaggtgaactgggaggaggaggccgccagcggcctgctgaccagcctgaaggacaacgtgcccaaggccaccggcgtgctgtacgactacgtgaacaagtaccactgggagcacaccggcctgaccctgagagaggtgagcagcaagctgagaagaaacctgcagaacaacgccgagtgggtgtaccagggcgccatcagacagatcgacgacatcgacgtgagattccagaaggccgccagcggcaccaccggcacctaccaggagtggaaggacaaggcccagaacctgtaccaggagctgctgacccaggagggccaggccagcttccagggcctgaaggacaacgtgttcgacggcctggtgagagtgacccaggagttccacatgaaggtgaagcacctgatcgacagcctgatcgacttcctgaacttccccagattccagttccccggcaagcccggcatctacaccagagaggagctgtgcaccatgttcatcagagaggtgggcaccgtgctgagccaggtgtacagcaaggtgcacaacggcagcgagatcctgttcagctacttccaggacctggtgatcaccctgcccttcgagctgagaaagcacaagctgatcgacgtgatcagcatgtacagagagctgctgaaggacctgagcaaggaggcccaggaggtgttcaaggccatccagagcctgaagaccaccgaggtgctgagaaacctgcaggacctgctgcagttcatcttccagctgatcgaggacaacatcaagcagctgaaggagatgaagttcacctacctgatcaactacatccaggacgagatcaacaccatcttcagcgactacatcccctacgtgttcaagctgctgaaggagaacctgtgcctgaacctgcacaagttcaacgagttcatccagaacgagctgcaggaggccagccaggagctgcagcagatccaccagtacatcatggccctgagagaggagtacttcgaccccagcatcgtgggctggaccgtgaagtactacgagctggaggagaagatcgtgagcctgatcaagaacctgctggtggccctgaaggacttccacagcgagtacatcgtgagcgccagcaacttcaccagccagctgagcagccaggtggagcagttcctgcacagaaacatccaggagtacctgagcatcctgaccgaccccgacggcaagggcaaggagaagatcgccgagctgagcgccaccgcccaggagatcatcaagagccaggccatcgccaccaagaagatcatcagcgactaccaccagcagttcagatacaagctgcaggacttcagcgaccagctgagcgactactacgagaagttcatcgccgagagcaagagactgatcgacctgagcatccagaactaccacaccttcctgatctacatcaccgagctgctgaagaagctgcagagcaccaccgtgatgaacccctacatgaagctggcccccggcgagctgaccatcatcctgtag

SEQ ID NO: 8417 - DNA, 3084 bp, Artificial Sequence
  Description of Artificial Sequence: Synthetic coding sequence
atgtacgagggcaagcacatccacttcagcgaggtggacaacaagcccctgtgcagctacagccccaagctgtgcaagcagagaagactgaacggctacgccttctgcatcagacacgtgctggaggacaagaccgcccccttcaagcagtgcgagtacgtggccaagtacaacagccagagatgcaccaaccccatccccaagagcgaggacagaagatactgcaacagccacctgcaggtgctgggcttcatccccaagaaggagagaaagaagaagaacgaccccatcgacgaggtgaaggtgagacaccagatggacaccatggccttcagcctgaccgtgcccaccctggccctgaagatgcccaacggcctggacggcatgagcctgagcccccccggcgccagagtgcccctgcactacctggagaccgagctggaggaccccttcgccttcaacgaggaggacgacgacctgaagaagggcgccaccgtgagaaagaagctgcagagcaagctggcccagaacagacagagacagagagagaccgagatcctgaaggtgagacaggagcacttcagccccccccccgcccccagccagcagcagcccccccagcagcacagccacctgagccccctgagcaccagcctgaagccccccgcccccccccagggcagcgtgtgcaagagcccccagccccagaacaccagcctgcccatgcagggcgtggcccccaccacccacaccatcgcccaggccagacagctgagccacaagagacccctgcccctgctgcccagcagcagagcccccaccgtggacccccccagaaccgacagaatcctgatgaaggccaccgccttcagcccccacttcagctgcatcagcagactgcagagactggtgaagctgtgcacccagaagcaccagctggacaccgacctgttcccccacctgggcctggactggagcgaggagagcggcgaggagcccgaggacagcgagcaggccagcccctaccaggtggcctggagcatcagagagaccctgagataccagagacacgccagcgacgacgacgacgccgagagcagaagcagcagagtgacccagctgtgcacctacttccagcagaagtacaagcacctgtgcagactggagagagccgagagcagacagaagaagtgcagacacaccttcagaaaggccctgctgcaggccgccagcaaggagcccgagtgcaccggccagctgatccaggagctgagaagagccgcctgcagcagaaccagcatcagcagaaccaagctgagagaggtggagcccgccgcctgcagcggcaccgtgaagggcgagcagtgcgccaacaaggccctgcccttcaccagacactgcttccagcacatcctgctgaaccacagccagcagctgttcagcagctgcaccgccaagttcgccgacggccagcagtgcagcgtgcccgtgttcgacatcacccaccagacccccctgtgcgaggagcacgccaagaagatggacaacttcctgagaggcgacaacagcagaaaggtgcagcaccagcagcagagaaagcccagaaagaagaccaagccccccgccctgaccaagaagcacaagaagaagagaagaagaggccccagaagaccccagaagcccatcccccccgccgtgccccagggcaacctgagcatgcccgccagcgtgagcctgcccgtggaggccagccacatcagaagccccagcacccccgagctgagcgccgacgagctgcccgacgacatcgccaacgagatcaccgacatcccccacgacctggagctgaaccaggaggacttcagcgacgtgctgcccagactgcccgacgacctgcaggacttcgacttcttcgagggcaagaacggcgacctgctgcccaccaccgaggaggccgaggagctggagagagccctgcaggccgtgaccagcctggagtgcctgagcaccatcggcgtgctggcccagagcgacggcgtgcccgtgcaggagctgagcgacagaggcatcggcgtgttcagcaccggcaccggcgccagcggcatccagagcctgagcagagaggtgaacaccgacctgggcgagctgctgaacggcagaatcgtgcacgacaacttcagcagcctggagctggacgagaacctgctgagaagcgccaccctgagcaacccccccacccccctggccggccagatccagggccagttcagcgcccccgccaacgtgggcctgaccagcgccaccctgatcagccagagcgccctgggcgagagagccttccccggccagttccacggcctgcacgacggcagccacgccagccagagaccccaccccgcccagctgctgagcaaggccgacgacctgatcaccagcagacagcagtacagcagcgaccacagccacagcagcccccacggcagccactacgacagcgagcacgtgcccagcccctacagcgaccacatcaccagcccccacaccaccagctacagcggcgacaacatggccgccaccttcagcgccgagatgcccatcatggcccagcacctgctgcccacccagctggaggtgcccctgggcggcgtggtgaaccccagaacccactggggcaacctgcccgtgaacctgggcgaccccagccccttcagcaacctgctgggcgccgacggccacctgctgagcaccagcctgagcaccccccccaccaccagcaacagcgagaccacccagcccgccttcgccaccgtgacccccagcagcagcagcgtgctgcccggcctgccccagaccagcttcagcggcatgggccccagcgccgagctgatggccagcaccagccccaagcagcagctgccccagttcagcgccgccttcggccaccagctgagcagccacagcggcatccccaaggacctgcagcccagccacagcagcatcgccccccccaccggcttcaccgtgaccggcgccaccgccaccagcaccaacaacgccagcagccccttccccagccccaactag

SEQ ID NO: 8418 - DNA, 114 bp, Artificial Sequence
  Description of Artificial Sequence: Synthetic coding sequence
atgtacgagggcaagcacatccacttcagcgaggtggacaacaagcccctgtgcagctacagccccaagctgtgcaagcagagaagactgaacggctacgccttctgcatctag

SEQ ID NO: 8419 - DNA, 735 bp, Artificial Sequence
  Description of Artificial Sequence: Synthetic coding sequence
atgaacggccccgccgacggcgaggtggactacaagaagaagtacagaaacctgaagagaaagctgaagttcctgatctacgagcacgagtgcttccaggaggagctgagaaaggcccagagaaagctgctgaaggtgagcagagacaagagcttcctgctggacagactgctgcagtacgagaacgtggacgaggacagcagcgacagcgacgccaccgccagcagcgacaacagcgagaccgagggcacccccaagctgagcgacacccccgcccccaagagaaagagaagcccccccctgggcggcgcccccagccccagcagcctgagcctgccccccagcaccggcttccccctgcaggccagcggcgtgcccagcccctacctgagcagcctggccagcagcagatacccccccttccccagcgactacctggccctgcagctgcccgagcccagccccctgagacccaagagagagaagagacccagactgcccagaaagctgaagatggccgtgggcccccccgactgccccgtgggcggccccctgaccttccccggcagaggcagcggcgccggcgtgggcaccaccctgacccccctgcccccccccaagatgcccccccccaccatcctgagcaccgtgcccagacagatgttcagcgacgccggcagcggcgacgacgccctggacggcgacgacgacctggtgatcgacatccccgagtag

SEQ ID NO: 8420 - DNA, 486 bp, Artificial Sequence
  Description of Artificial Sequence: Synthetic coding sequence
gccggcgccgccagacagcccctgctgggcgtggccggcggccagaccctgggcgccacccccggccccgtgatgaacggccccgccgacggcgaggtggactacaagaagaagtacagaaacctgaagagaaagctgaagttcctgatctacgagcacgagtgcttccaggaggagctgagaaaggcccagagaaagctgctgaaggtgagcagagacaagagcttcctgctggacagactgctgcagtacgagaacgtggacgaggacagcagcgacagcgacgccaccgccagcagcgacaacagcgagaccgagggcacccccaagctgagcgacacccccgcccccaagagaaagagaagcccccccctgggcggcgcccccagccccagcagcctgagcctgccccccagcaccggcttccccctgcaggccagcggcgtgcccagcccctacctgagcagcgagagaggccaggcctag

SEQ ID NO: 8421 - DNA, 414 bp, Artificial Sequence
  Description of Artificial Sequence: Synthetic coding sequence
atgaacggccccgccgacggcgaggtggactacaagaagaagtacagaaacctgaagagaaagctgaagttcctgatctacgagcacgagtgcttccaggaggagctgagaaaggcccagagaaagctgctgaaggtgagcagagacaagagcttcctgctggacagactgctgcagtacgagaacgtggacgaggacagcagcgacagcgacgccaccgccagcagcgacaacagcgagaccgagggcacccccaagctgagcgacacccccgcccccaagagaaagagaagcccccccctgggcggcgcccccagccccagcagcctgagcctgccccccagcaccggcttccccctgcaggccagcggcgtgcccagcccctacctgagcagcgagagaggccaggcctag

SEQ ID NO: 8422 - DNA, 735 bp, Artificial Sequence; identical to SEQ ID NO: 8419
  Description of Artificial Sequence: Synthetic coding sequence

SEQ ID NO: 8423 - DNA, 2133 bp, Artificial Sequence
  Description of Artificial Sequence: Synthetic coding sequence
atgagcgcccagggcgactgcgagttcctggtgcagagagccagagagctggtgccccaggacctgtgggccgccaaggcctggctgatcaccgccagaagcctgtaccccgccgacttcaacatccagtacgagatgtacaccatcgagagaaacgccgagagaaccgccaccgccggcagactgctgtacgacatgttcgtgaacttccccgaccagcccgtggtgtggagagagatcagcatcatcaccagcgccctgagaaacgacagccaggacaagcagacccagttcctgagaagcctgttcgagaccctgcccggcagagtgcagtgcgagatgctgctgaaggtgaccgagcagtgcttcaacaccctggagagaagcgagatgctgctgctgctgctgagaagattccccgagaccgtggtgcagcacggcgtgggcctgggcgaggccctgctggaggccgagaccatcgaggagcaggagagccccgtgaactgcttcagaaagctgttcgtgtgcgacgtgctgcccctgatcatcaacaaccacgacgtgagactgcccgccaacctgctgtacaagtacctgaacaaggccgccgagttctacatcaactacgtgaccagaagcacccagatcgagaaccagcaccagggcgcccaggacaccagcgacctgatgagccccagcaagagaagcagccagaagtacatcatcgagggcctgaccgagaagagcagccagatcgtggacccctgggagagactgttcaagatcctgaacgtggtgggcatgagatgcgagtggcagatggacaagggcagaagaagctacggcgacatcctgcacagaatgaaggacctgtgcagatacatgaacaacttcgacagcgaggcccacgccaagtacaagaaccaggtggtgtacagcaccatgctggtgttcttcaagaacgccttccagtacgtgaacagcatccagcccagcctgttccagggccccaacgcccccagccaggtgcccctggtgctgctggaggacgtgagcaacgtgtacggcgacgtggagatcgacagaaacaagcacatccacaagaagagaaagctggccgagggcagagagaagaccatgagcagcgacgacgaggactgcagcgccaagggcagaaacagacacatcgtggtgaacaaggccgagctggccaacagcaccgaggtgctggagagcttcaagctggccagagagagctgggagctgctgtacagcctggagttcctggacaaggagttcaccagaatctgcctggcctggaagaccgacacctggctgtggctgagaatcttcctgaccgacatgatcatctaccagggccagtacaagaaggccatcgccagcctgcaccacctggccgccctgcagggcagcatcagccagccccagatcaccggccagggcaccctggagcaccagagagccctgatccagctggccacctgccacttcgccctgggcgagtacagaatgacctgcgagaaggtgctggacctgatgtgctacatggtgctgcccatccaggacggcggcaagagccaggaggagcccagcaaggtgaagcccaagttcagaaagggcagcgacctgaagctgctgccctgcaccagcaaggccatcatgccctactgcctgcacctgatgctggcctgcttcaagctgagagccttcaccgacaacagagacgacatggccctgggccacgtgatcgtgctgctgcagcaggagtggcccagaggcgagaacctgttcctgaaggccgtgaacaagatctgccagcagggcaacttccagtacgagaacttcttcaactacgtgaccaacatcgacatgctggaggagttcgcctacctgagaacccaggagggcggcaagatccacctggagctgctgcccaaccagggcatgctgatcaagcaccacaccgtgaccagaggcatcaccaagggcgtgaaggaggacttcagactggccatggagagacaggtgagcagatgcggcgagaacctgatggtggtgctgcacagattctgcatcaacgagaagatcctgctgctgcagaccctgacctag

SEQ ID NO: 8424 - DNA, 1389 bp, Artificial Sequence
  Description of Artificial Sequence: Synthetic coding sequence
atggccgccaccgtgaacctggagctggaccccatcttcctgaaggccctgggcttcctgcacagcaagagcaaggacagcgccgagaagctgaaggccctgctggacgagagcctggccagaggcatcgacagcagctacagacccagccagaaggacgtggagccccccaagatcagcagcaccaagaacatcagcatcaagcaggagcccaagatcagcagcagcctgcccagcggcaacaacaacggcaaggtgctgaccaccgagaaggtgaagaaggaggccgagaagagacccgccgacaagatgaagagcgacatcaccgagggcgtggacatccccaagaagcccagactggagaagcccgagacccagagcagccccatcaccgtgcagagcagcaaggacctgcccatggccgacctgagcagcttcgaggagaccagcgccgacgacttcgccatggagatgggcctggcctgcgtggtgtgcagacagatgatggtggccagcggcaaccagctggtggagtgccaggagtgccacaacctgtaccacagagactgccacaagccccaggtgaccgacaaggaggccaacgaccccagactggtgtggtactgcgccagatgcaccagacagatgaagagaatggcccagaagacccagaagcccccccagaagcccgcccccgccgtggtgagcgtgacccccgccgtgaaggaccccctggtgaagaagcccgagaccaagctgaagcaggagaccaccttcctggccttcaagagaaccgaggtgaagaccagcaccgtgatcagcggcaacagcagcagcgccagcgtgagcagcagcgtgaccagcggcctgaccggctgggccgccttcgccgccaagaccagcagcgccggccccagcaccgccaagctgagcagcaccacccagaacaacaccggcaagcccgccaccagcagcgccaaccagaagcccgtgggcctgaccggcctggccaccagcagcaagggcggcatcggcagcaagatcggcagcaacaacagcaccacccccaccgtgcccctgaagccccccccccccctgaccctgggcaagaccggcctgagcagaagcgtgagctgcgacaacgtgagcaaggtgggcctgcccagccccagcagcctggtgcccggcagcagcagccagctgagcggcaacggcaacagcggcaccagcggccccagcggcagcaccaccagcaagaccaccagcgagagcagcagcagccccagcgccagcctgaagggccccaccagccaggagagccagctgaacgccatgaagagactgcagatggtgaagaagaaggccgcccagaagaagctgaagaagtag

SEQ ID NO: 8425 - DNA, 1389 bp, Artificial Sequence; identical to SEQ ID NO: 8424
  Description of Artificial Sequence: Synthetic coding sequence

SEQ ID NO: 8426 - DNA, 267 bp, Artificial Sequence
  Description of Artificial Sequence: Synthetic coding sequence
atggccgccaccgtgaacctggagctggaccccatcttcctgaaggccctgggcttcctgcacagcaagagcaaggacagcgccgagaagctgaaggccctgctggacgagagcctggccagaggcatcgacagcagctacagacccagccagaaggacgtggagccccccaagatcagcagcaccaagaacatcagcatcaagcaggagcccaagatcagcagcagcctgcccagcggcaacaacaacggcaaggtgctgacctag

SEQ ID NO: 8427 - DNA, 399 bp, Artificial Sequence
  Description of Artificial Sequence: Synthetic coding sequence
atggccgccaccgtgaacctggagctggaccccatcttcctgaaggccctgggcttcctgcacagcaagagcaaggacagcgccgagaagctgaaggccctgctggacgagagcctggccagaggcatcgacagcagctacagacccagccagaaggacgtggagccccccaagatcagcagcaccaagaacatcagcatcaagcaggagcccaagatcagcagcagcctgcccagcggcaacaacaacggcaaggtgctgaccaccgagaaggtgaagaaggaggccgagaagagacccgccgacaagatgaagagcgacatcaccgagggcgtggacatccccaagaagcccagactggagaagcccgagacccagagcagccccatcaccgtgtag

SEQ ID NO: 8428 - DNA, 267 bp, Artificial Sequence; identical to SEQ ID NO: 8426
  Description of Artificial Sequence: Synthetic coding sequence

SEQ ID NO: 8429 - DNA, 1389 bp, Artificial Sequence; identical to SEQ ID NO: 8424
  Description of Artificial Sequence: Synthetic coding sequence

SEQ ID NO: 8430 - DNA, 480 bp, Artificial Sequence
  Description of Artificial Sequence: Synthetic coding sequence
atggccgccaccgtgaacctggagctggaccccatcttcctgaaggccctgggcttcctgcacagcaagagcaaggacagcgccgagaagctgaaggccctgctggacgagagcctggccagaggcatcgacagcagctacagacccagccagaaggacgtggagccccccaagatcagcagcaccaagaacatcagcatcaagcaggagcccaagatcagcagcagcctgcccagcggcaacaacaacggcaaggtgctgaccaccgagaaggtgaagaaggaggccgagaagagacccgccgacaagatgaagagcgacatcaccgagggcgtggacatccccaagaagcccagactggagaagcccgagacccagagcagccccatcaccgtgcagagcagcaaggacctgcccatggccgacctgagcagcttcgaggagaccagcgccgacgacttcgccatggagatgggctag

SEQ ID NO: 8431 - DNA, 57 bp, Artificial Sequence
  Description of Artificial Sequence: Synthetic coding sequence
atggccgccaccgtgaacctggagctggaccccatcttcctgaaggccctgggctag

SEQ ID NO: 8432 - DNA, 3129 bp, Artificial Sequence
  Description of Artificial Sequence: Synthetic coding sequence
atggagctgcagaagggcaagggcgccgccgccgccgccgccgccagcggcgccgccggcggcggcggcggcggcgccggcgccggcgcccccggcggcggcagactgctgctgagcaccagcctggacgccaaggacgagctggaggagagactggagagatgcatgagcatcgtgaccagcatgaccgccggcgtgagcgagagagaggccaacgacgccctgaacgcctacgtgtgcaagggcctgccccagcacgaggagatctgcctgggcctgttcaccctgatcctgaccgagcccgcccaggcccagaagtgctacagagacctggccctggtgagcagagacggcatgaacatcgtgctgaacaagatcaaccagatcctgatggagaagtacctgaagctgcaggacacctgcagaacccagctggtgtggctggtgagagagctggtgaagagcggcgtgctgggcgccgacggcgtgtgcatgaccttcatgaagcagatcgccggcggcgacgtgaccgccaagaacatctggctggccgagagcgtgctggacatcctgaccgagcagagagagtgggtgctgaagagcagcatcctgatcgccatggccgtgtacacctacctgagactgatcgtggaccaccacggcaccgcccagctgcaggccctgagacagaaggaggtggacttctgcatcagcctgctgagagagagattcatggagtgcctgatgatcggcagagacctggtgagactgctgcagaacgtggccagaatccccgagttcgagctgctgtggaaggacatcatccacaacccccaggccctgagcccccagttcaccggcatcctgcagctgctgcagagcagaaccagcagaaagttcctggcctgcagactgacccccgacatggagaccaagctgctgttcatgaccagcagagtgagattcggccagcagaagagataccaggactggttccagagacagtacctgagcacccccgacagccagagcctgagatgcgacctgatcagatacatctgcggcgtggtgcaccccagcaacgaggtgctgagcagcgacatcctgcccagatgggccatcatcggctggctgctgaccacctgcaccagcaacgtggccgccagcaacgccaagctggccctgttctacgactggctgttcttcagccccgacaaggacagcatcatgaacatcgagcccgccatcctggtgatgcaccacagcatgaagccccaccccgccatcaccgccaccctgctggacttcatgtgcagaatcatccccaacttctacccccccctggagggccacgtgagacagggcgtgttcagcagcctgaaccacatcgtggagaagagagtgctggcccacctggcccccctgttcgacaaccccaagctggacaaggagctgagagccatgctgagagagaagttccccgagttctgcagcagccccagcccccccgtggaggtgaagatcgaggagcccgtgagcatggagatggacaaccacatgagcgacaaggacgagagctgctacgacaacgccgaggccgccttcagcgacgacgaggaggacctgaacagcaagggcaagaagagagagttcagattccaccccatcaaggagaccgtggtggaggagcccgtggacatcaccccctacctggaccagctggacgagagcctgagagacaaggtgctgcagctgcagaagggcagcgacaccgaggcccagtgcgaggtgatgcaggagatcgtggaccaggtgctggaggaggacttcgacagcgagcagctgagcgtgctggccagctgcctgcaggagctgttcaaggcccacttcagaggcgaggtgctgcccgaggagatcaccgaggagagcctggaggagagcgtgggcaagcccctgtacctgatcttcagaaacctgtgccagatgcaggaggacaacagcagcttcagcctgctgctggacctgctgagcgagctgtaccagaagcagcccaagatcggctaccacctgctgtactacctgagagccagcaaggccgccgccggcaagatgaacctgtacgagagcttcgcccaggccacccagctgggcgacctgcacacctgcctgatgatggacatgaaggcctgccaggaggacgacgtgagactgctgtgccacctgacccccagcatctacaccgagttccccgacgagaccctgagaagcggcgagctgctgaacatgatcgtggccgtgatcgacagcgcccagctgcaggagctggtgtgccacgtgatgatgggcaacctggtgatgttcagaaaggacagcgtgctgaacatcctgatccagagcctggactgggagaccttcgagcagtactgcgcctggcagctgttcctggcccacaacatccccctggagaccatcatccccatcctgcagcacctgaagtacaaggagcaccccgaggccctgagctgcctgctgctgcagctgagaagagagaagcccagcgaggagatggtgaagatggtgctgagcagaccctgccaccccgacgaccagttcaccaccagcatcctgagacactggtgcatgaagcacgacgagctgctggccgagcacatcaagagcctgctgatcaagaacaacagcctgcccagaaagagacagagcctgagaagcagcagcagcaagctggcccagctgaccctggagcagatcctggagcacctggacaacctgagactgaacctgaccaacaccaagcagaacttcttcagccagacccccatcctgcaggccctgcagcacgtgcaggccagctgcgacgaggcccacaagatgaagttcagcgacctgttcagcctggccgaggagtacgaggacagcagcaccaagccccccaagagcagaagaaaggccgccctgagcagccccagaagcagaaagaacgccacccagccccccaacgccgaggaggagagcggcagcagcagcgccagcgaggaggaggacaccaagcccaagcccaccaagagaaagagaaagggcagcagcgccgtgggcagcgacagcgactag

SEQ ID NO: 8433 - DNA, 3129 bp, Artificial Sequence; identical to SEQ ID NO: 8432
  Description of Artificial Sequence: Synthetic coding sequence

SEQ ID NO: 8434 - DNA, 2709 bp, Artificial Sequence
  Description of Artificial Sequence: Synthetic coding sequence
atggccgtgtacacctacctgagactgatcgtggaccaccacggcaccgcccagctgcaggccctgagacagaaggaggtggacttctgcatcagcctgctgagagagagattcatggagtgcctgatgatcggcagagacctggtgagactgctgcagaacgtggccagaatccccgagttcgagctgctgtggaaggacatcatccacaacccccaggccctgagcccccagttcaccggcatcctgcagctgctgcagagcagaaccagcagaaagttcctggcctgcagactgacccccgacatggagaccaagctgctgttcatgaccagcagagtgagattcggccagcagaagagataccaggactggttccagagacagtacctgagcacccccgacagccagagcctgagatgcgacctgatcagatacatctgcggcgtggtgcaccccagcaacgaggtgctgagcagcgacatcctgcccagatgggccatcatcggctggctgctgaccacctgcaccagcaacgtggccgccagcaacgccaagctggccctgttctacgactggctgttcttcagccccgacaaggacagcatcatgaacatcgagcccgccatcctggtgatgcaccacagcatgaagccccaccccgccatcaccgccaccctgctggacttcatgtgcagaatcatccccaacttctacccccccctggagggccacgtgagacagggcgtgttcagcagcctgaaccacatcgtggagaagagagtgctggcccacctggcccccctgttcgacaaccccaagctggacaaggagctgagagccatgctgagagagaagttccccgagttctgcagcagccccagcccccccgtggaggtgaagatcgaggagcccgtgagcatggagatggacaaccacatgagcgacaaggacgagagctgctacgacaacgccgaggccgccttcagcgacgacgaggaggacctgaacagcaagggcaagaagagagagttcagattccaccccatcaaggagaccgtggtggaggagcccgtggacatcaccccctacctggaccagctggacgagagcctgagagacaaggtgctgcagctgcagaagggcagcgacaccgaggcccagtgcgaggtgatgcaggagatcgtggaccaggtgctggaggaggacttcgacagcgagcagctgagcgtgctggccagctgcctgcaggagctgttcaaggcccacttcagaggcgaggtgctgcccgaggagatcaccgaggagagcctggaggagagcgtgggcaagcccctgtacctgatcttcagaaacctgtgccagatgcaggaggacaacagcagcttcagcctgctgctggacctgctgagcgagctgtaccagaagcagcccaagatcggctaccacctgctgtactacctgagagccagcaaggccgccgccggcaagatgaacctgtacgagagcttcgcccaggccacccagctgggcgacctgcacacctgcctgatgatggacatgaaggcctgccaggaggacgacgtgagactgctgtgccacctgacccccagcatctacaccgagttccccgacgagaccctgagaagcggcgagctgctgaacatgatcgtggccgtgatcgacagcgcccagctgcaggagctggtgtgccacgtgatgatgggcaacctggtgatgttcagaaaggacagcgtgctgaacatcctgatccagagcctggactgggagaccttcgagcagtactgcgcctggcagctgttcctggcccacaacatccccctggagaccatcatccccatcctgcagcacctgaagtacaaggagcaccccgaggccctgagctgcctgctgctgcagctgagaagagagaagcccagcgaggagatggtgaagatggtgctgagcagaccctgccaccccgacgaccagttcaccaccagcatcctgagacactggtgcatgaagcacgacgagctgctggccgagcacatcaagagcctgctgatcaagaacaacagcctgcccagaaagagacagagcctgagaagcagcagcagcaagctggcccagctgaccctggagcagatcctggagcacctggacaacctgagactgaacctgaccaacaccaagcagaactgcatgcccagcaccctgggcgtgcagtgcagaagatgctgccccggccccgactacgcctggagccaggccggcggcagaggcagaacccccggcgccaccacccacaccagagacaagaccacctgcgcctgctgcctgatcagcagccagaccagcgactgcttcagcttccccgccctgcccttcctgcccctggtgttcagccagacccccatcctgcaggccctgcagcacgtgcaggccagctgcgacgaggcccacaagatgaagttcagcgacctgttcagcctggccgaggagtacgaggacagcagcaccaagccccccaagagcagaagaaaggccgccctgagcagccccagaagcagaaagaacgccacccagccccccaacgccgaggaggagagcggcagcagcagcgccagcgaggaggaggacaccaagcccaagcccaccaagagaaagagaaagggcagcagcgccgtgggcagcgacagcgactag

SEQ ID NO: 8435 - DNA, 2709 bp, Artificial Sequence; identical to SEQ ID NO: 8434
  Description of Artificial Sequence: Synthetic coding sequence

SEQ ID NO: 8436 - DNA, 1530 bp, Artificial Sequence
  Description of Artificial Sequence: Synthetic coding sequence
cccaacagcatctgcagacacctgcacctgaccgacaccagccacggcgtgagaaacaagtgcctgcagctgctgggcaacctgggcagcctggagaagagcgtgaccaaggacgccgagggcctggccgccagagacgtgcagaagatcatcggcgactacttcagcgaccaggaccccagagtgagaaccgccgccatcaaggccatgctgcagctgcacgagagaggcctgaagctgcaccagaccatctacaaccaggcctgcaagctgctgagcgacgactacgagcaggtgagaagcgccgccgtgcagctgatctgggtggtgagccagctgtaccccgagagcatcgtgcccatccccagcagcaacgaggagatcagactggtggacgacgccttcggcaagatctgccacatggtgagcgacggcagctgggtggtgagagtgcaggccgccaagctgctgggcagcatggagcaggtgagcagccacttcctggagcagaccctggacaagaagctgatgagcgacctgagaagaaagagaaccgcccacgagagagccaaggagctgtacagcagcggcgagttcagcagcggcagaaagtggggcgacgacgcccccaaggaggaggtggacaccggcgccgtgaacctgatcgagagcggcgcctgcggcgccttcgtgcacggcctggaggacgagatgtacgaggtgagaatcgccgccgtggaggccctgtgcatgctggcccagagcagccccagcttcgccgagaagtgcctggacttcctggtggacatgttcaacgacgagatcgaggaggtgagactgcagagcatccacaccatgagaaagatcagcaacaacatcaccctgagagaggaccagctggacaccgtgctggccgtgctggaggacagcagcagagacatcagagaggccctgcacgagctgctgtgctgcaccaacgtgagcaccaaggagggcatccacctggccctggtggagctgctgaagaacctgaccaagtaccccaccgacagagacagcatctggaagtgcctgaagttcctgggcagcagacaccccaccctggtgctgcccctggtgcccgagctgctgagcacccaccccttcttcgacaccgccgagcccgacatggacgaccccgcctacatcgccgtgctggtgctgatcttcaacgccgccaagacctgccccaccatgcccgccctgttcagcgaccacaccttcagacactacgcctacctgagagacagcctgagccacctggtgcccgccctgagactgcccggcagaaagctggtgagcagcgccgtgagccccagcatcatcccccaggaggaccccagccagcagttcctgcagcagagcctggagagagtgtacagcctgcagcacctggacccccagggcgcccaggagctgctggagttcaccatcagagtggaggtgagcccctggtggcccggctggagccagacccccgagctgaagtag

SEQ ID NO: 8437 - DNA, 2892 bp, Artificial Sequence
  Description of Artificial Sequence: Synthetic coding sequence
atggccgcccacctgaagaagagagtgtacgaggagttcaccaaggtggtgcagccccaggaggagatcgccaccaagaagctgagactgaccaagcccagcaagagcgccgccctgcacatcgacctgtgcaaggccaccagccccgccgacgccctgcagtacctgctgcagttcgccagaaagcccgtggaggccgagagcgtggagggcgtggtgagaatcctgctggagcactactacaaggagaacgaccccagcgtgagactgaagatcgccagcctgctgggcctgctgagcaagaccgccggcttcagccccgactgcatcatggacgacgccatcaacatcctgcagaacgagaagagccaccaggtgctggcccagctgctggacaccctgctggccatcggcaccaagctgcccgagaaccaggccatccagatgagactggtggacgtggcctgcaagcacctgaccgacaccagccacggcgtgagaaacaagtgcctgcagctgctgggcaacctgggcagcctggagaagagcgtgaccaaggacgccgagggcctggccgccagagacgtgcagaagatcatcggcgactacttcagcgaccaggaccccagagtgagaaccgccgccatcaaggccatgctgcagctgcacgagagaggcctgaagctgcaccagaccatctacaaccaggcctgcaagctgctgagcgacgactacgagcaggtgagaagcgccgccgtgcagctgatctgggtggtgagccagctgtaccccgagagcatcgtgcccatccccagcagcaacgaggagatcagactggtggacgacgccttcggcaagatctgccacatggtgagcgacggcagctgggtggtgagagtgcaggccgccaagctgctgggcagcatggagcaggtgagcagccacttcctggagcagaccctggacaagaagctgatgagcgacctgagaagaaagagaaccgcccacgagagagccaaggagctgtacagcagcggcgagttcagcagcggcagaaagtggggcgacgacgcccccaaggaggaggtggacaccggcgccgtgaacctgatcgagagcggcgcctgcggcgccttcgtgcacggcctggaggacgagatgtacgaggtgagaatcgccgccgtggaggccctgtgcatgctggcccagagcagccccagcttcgccgagaagtgcctggacttcctggtggacatgttcaacgacgagatcgaggaggtgagactgcagagcatccacaccatgagaaagatcagcaacaacatcaccctgagagaggaccagctggacaccgtgctggccgtgctggaggacagcagcagagacatcagagaggccctgcacgagctgctgtgctgcaccaacgtgagcaccaaggagggcatccacctggccctggtggagctgctgaagaacctgaccaagtaccccaccgacagagacagcatctggaagtgcctgaagttcctgggcagcagacaccccaccctggtgctgcccctggtgcccgagctgctgagcacccaccccttcttcgacaccgccgagcccgacatggacgaccccgcctacatcgccgtgctggtgctgatcttcaacgccgccaagacctgccccaccatgcccgccctgttcagcgaccacaccttcagacactacgcctacctgagagacagcctgagccacctggtgcccgccctgagactgcccggcagaaagctggtgagcagcgccgtgagccccagcatcatcccccaggaggaccccagccagcagttcctgcagcagagcctggagagagtgtacagcctgcagcacctggacccccagggcgcccaggagctgctggagttcaccatcagagacctgcagagactgggcgagctgcagagcgagctggccggcgtggccgacttcagcgccacctacctgagatgccagctgctgctgatcaaggccctgcaggagaagctgtggaacgtggccgcccccctgtacctgaagcagagcgacctggccagcgccgccgccaagcagatcatggaggagacctacaagatggagttcatgtacagcggcgtggagaacaagcaggtggtgatcatccaccacatgagactgcaggccaaggccctgcagctgatcgtgaccgccagaaccaccagaggcctggaccccctgttcggcatgtgcgagaagttcctgcaggaggtggacttcttccagagatacttcatcgccgacctgccccacctgcaggacagcttcgtggacaagctgctggacctgatgcccagactgatgaccagcaagcccgccgaggtggtgaagatcctgcagaccatgctgagacagagcgccttcctgcacctgcccctgcccgagcagatccacaaggccagcgccaccatcatcgagcccgccggcgagagcgacaaccccctgagattcaccagcggcctggtggtggccctggacgtggacgccaccctggagcacgtgcaggacccccagaacaccgtgaaggtgcaggtgctgtaccccgacggccaggcccagatgatccaccccaagcccgccgacttcagaaaccccggccccggcagacacagactgatcacccaggtgtacctgagccacaccgcctggaccgaggcctgccaggtggaggtgagactgctgctggcctacaacagcagcgccagaatccccaagtgcccctggatggagggcggcgagatgagcccccaggtggagaccagcatcgagggcaccatccccttcagcaagcccgtgaaggtgtacatcatgcccaagcccgccagaagatag

SEQ ID NO: 8438 - DNA, 1017 bp, Artificial Sequence
  Description of Artificial Sequence: Synthetic coding sequence
atgcccgccctgaagcagaccgccagccaggtgacccagaccctgagagacctgcagagactgggcgagctgcagagcgagctggccggcgtggccgacttcagcgccacctacctgagatgccagctgctgctgatcaaggccctgcaggagaagctgtggaacgtggccgcccccctgtacctgaagcagagcgacctggccagcgccgccgccaagcagatcatggaggagacctacaagatggagttcatgtacagcggcgtggagaacaagcaggtggtgatcatccaccacatgagactgcaggccaaggccctgcagctgatcgtgaccgccagaaccaccagaggcctggaccccctgttcggcatgtgcgagaagttcctgcaggaggtggacttcttccagagatacttcatcgccgacctgccccacctgcaggacagcttcgtggacaagctgctggacctgatgcccagactgatgaccagcaagcccgccgaggtggtgaagatcctgcagaccatgctgagacagagcgccttcctgcacctgcccctgcccgagcagatccacaaggccagcgccaccatcatcgagcccgccggcgagagcgacaaccccctgagattcaccagcggcctggtggtggccctggacgtggacgccaccctggagcacgtgcaggacccccagaacaccgtgaaggtgcaggtgctgtaccccgacggccaggcccagatgatccaccccaagcccgccgacttcagaaaccccggccccggcagacacagactgatcacccaggtgtacctgagccacaccgcctggaccgaggcctgccaggtggaggtgagactgctgctggcctacaacagcagcgccagaatccccaagtgcccctggatggagggcggcgagatgagcccccaggtggagaccagcatcgagggcaccatccccttcagcaagcccgtgaaggtgtacatcatgcccaagcccgccagaagatag

SEQ ID NO: 8439 - DNA, 2829 bp, Artificial Sequence
  Description of Artificial Sequence: Synthetic coding sequence
atggccagcaacagcaccaagagcttcctggccgacgccggctacggcgagcaggagctggacgccaacagcgccctgatggagctggacaagggcctgagaagcggcaagctgggcgagcagtgcgaggccgtggtgagattccccagactgttccagaagtaccccttccccatcctgatcaacagcgccttcctgaagctggccgacgtgttcagagtgggcaacaacttcctgagactgtgcgtgctgaaggtgacccagcagagcgagaagcacctggagaagatcctgaacgtggacgagttcgtgaagagaatcttcagcgtgatccacagcaacgaccccgtggccagagccatcaccctgagaatgctgggcagcctggccagcatcatccccgagagaaagaacgcccaccacagcatcagacagagcctggacagccacgacaacgtggaggtggaggccgccgtgttcgccgccgccaacttcagcgcccagagcaaggacttcgccgtgggcatctgcaacaagatcagcgagatgatccagggcctggccacccccgtggacctgaagctgaagctgatccccatcctgcagcacatgcaccacgacgccatcctggccagcagcgccagacagctgctgcagcagctggtgaccagctaccccagcaccaagatggtgatcgtgagcctgcacaccttcaccctgctggccgccagcagcctggtggacacccccaagcagatccagctgctgctgcagtacctgaagaacgaccccagaaaggccgtgaagagactggccatccaggacctgaagctgctggccaacaagaccccccacacctggagcagagagaacatccaggccctgtgcgagtgcgccctgcagaccccctacgacagcctgaagctgggcatgctgagcgtgctgagcaccctgagcggcaccatcgccatcaagcactacttcagcatcgtgcccggcaacgtgagcagcagccccagaagcagcgacctggtgaagctggcccaggagtgctgctaccacaacaacagaggcatcgccgcccacggcgtgagagtgctgaccaacatcaccgtgagctgccaggagaaggacctgctggccctggagcaggacgccgtgttcggcctggagagcctgctggtgctgtgcagccaggacgacagccccggcgcccaggccaccctgaagatcgccctgaactgcatggtgaagctggccaagggcagaccccacctgagccagagcgtggtggagaccctgctgacccagctgcacagcgcccaggacgccgccagaatcctgatgtgccactgcctggccgccatcgccatgcagctgcccgtgctgggcgacggcatgctgggcgacctgatggagctgtacaaggtgatcggcagaagcgccaccgacaagcagcaggagctgctggtgagcctggccaccgtgatcttcgtggccagccagaaggccctgagcgtggagagcaaggccgtgatcaagcagcagctggagagcgtgagcaacggctggaccgtgtacagaatcgccagacaggccagcagaatgggcaaccacgacatggccaaggagctgtaccagagcctgctgacccaggtggccagcgagcacttctacttctggctgaacagcctgaaggagttcagccacgccgagcagtgcctgaccggcctgcaggaggagaactacagcagcgccctgagctgcatcgccgagagcctgaagttctaccacaagggcatcgccagcctgaccgccgccagcacccccctgaaccccctgagcttccagtgcgagttcgtgaagctgagaatcgacctgctgcaggccttcagccagctgatctgcacctgcaacagcctgaagaccagccccccccccgccatcgccaccaccatcgccatgaccctgggcaacgacctgcagagatgcggcagaatcagcaaccagatgaagcagagcatggaggagttcagaagcctggccagcagatacggcgacctgtaccaggccagcttcgacgccgacagcgccaccctgagaaacgtggagctgcagcagcagagctgcctgctgatcagccacgccatcgaggccctgatcctggaccccgagagcgccagcttccaggagtacggcagcaccggcaccgcccacgccgacagcgagtacgagagaagaatgatgagcgtgtacaaccacgtgctggaggaggtggagagcctgaacagaaagtacacccccgtgagctacatgagatacttcttccagaagctgcagagcaccagcatcaagctggccctgagccccagccccagaaaccccgccgagcccatcgccgtgcagaacaaccagcagctggccctgaaggtggagggcgtggtgcagcacggcagcaagcccggcctgttcagaaagatccagagcgtgtgcctgaacgtgagcagcaccctgcagagcaagagcggccaggactacaagatccccatcgacaacatgaccaacgagatggagcagagagtggagccccacaacgactacttcagcacccagttcctgctgaacttcgccatcctgggcacccacaacatcaccgtggagagcagcgtgaaggacgccaacggcatcgtgtggaagaccggccccagaaccaccatcttcgtgaagagcctggaggacccctacagccagcagatcagactgcagcagcagcaggcccagcagcccctgcagcagcagcagcagagaaacgcctacaccagattctag

SEQ ID NO: 8440 - DNA, 2847 bp, Artificial Sequence
  Description of Artificial Sequence: Synthetic coding sequence
atggccagcaacagcaccaagagcttcctggccgacgccggctacggcgagcaggagctggacgccaacagcgccctgatggagctggacaagggcctgagaagcggcaagctgggcgagcagtgcgaggccgtggtgagattccccagactgttccagaagtaccccttccccatcctgatcaacagcgccttcctgaagctggccgacgtgttcagagtgggcaacaacttcctgagactgtgcgtgctgaaggtgacccagcagagcgagaagcacctggagaagatcctgaacgtggacgagttcgtgaagagaatcttcagcgtgatccacagcaacgaccccgtggccagagccatcaccctgagaatgctgggcagcctggccagcatcatccccgagagaaagaacgcccaccacagcatcagacagagcctggacagccacgacaacgtggaggtggaggccgccgtgttcgccgccgccaacttcagcgcccagagcaaggacttcgccgtgggcatctgcaacaagatcagcgagatgatccagggcctggccacccccgtggacctgaagctgaagctgatccccatcctgcagcacatgcaccacgacgccatcctggccagcagcgccagacagctgctgcagcagctggtgaccagctaccccagcaccaagatggtgatcgtgagcctgcacaccttcaccctgctggccgccagcagcctggtggacacccccaagcagatccagctgctgctgcagtacctgaagaacgaccccagaaaggccgtgaagagactggccatccaggacctgaagctgctggccaacaagaccccccacacctggagcagagagaacatccaggccctgtgcgagtgcgccctgcagaccccctacgacagcctgaagctgggcatgctgagcgtgctgagcaccctgagcggcaccatcgccatcaagcactacttcagcatcgtgcccggcaacgtgagcagcagccccagaagcagcgacctggtgaagctggcccaggagtgctgctaccacaacaacagaggcatcgccgcccacggcgtgagagtgctgaccaacatcaccgtgagctgccaggagaaggacctgctggccctggagcaggacgccgtgttcggcctggagagcctgctggtgctgtgcagccaggacgacagccccggcgcccaggccaccctgaagatcgccctgaactgcatggtgaagctggccaagggcagaccccacctgagccagagcgtggtggagaccctgctgacccagctgcacagcgcccaggacgccgccagaatcctgatgtgccactgcctggccgccatcgccatgcagctgcccgtgctgggcgacggcatgctgggcgacctgatggagctgtacaaggtgatcggcagaagcgccaccgacaagcagcaggagctgctggtgagcctggccaccgtgatcttcgtggccagccagaaggccctgagcgtggagagcaaggccgtgatcaagcagcagctggagagcgtgagcaacggctggaccgtgtacagaatcgccagacaggccagcagaatgggcaaccacgacatggccaaggagctgtaccagagcctgctgacccaggtggccagcgagcacttctacttctggctgaacagcctgaaggagttcagccacgccgagcagtgcctgaccggcctgcaggaggagaactacagcagcgccctgagctgcatcgccgagagcctgaagttctaccacaagggcatcgccagcctgaccgccgccagcacccccctgaaccccctgagcttccagtgcgagttcgtgaagctgagaatcgacctgctgcaggccttcagccagctgatctgcacctgcaacagcctgaagaccagccccccccccgccatcgccaccaccatcgccatgaccctgggcaacgacctgcagagatgcggcagaatcagcaaccagatgaagcagagcatggaggagttcagaagcctggccagcagatacggcgacctgtaccaggccagcttcgacgccgacagcgccaccctgagaaacgtggagctgcagcagcagagctgcctgctgatcagccacgccatcgaggccctgatcctggaccccgagagcgccagcttccaggagtacggcagcaccggcaccgcccacgccgacagcgagtacgagagaagaatgatgagcgtgtacaaccacgtgctggaggagcacaccgcctgcctgtgcaacgccatcatcgccctgctgaaggtgcccctgagcttccagagatacttcttccagaagctgcagagcaccagcatcaagctggccctgagccccagccccagaaaccccgccgagcccatcgccgtgcagaacaaccagcagctggccctgaaggtggagggcgtggtgcagcacggcagcaagcccggcctgttcagaaagatccagagcgtgtgcctgaacgtgagcagcaccctgcagagcaagagcggccaggactacaagatccccatcgacaacatgaccaacgagatggagcagagagtggagccccacaacgactacttcagcacccagttcctgctgaacttcgccatcctgggcacccacaacatcaccgtggagagcagcgtgaaggacgccaacggcatcgtgtggaagaccggccccagaaccaccatcttcgtgaagagcctggaggacccctacagccagcagatcagactgcagcagcagcaggcccagcagcccctgcagcagcagcagcagagaaacgcctacaccagattctag

SEQ ID NO: 8441 - DNA, 2889 bp, Artificial Sequence
  Description of Artificial Sequence: Synthetic coding sequence
atggccagcaacagcaccaagagcttcctggccgacgccggctacggcgagcaggagctggacgccaacagcgccctgatggagctggacaagggcctgagaagcggcaagctgggcgagcagtgcgaggccgtggtgagattccccagactgttccagaagtaccccttccccatcctgatcaacagcgccttcctgaagctggccgacgtgttcagagtgggcaacaacttcctgagactgtgcgtgctgaaggtgacccagcagagcgagaagcacctggagaagatcctgaacgtggacgagttcgtgaagagaatcttcagcgtgatccacagcaacgaccccgtggccagagccatcaccctgagaatgctgggcagcctggccagcatcatccccgagagaaagaacgcccaccacagcatcagacagagcctggacagccacgacaacgtggaggtggaggccgccgtgttcgccgccgccaacttcagcgcccagagcaaggacttcgccgtgggcatctgcaacaagatcagcgagatgatccagggcctggccacccccgtggacctgaagctgaagctgatccccatcctgcagcacatgcaccacgacgccatcctggccagcagcgccagacagctgctgcagcagctggtgaccagctaccccagcaccaagatggtgatcgtgagcctgcacaccttcaccctgctggccgccagcagcctggtggacacccccaagcagatccagctgctgctgcagtacctgaagaacgaccccagaaaggccgtgaagagactggccatccaggacctgaagctgctggccaacaagaccccccacacctggagcagagagaacatccaggccctgtgcgagtgcgccctgcagaccccctacgacagcctgaagctgggcatgctgagcgtgctgagcaccctgagcggcaccatcgccatcaagcactacttcagcatcgtgcccggcaacgtgagcagcagccccagaagcagcgacctggtgaagctggcccaggagtgctgctaccacaacaacagaggcatcgccgcccacggcgtgagagtgctgaccaacatcaccgtgagctgccaggagaaggacctgctggccctggagcaggacgccgtgttcggcctggagagcctgctggtgctgtgcagccaggacgacagccccggcgcccaggccaccctgaagatcgccctgaactgcatggtgaagctggccaagggcagaccccacctgagccagagcgtggtggagaccctgctgacccagctgcacagcgcccaggacgccgccagaatcctgatgtgccactgcctggccgccatcgccatgcagctgcccgtgctgggcgacggcatgctgggcgacctgatggagctgtacaaggtgatcggcagaagcgccaccgacaagcagcaggagctgctggtgagcctggccaccgtgatcttcgtggccagccagaaggccctgagcgtggagagcaaggccgtgatcaagcagcagctggagagcgtgagcaacggctggaccgtgtacagaatcgccagacaggccagcagaatgggcaaccacgacatggccaaggagctgtaccagagcctgctgacccaggtggccagcgagcacttctacttctggctgaacagcctgaaggagttcagccacgccgagcagtgcctgaccggcctgcaggaggagaactacagcagcgccctgagctgcatcgccgagagcctgaagttctaccacaagggcatcgccagcctgaccgccgccagcacccccctgaaccccctgagcttccagtgcgagttcgtgaagctgagaatcgacctgctgcaggccttcagccagctgatctgcacctgcaacagcctgaagaccagccccccccccgccatcgccaccaccatcgccatgaccctgggcaacgacctgcagagatgcggcagaatcagcaaccagatgaagcagagcatggaggagttcagaagcctggccagcagatacggcgacctgtaccaggccagcttcgacgccgacagcgccaccctgagaaacgtggagctgcagcagcagagctgcctgctgatcagccacgccatcgaggccctgatcctggaccccgagagcgccagcttccaggagtacggcagcaccggcaccgcccacgccgacagcgagtacgagagaagaatgatgagcgtgtacaaccacgtgctggaggaggtggagagcctgaacagaaagtacacccccgtgagctacatgcacaccgcctgcctgtgcaacgccatcatcgccctgctgaaggtgcccctgagcttccagagatacttcttccagaagctgcagagcaccagcatcaagctggccctgagccccagccccagaaaccccgccgagcccatcgccgtgcagaacaaccagcagctggccctgaaggtggagggcgtggtgcagcacggcagcaagcccggcctgttcagaaagatccagagcgtgtgcctgaacgtgagcagcaccctgcagagcaagagcggccaggactacaagatccccatcgacaacatgaccaacgagatggagcagagagtggagccccacaacgactacttcagcacccagttcctgctgaacttcgccatcctgggcacccacaacatcaccgtggagagcagcgtgaaggacgccaacggcatcgtgtggaagaccggccccagaaccaccatcttcgtgaagagcctggaggacccctacagccagcagatcagactgcagcagcagcaggcccagcagcccctgcagcagcagcagcagagaaacgcctacaccagattctag

SEQ ID NO: 8442 - DNA, 2742 bp, Artificial Sequence
  Description of Artificial Sequence: Synthetic coding sequence
atggccagcaacagcaccaagagcttcctggccgacgccggctacggcgagcaggagctggacgccaacagcgccctgatggagctggacaagggcctgagaagcggcaagctgggcgagcagtgcgaggccgtggtgagattccccagactgttccagaagtaccccttccccatcctgatcaacagcgccttcctgaagctggccgacgtgttcagagtgggcatgctgggcagcctggccagcatcatccccgagagaaagaacgcccaccacagcatcagacagagcctggacagccacgacaacgtggaggtggaggccgccgtgttcgccgccgccaacttcagcgcccagagcaaggacttcgccgtgggcatctgcaacaagatcagcgagatgatccagggcctggccacccccgtggacctgaagctgaagctgatccccatcctgcagcacatgcaccacgacgccatcctggccagcagcgccagacagctgctgcagcagctggtgaccagctaccccagcaccaagatggtgatcgtgagcctgcacaccttcaccctgctggccgccagcagcctggtggacacccccaagcagatccagctgctgctgcagtacctgaagaacgaccccagaaaggccgtgaagagactggccatccaggacctgaagctgctggccaacaagaccccccacacctggagcagagagaacatccaggccctgtgcgagtgcgccctgcagaccccctacgacagcctgaagctgggcatgctgagcgtgctgagcaccctgagcggcaccatcgccatcaagcactacttcagcatcgtgcccggcaacgtgagcagcagccccagaagcagcgacctggtgaagctggcccaggagtgctgctaccacaacaacagaggcatcgccgcccacggcgtgagagtgctgaccaacatcaccgtgagctgccaggagaaggacctgctggccctggagcaggacgccgtgttcggcctggagagcctgctggtgctgtgcagccaggacgacagccccggcgcccaggccaccctgaagatcgccctgaactgcatggtgaagctggccaagggcagaccccacctgagccagagcgtggtggagaccctgctgacccagctgcacagcgcccaggacgccgccagaatcctgatgtgccactgcctggccgccatcgccatgcagctgcccgtgctgggcgacggcatgctgggcgacctgatggagctgtacaaggtgatcggcagaagcgccaccgacaagcagcaggagctgctggtgagcctggccaccgtgatcttcgtggccagccagaaggccctgagcgtggagagcaaggccgtgatcaagcagcagctggagagcgtgagcaacggctggaccgtgtacagaatcgccagacaggccagcagaatgggcaaccacgacatggccaaggagctgtaccagagcctgctgacccaggtggccagcgagcacttctacttctggctgaacagcctgaaggagttcagccacgccgagcagtgcctgaccggcctgcaggaggagaactacagcagcgccctgagctgcatcgccgagagcctgaagttctaccacaagggcatcgccagcctgaccgccgccagcacccccctgaaccccctgagcttccagtgcgagttcgtgaagctgagaatcgacctgctgcaggccttcagccagctgatctgcacctgcaacagcctgaagaccagccccccccccgccatcgccaccaccatcgccatgaccctgggcaacgacctgcagagatgcggcagaatcagcaaccagatgaagcagagcatggaggagttcagaagcctggccagcagatacggcgacctgtaccaggccagcttcgacgccgacagcgccaccctgagaaacgtggagctgcagcagcagagctgcctgctgatcagccacgccatcgaggccctgatcctggaccccgagagcgccagcttccaggagtacggcagcaccggcaccgcccacgccgacagcgagtacgagagaagaatgatgagcgtgtacaaccacgtgctggaggaggtggagagcctgaacagaaagtacacccccgtgagctacatgcacaccgcctgcctgtgcaacgccatcatcgccctgctgaaggtgcccctgagcttccagagatacttcttccagaagctgcagagcaccagcatcaagctggccctgagccccagccccagaaaccccgccgagcccatcgccgtgcagaacaaccagcagctggccctgaaggtggagggcgtggtgcagcacggcagcaagcccggcctgttcagaaagatccagagcgtgtgcctgaacgtgagcagcaccctgcagagcaagagcggccaggactacaagatccccatcgacaacatgaccaacgagatggagcagagagtggagccccacaacgactacttcagcacccagttcctgctgaacttcgccatcctgggcacccacaacatcaccgtggagagcagcgtgaaggacgccaacggcatcgtgtggaagaccggccccagaaccaccatcttcgtgaagagcctggaggacccctacagccagcagatcagactgcagcagcagcaggcccagcagcccctgcagcagcagcagcagagaaacgcctacaccagattctag

SEQ ID NO: 8443 - DNA, 2937 bp, Artificial Sequence
  Description of Artificial Sequence: Synthetic coding sequence
atgagcgccgaggccgccgacagagaggccgccaccagcagcagaccctgcacccccccccagacctgctggttcgagttcctgctggaggagagcctgctggagaagcacctgagaaagccctgccccgaccccgcccccgtgcagctgatcgtgcagttcctggagcaggccagcaagcccagcgtgaacgagcagaaccaggtgcagcccccccccgacaacaagagaaacagaatcctgaagctgctggccctgaaggtggccgcccacctgaagtgggacctggacatcctggagaagagcctgagcgtgcccgtgctgaacatgctgctgaacgagctgctgtgcatcagcaaggtgccccccggcaccaagcacgtggacatggacctggccaccctgccccccaccaccgccatggccgtgctgctgtacaacagatgggccatcagaaccatcgtgcagagcagcttccccgtgaagcaggccaagcccggccccccccagctgagcgtgatgaaccagatgcagcaggagaaggagctgaccgagaacatcctgaaggtgctgaaggagcaggccgccgacagcatcctggtgctggaggccgccctgaagctgaacaaggacctgtacgtgcacaccatgagaaccctggacctgctggccatggagcccggcatggtgaacggcgagaccgagagcagcaccgccggcctgaaggtgaagaccgaggagatgcagtgccaggtgtgctacgacctgggcgccgcctacttccagcagggcagcaccaacagcgccgtgtacgagaacgccagagagaagttcttcagaaccaaggagctgatcgccgagatcggcagcctgagcctgcactgcaccatcgacgagaagagactggccggctactgccaggcctgcgacgtgctggtgcccagcagcgacagcaccagccagcagctgaccccctacagccaggtgcacatctgcctgagaagcggcaactaccaggaggtgatccagatcttcatcgaggacaacctgaccctgagcctgcccgtgcagttcagacagagcgtgctgagagagctgttcaagaaggcccagcagggcaacgaggccctggacgagatctgcttcaaggtgtgcgcctgcaacaccgtgagagacatcctggagggcagaaccatcagcgtgcagttcaaccagctgttcctgagacccaacaaggagaagatcgacttcctgctggaggtgtgcagcagaagcgtgaacctggagaaggccagcgagagcctgaagggcaacatggccgccttcctgaagaacgtgtgcctgggcctggaggacctgcagtacgtgttcatgatcagcagccacgagctgttcatcaccctgctgaaggacgaggagagaaagctgctggtggaccagatgagaaagagaagccccagagtgaacctgtgcatcaagcccgtgaccagcttctacgacatccccgccagcgccagcgtgaacatcggccagctggagcaccagctgatcctgagcgtggacccctggagaatcagacagatcctgatcgagctgcacggcatgaccagcgagagacagttctggaccgtgagcaacaagtgggaggtgcccagcgtgtacagcggcgtgatcctgggcatcaaggacaacctgaccagagacctggtgtacatcctgatggccaagggcctgcactgcagcaccgtgaaggacttcagccacgccaagcagctgttcgccgcctgcctggagctggtgaccgagttcagccccaagctgagacaggtgatgctgaacgagatgctgctgctggacatccacacccacgaggccggcaccggccaggccggcgagagaccccccagcgacctgatcagcagagtgagaggctacctggagatgagactgcccgacatccccctgagacaggtgatcgccgaggagtgcgtggccttcatgctgaactggagagagaacgagtacctgaccctgcaggtgcccgccttcctgctgcagagcaacccctacgtgaagctgggccagctgctggccgccacctgcaaggagctgcccggccccaaggagagcagaagaaccgccaaggacctgtgggaggtggtggtgcagatctgcagcgtgagcagccagcacaagagaggcaacgacggcagagtgagcctgatcaagcagagagagagcaccctgggcatcatgtacagaagcgagctgctgagcttcatcaagaagctgagagagcccctggtgctgaccatcatcctgagcctgttcgtgaagctgcacaacgtgagagaggacatcgtgaacgacatcaccgccgagcacatcagcatctggcccagcagcatccccaacctgcagagcgtggacttcgaggccgtggccatcaccgtgaaggagctggtgagatacaccctgagcatcaaccccaacaaccacagctggctgatcatccaggccgacatctacttcgccaccaaccagtacagcgccgccctgcactactacctgcaggccggcgccgtgtgcagcgacttcttcaacaaggccgtgccccccgacgtgtacaccgaccaggtggccatcctgtgccagttcctgagagagatcgactacaagaccgccttcaagagcctgcaggagcagaacagccacgacgccatggacagctactacgactacatctgggacgtgaccatcctggagtacctgacctacctgcaccacaagagaggcgagaccgacaagagacagatcgccatcaaggccatcggccagaccgagctgaacgccagcaaccccgaggaggtgctgcagctggccgcccagagaagaaagaagaagttcctgcaggccatggccaagctgtacttctag

SEQ ID NO: 8444 - DNA, 2988 bp, Artificial Sequence
  Description of Artificial Sequence: Synthetic coding sequence
atgagcgccgaggccgccgacagagaggccgccaccagcagcagaccctgcacccccccccagacctgctggttcgagttcctgctggaggagagcctgctggagaagcacctgagaaagccctgccccgaccccgcccccgtgcagctgatcgtgcagttcctggagcaggccagcaagcccagcgtgaacgagcagaaccaggtgcagcccccccccgacaacaagagaaacagaatcctgaagctgctggccctgaaggtggccgcccacctgaagtgggacctggacatcctggagaagagcctgagcgtgcccgtgctgaacatgctgctgaacgagctgctgtgcatcagcaaggtgccccccggcaccaagcacgtggacatggacctggccaccctgccccccaccaccgccatggccgtgctgctgtacaacagatgggccatcagaaccatcgtgcagagcagcttccccgtgaagcaggccaagcccggccccccccagctgagcgtgatgaaccagatgcagcaggagaaggagctgaccgagaacatcctgaaggtgctgaaggagcaggccgccgacagcatcctggtgctggaggccgccctgaagctgaacaaggacctgtacgtgcacaccatgagaaccctggacctgctggccatggagcccggcatggtgaacggcgagaccgagagcagcaccgccggcctgaaggtgaagaccgaggagatgcagtgccaggtgtgctacgacctgggcgccgcctacttccagcagggcagcaccaacagcgccgtgtacgagaacgccagagagaagttcttcagaaccaaggagctgatcgccgagatcggcagcctgagcctgcactgcaccatcgacgagaagagactggccggctactgccaggcctgcgacgtgctggtgcccagcagcgacagcaccagccagcagctgaccccctacagccaggtgcacatctgcctgagaagcggcaactaccaggaggtgatccagatcttcatcgaggacaacctgaccctgagcctgcccgtgcagttcagacagagcgtgctgagagagctgttcaagaaggcccagcagggcaacgaggccctggacgagatctgcttcaaggtgtgcgcctgcaacaccgtgagagacatcctggagggcagaaccatcagcgtgcagttcaaccagctgttcctgagacccaacaaggagaagatcgacttcctgctggaggtgtgcagcagaagcgtgaacctggagaaggccagcgagagcctgaagggcaacatggccgccttcctgaagaacgtgtgcctgggcctggaggacctgcagtacgtgttcatgatcagcagccacgagctgttcatcaccctgctgaaggacgaggagagaaagctgctggtggaccagatgagaaagagaagccccagagtgaacctgtgcatcaagcccgtgaccagcttctacgacatccccgccagcgccagcgtgaacatcggccagctggagcaccagctgatcctgagcgtggacccctggagaatcagacagatcctgatcgagctgcacggcatgaccagcgagagacagttctggaccgtgagcaacaagtgggaggtgcccagcgtgtacagcggcgtgatcctgggcatcaaggacaacctgaccagagacctggtgtacatcctgatggccaagggcctgcactgcagcaccgtgaaggacttcagccacgccaagcagctgttcgccgcctgcctggagctggtgaccgagttcagccccaagctgagacaggtgatgctgaacgagatgctgctgctggacatccacacccacgaggccggcaccggccaggccggcgagagaccccccagcgacctgatcagcagagtgagaggctacctggagatgagactgcccgacatccccctgagacaggtgatcgccgaggagtgcgtggccttcatgctgaactggagagagaacgagtacctgaccctgcaggtgcccgccttcctgctgcagagcaacccctacgtgaagctgggccagctgctggccgccacctgcaaggagctgcccggccccaaggagagcagaagaaccgccaaggacctgtgggaggtggtggtgcagatctgcagcgtgagcagccagcacaagagaggcaacgacggcagagtgagcctgatcaagcagagagagagcaccctgggcatcatgtacagaagcgagctgctgagcttcatcaagaagctgagagagcccctggtgctgaccatcatcctgagcctgttcgtgaagctgcacaacgtgagagaggacatcgtgaacgacatcaccgccgagcacatcagcatctggcccagcagcatccccaacctgcagagcgtggacttcgaggccgtggccatcaccgtgaaggagctggtgagatacaccctgagcatcaaccccaacaaccacagctggctgatcatccaggccgacatctacttcgccaccaaccagtacagcgccgccctgcactactacctgcaggccggcgccgtgtgcagcgacttcttcaacaaggccgtgccccccgacgtgtacaccgaccaggtgatcaagagaatgatcaagtgctgcagcctgctgaactgccacacccaggtggccatcctgtgccagttcctgagagagatcgactacaagaccgccttcaagagcctgcaggagcagaacagccacgacgccatggacagctactacgactacatctgggacgtgaccatcctggagtacctgacctacctgcaccacaagagaggcgagaccgacaagagacagatcgccatcaaggccatcggccagaccgagctgaacgccagcaaccccgaggaggtgctgcagctggccgcccagagaagaaagaagaagttcctgcaggccatggccaagctgtacttctag

SEQ ID NO: 8445 - DNA, 1659 bp, Artificial Sequence
  Description of Artificial Sequence: Synthetic coding sequence
atgatggccctgccctacatcaccgagcacaccggcttcaccggcaccgtgtacgccaccgagcccaccgtgcagatcggcagactgctgatggaggagctggtgaacttcatcgagagagtgcccaaggcccagagcgccagcctgtggaagaacaaggacatccagagactgctgcccagccccctgaaggacgccgtggaggtgagcacctggagaagatgctacaccatgcaggaggtgaacagcgccctgagcaagatccagctggtgggctacagccagaagatcgagctgttcggcgccgtgcaggtgacccccctgagcagcggctacgccctgggcagcagcaactggatcatccagagccactacgagaaggtgagctacgtgagcggcagcagcctgctgaccacccacccccagcccatggaccaggccagcctgaagaacagcgacgtgctggtgctgaccggcctgacccagatccccaccgccaaccccgacggcatggtgggcgagttctgcagcaacctggccctgaccgtgagaaacggcggcaacgtgctggtgccctgctaccccagcggcgtgatctacgacctgctggagtgcctgtaccagtacatcgacagcgccggcctgagcagcgtgcccctgtacttcatcagccccgtggccaacagcagcctggagttcagccagatcttcgccgagtggctgtgccacaacaagcagagcaaggtgtacctgcccgagccccccttcccccacgccgagctgatccagaccaacaagctgaagcactaccccagcatccacggcgacttcagcaacgacttcagacagccctgcgtggtgttcaccggccaccccagcctgagattcggcgacgtggtgcacttcatggagctgtggggcaagagcagcctgaacaccgtgatcttcaccgagcccgacttcagctacctggaggccctggccccctaccagcccctggccatgaagtgcatctactgccccatcgacaccagactgaacttcatccaggtgagcaagctgctgaaggaggtgcagcccctgcacgtggtgtgccccgagcagtacacccagcccccccccgcccagagccacagaatggacctgatgatcgactgccagccccccgccatgagctacagaagagccgaggtgctggccctgcccttcaagagaagatacgagaagatcgagatcatgcccgagctggccgacagcctggtgcccatggagatcaagcccggcatcagcctggccaccgtgagcgccgtgctgcacaccaaggacaacaagcacctgctgcagcccccccccagacccgcccagcccaccagcggcaagaagagaaagagagtgagcgacgacgtgcccgactgcaaggtgctgaagcccctgctgagcggcagcatccccgtggagcagttcgtgcagaccctggagaagcacggcttcagcgacatcaaggtggaggacaccgccaagggccacatcgtgctgctgcaggaggccgagaccctgatccagatcgaggaggacagcacccacatcatctgcgacaacgacgagatgctgagagtgagactgagagacctggtgctgaagttcctgcagaagttctag

SEQ ID NO: 8446 - DNA, 1977 bp, Artificial Sequence
  Description of Artificial Sequence: Synthetic coding sequence
atgaagctgtactgcctgagcggccaccccaccctgccctgcaacgtgctgaagttcaagagcaccaccatcatgctggactgcggcctggacatgaccagcaccctgaacttcctgcccctgcccctggtgcagagccccagactgagcaacctgcccggctggagcctgaaggacggcaacgccttcctggacaaggagctgaaggagtgcagcggccacgtgttcgtggacagcgtgcccgagttctgcctgcccgagaccgagctgatcgacctgagcaccgtggacgtgatcctgatcagcaactaccactgcatgatggccctgccctacatcaccgagcacaccggcttcaccggcaccgtgtacgccaccgagcccaccgtgcagatcggcagactgctgatggaggagctggtgaacttcatcgagagagtgcccaaggcccagagcgccagcctgtggaagaacaaggacatccagagactgctgcccagccccctgaaggacgccgtggaggtgagcacctggagaagatgctacaccatgcaggaggtgaacagcgccctgagcaagatccagctggtgggctacagccagaagatcgagctgttcggcgccgtgcaggtgacccccctgagcagcggctacgccctgggcagcagcaactggatcatccagagccactacgagaaggtgagctacgtgagcggcagcagcctgctgaccacccacccccagcccatggaccaggccagcctgaagaacagcgacgtgctggtgctgaccggcctgacccagatccccaccgccaaccccgacggcatggtgggcgagttctgcagcaacctggccctgaccgtgagaaacggcggcaacgtgctggtgccctgctaccccagcggcgtgatctacgacctgctggagtgcctgtaccagtacatcgacagcgccggcctgagcagcgtgcccctgtacttcatcagccccgtggccaacagcagcctggagttcagccagatcttcgccgagtggctgtgccacaacaagcagagcaaggtgtacctgcccgagccccccttcccccacgccgagctgatccagaccaacaagctgaagcactaccccagcatccacggcgacttcagcaacgacttcagacagccctgcgtggtgttcaccggccaccccagcctgagattcggcgacgtggtgcacttcatggagctgtggggcaagagcagcctgaacaccgtgatcttcaccgagcccgacttcagctacctggaggccctggccccctaccagcccctggccatgaagtgcatctactgccccatcgacaccagactgaacttcatccaggtgagcaagctgctgaaggaggtgcagcccctgcacgtggtgtgccccgagcagtacacccagcccccccccgcccagagccacagaatggacctgatgatcgactgccagccccccgccatgagctacagaagagccgaggtgctggccctgcccttcaagagaagatacgagaagatcgagatcatgcccgagctggccgacagcctggtgcccatggagatcaagcccggcatcagcctggccaccgtgagcgccgtgctgcacaccaaggacaacaagcacctgctgcagcccccccccagacccgcccagcccaccagcggcaagaagagaaagagagtgagcgacgacgtgcccgactgcaaggtgctgaagcccctgctgagcggcagcatccccgtggagcagttcgtgcagaccctggagaagcacggcttcagcgacatcaaggtggaggacaccgccaagggccacatcgtgctgctgcaggaggccgagaccctgatccagatcgaggaggacagcacccacatcatctgcgacaacgacgagatgctgagagtgagactgagagacctggtgctgaagttcctgcagaagttctag

SEQ ID NO: 8447 - DNA, 1509 bp, Artificial Sequence
  Description of Artificial Sequence: Synthetic coding sequence
aagatctactgcctgagcggccaccccaccctgccctgcaacgtgctgaagttcaagagcacctggagaagatgctacaccatgcaggaggtgaacagcgccctgagcaagatccagctggtgggctacagccagaagatcgagctgttcggcgccgtgcaggtgacccccctgagcagcggctacgccctgggcagcagcaactggatcatccagagccactacgagaaggtgagctacgtgagcggcagcagcctgctgaccacccacccccagcccatggaccaggccagcctgaagaacagcgacgtgctggtgctgaccggcctgacccagatccccaccgccaaccccgacggcatggtgggcgagttctgcagcaacctggccctgaccgtgagaaacggcggcaacgtgctggtgccctgctaccccagcggcgtgatctacgacctgctggagtgcctgtaccagtacatcgacagcgccggcctgagcagcgtgcccctgtacttcatcagccccgtggccaacagcagcctggagttcagccagatcttcgccgagtggctgtgccacaacaagcagagcaaggtgtacctgcccgagccccccttcccccacgccgagctgatccagaccaacaagctgaagcactaccccagcatccacggcgacttcagcaacgacttcagacagccctgcgtggtgttcaccggccaccccagcctgagattcggcgacgtggtgcacttcatggagctgtggggcaagagcagcctgaacaccgtgatcttcaccgagcccgacttcagctacctggaggccctggccccctaccagcccctggccatgaagtgcatctactgccccatcgacaccagactgaacttcatccaggtgagcaagctgctgaaggaggtgcagcccctgcacgtggtgtgccccgagcagtacacccagcccccccccgcccagagccacagaatggacctgatgatcgactgccagccccccgccatgagctacagaagagccgaggtgctggccctgcccttcaagagaagatacgagaagatcgagatcatgcccgagctggccgacagcctggtgcccatggagatcaagcccggcatcagcctggccaccgtgagcgccgtgctgcacaccaaggacaacaagcacctgctgcagcccccccccagacccgcccagcccaccagcggcaagaagagaaagagagtgagcgacgacgtgcccgactgcaaggtgctgaagcccctgctgagcggcagcatccccgtggagcagttcgtgcagaccctggagaagcacggcttcagcgacatcaaggtggaggacaccgccaagggccacatcgtgctgctgcaggaggccgagaccctgatccagatcgaggaggacagcacccacatcatctgcgacaacgacgagatgctgagagtgagactgagagacctggtgctgaagttcctgcagaagttctag

SEQ ID NO: 8448 - DNA, 1914 bp, Artificial Sequence
  Description of Artificial Sequence: Synthetic coding sequence
atgaagctgtactgcctgagcggccaccccaccctgccctgcaacgtgctgaagttcaagagcaccaccatcatgctggactgcggcctggacatgaccagcaccctgaacttcctgcccctgcccctggtgcagagccccagactgagcaacctgcccggctggagcctgaaggacggcaacgccttcctggacaagaccgagctgatcgacctgagcaccgtggacgtgatcctgatcagcaactaccactgcatgatggccctgccctacatcaccgagcacaccggcttcaccggcaccgtgtacgccaccgagcccaccgtgcagatcggcagactgctgatggaggagctggtgaacttcatcgagagagtgcccaaggcccagagcgccagcctgtggaagaacaaggacatccagagactgctgcccagccccctgaaggacgccgtggaggtgagcacctggagaagatgctacaccatgcaggaggtgaacagcgccctgagcaagatccagctggtgggctacagccagaagatcgagctgttcggcgccgtgcaggtgacccccctgagcagcggctacgccctgggcagcagcaactggatcatccagagccactacgagaaggtgagctacgtgagcggcagcagcctgctgaccacccacccccagcccatggaccaggccagcctgaagaacagcgacgtgctggtgctgaccggcctgacccagatccccaccgccaaccccgacggcatggtgggcgagttctgcagcaacctggccctgaccgtgagaaacggcggcaacgtgctggtgccctgctaccccagcggcgtgatctacgacctgctggagtgcctgtaccagtacatcgacagcgccggcctgagcagcgtgcccctgtacttcatcagccccgtggccaacagcagcctggagttcagccagatcttcgccgagtggctgtgccacaacaagcagagcaaggtgtacctgcccgagccccccttcccccacgccgagctgatccagaccaacaagctgaagcactaccccagcatccacggcgacttcagcaacgacttcagacagccctgcgtggtgttcaccggccaccccagcctgagattcggcgacgtggtgcacttcatggagctgtggggcaagagcagcctgaacaccgtgatcttcaccgagcccgacttcagctacctggaggccctggccccctaccagcccctggccatgaagtgcatctactgccccatcgacaccagactgaacttcatccaggtgagcaagctgctgaaggaggtgcagcccctgcacgtggtgtgccccgagcagtacacccagcccccccccgcccagagccacagaatggacctgatgatcgactgccagccccccgccatgagctacagaagagccgaggtgctggccctgcccttcaagagaagatacgagaagatcgagatcatgcccgagctggccgacagcctggtgcccatggagatcaagcccggcatcagcctggccaccgtgagcgccgtgctgcacaccaaggacaacaagcacctgctgcagcccccccccagacccgcccagcccaccagcggcaagaagagaaagagagtgagcgacgacgtgcccgactgcaaggtgctgaagcccctgctgagcggcagcatccccgtggagcagttcgtgcagaccctggagaagcacggcttcagcgacatcaaggtggaggacaccgccaagggccacatcgtgctgctgcaggaggccgagaccctgatccagatcgaggaggacagcacccacatcatctgcgacaacgacgagatgctgagagtgagactgagagacctggtgctgaagttcctgcagaagttctag

SEQ ID NO: 8449 - DNA, 1905 bp, Artificial Sequence
  Description of Artificial Sequence: Synthetic coding sequence
atgctggactgcggcctggacatgaccagcaccctgaacttcctgcccctgcccctggtgcagagccccagactgagcaacctgcccggctggagcctgaaggacggcaacgccttcctggacaaggagctgaaggagtgcagcggccacgtgttcgtggacagcgtgcccgagttctgcctgcccgagaccgagctgatcgacctgagcaccgtggacgtgatcctgatcagcaactaccactgcatgatggccctgccctacatcaccgagcacaccggcttcaccggcaccgtgtacgccaccgagcccaccgtgcagatcggcagactgctgatggaggagctggtgaacttcatcgagagagtgcccaaggcccagagcgccagcctgtggaagaacaaggacatccagagactgctgcccagccccctgaaggacgccgtggaggtgagcacctggagaagatgctacaccatgcaggaggtgaacagcgccctgagcaagatccagctggtgggctacagccagaagatcgagctgttcggcgccgtgcaggtgacccccctgagcagcggctacgccctgggcagcagcaactggatcatccagagccactacgagaaggtgagctacgtgagcggcagcagcctgctgaccacccacccccagcccatggaccaggccagcctgaagaacagcgacgtgctggtgctgaccggcctgacccagatccccaccgccaaccccgacggcatggtgggcgagttctgcagcaacctggccctgaccgtgagaaacggcggcaacgtgctggtgccctgctaccccagcggcgtgatctacgacctgctggagtgcctgtaccagtacatcgacagcgccggcctgagcagcgtgcccctgtacttcatcagccccgtggccaacagcagcctggagttcagccagatcttcgccgagtggctgtgccacaacaagcagagcaaggtgtacctgcccgagccccccttcccccacgccgagctgatccagaccaacaagctgaagcactaccccagcatccacggcgacttcagcaacgacttcagacagccctgcgtggtgttcaccggccaccccagcctgagattcggcgacgtggtgcacttcatggagctgtggggcaagagcagcctgaacaccgtgatcttcaccgagcccgacttcagctacctggaggccctggccccctaccagcccctggccatgaagtgcatctactgccccatcgacaccagactgaacttcatccaggtgagcaagctgctgaaggaggtgcagcccctgcacgtggtgtgccccgagcagtacacccagcccccccccgcccagagccacagaatggacctgatgatcgactgccagccccccgccatgagctacagaagagccgaggtgctggccctgcccttcaagagaagatacgagaagatcgagatcatgcccgagctggccgacagcctggtgcccatggagatcaagcccggcatcagcctggccaccgtgagcgccgtgctgcacaccaaggacaacaagcacctgctgcagcccccccccagacccgcccagcccaccagcggcaagaagagaaagagagtgagcgacgacgtgcccgactgcaaggtgctgaagcccctgctgagcggcagcatccccgtggagcagttcgtgcagaccctggagaagcacggcttcagcgacatcaaggtggaggacaccgccaagggccacatcgtgctgctgcaggaggccgagaccctgatccagatcgaggaggacagcacccacatcatctgcgacaacgacgagatgctgagagtgagactgagagacctggtgctgaagttcctgcagaagttctag

SEQ ID NO: 8450 - DNA, 1755 bp, Artificial Sequence
  Description of Artificial Sequence: Synthetic coding sequence
atggccagcgtgcaggccagcagaagacagtggtgctacctgtgcgacctgcccaagatgccctgggccatggtgtgggacttcagcgaggccgtgtgcagaggctgcgtgaacttcgagggcgccgacagaatcgagctgctgatcgacgccgccagacagctgaagagaagccacgtgctgcccgagggcagaagccccggcccccccgccctgaagcaccccgccaccaaggacctggccgccgccgccgcccagggcccccagctgccccccccccaggcccagccccagcccagcggcaccggcggcggcgtgagcggccaggacagatacgacagagccaccagcagcggcagactgcccctgcccagccccgccctggagtacaccctgggcagcagactggccaacggcctgggcagagaggaggccgtggccgagggcgccagaagagccctgctgggcagcatgcccggcctgatgccccccggcctgctggccgccgccgtgagcggcctgggcagcagaggcctgaccctggcccccggcctgagccccgccagacccctgttcggcagcgacttcgagaaggagaagcagcagagaaacgccgactgcctggccgagctgaacgaggccatgagaggcagagccgaggagtggcacggcagacccaaggccgtgagagagcagctgctggccctgagcgcctgcgcccccttcaacgtgagattcaagaaggaccacggcctggtgggcagagtgttcgccttcgacgccaccgccagaccccccggctacgagttcgagctgaagctgttcaccgagtacccctgcggcagcggcaacgtgtacgccggcgtgctggccgtggccagacagatgttccacgacgccctgagagagcccggcaaggccctggccagcagcggcttcaagtacctggagtacgagagaagacacggcagcggcgagtggagacagctgggcgagctgctgaccgacggcgtgagaagcttcagagagcccgcccccgccgaggccctgccccagcagtaccccgagcccgcccccgccgccctgtgcggccccccccccagagcccccagcagaaacctggcccccacccccagaagaagaaaggccagccccgagcccgagggcgaggccgccggcaagatgaccaccgaggagcagcagcagagacactgggtggcccccggcggcccctacagcgccgagacccccggcgtgcccagccccatcgccgccctgaagaacgtggccgaggccctgggccacagccccaaggaccccggcggcggcggcggccccgtgagagccggcggcgccagccccgccgccagcagcaccgcccagccccccacccagcacagactggtggccagaaacggcgaggccgaggtgagccccaccgccggcgccgaggccgtgagcggcggcggcagcggcaccggcgccacccccggcgcccccctgtgctgcaccctgtgcagagagagactggaggacacccacttcgtgcagtgccccagcgtgcccggccacaagttctgcttcccctgcagcagagagttcatcaaggcccagggccccgccggcgaggtgtactgccccagcggcgacaagtgccccctggtgggcagcagcgtgccctgggccttcatgcagggcgagatcgccaccatcctggccggcgacatcaaggtgaagaaggagagagacccctag

SEQ ID NO: 8451 - DNA, 1764 bp, Artificial Sequence
  Description of Artificial Sequence: Synthetic coding sequence
atggccgccgccgtggccgtggccgccgccagcagaagacagagctgctacctgtgcgacctgcccagaatgccctgggccatgatctgggacttcaccgagcccgtgtgcagaggctgcgtgaactacgagggcgccgacagagtggagttcgtgatcgagaccgccagacagctgaagagagcccacggctgcttccccgagggcagaagcccccccggcgccgccgccagcgccgccgccaagcccccccccctgagcgccaaggacatcctgctgcagcagcagcagcagctgggccacggcggccccgaggccgcccccagagccccccaggccctggagagataccccctggccgccgccgccgagagaccccccagactgggcagcgacttcggcagcagcagacccgccgccagcctggcccagccccccaccccccagcccccccccgtgaacggcatcctggtgcccaacggcttcagcaagctggaggagccccccgagctgaacagacagagccccaaccccagaagaggccacgccgtgccccccaccctggtgcccctgatgaacggcagcgccacccccctgcccaccgccctgggcctgggcggcagagccgccgccagcctggccgccgtgagcggcaccgccgccgccagcctgggcagcgcccagcccaccgacctgggcgcccacaagagacccgccagcgtgagcagcagcgccgccgtggagcacgagcagagagaggccgccgccaaggagaagcagccccccccccccgcccacagaggccccgccgacagcctgagcaccgccgccggcgccgccgagctgagcgccgagggcgccggcaagagcagaggcagcggcgagcaggactgggtgaacagacccaagaccgtgagagacaccctgctggccctgcaccagcacggccacagcggccccttcgagagcaagttcaagaaggagcccgccctgaccgccggcagactgctgggcttcgaggccaacggcgccaacggcagcaaggccgtggccagaaccgccagaaagagaaagcccagccccgagcccgagggcgaggtgggcccccccaagatcaacggcgaggcccagccctggctgagcaccagcaccgagggcctgaagatccccatgacccccaccagcagcttcgtgagcccccccccccccaccgccagcccccacagcaacagaaccaccccccccgaggccgcccagaacggccagagccccatggccgccctgatcctggtggccgacaacgccggcggcagccacgccagcaaggacgccaaccaggtgcacagcaccaccagaagaaacagcaacagcccccccagccccagcagcatgaaccagagaagactgggccccagagaggtgggcggccagggcgccggcaacaccggcggcctggagcccgtgcaccccgccagcctgcccgacagcagcctggccaccagcgcccccctgtgctgcaccctgtgccacgagagactggaggacacccacttcgtgcagtgccccagcgtgcccagccacaagttctgcttcccctgcagcagacagagcatcaagcagcagggcgccagcggcgaggtgtactgccccagcggcgagaagtgccccctggtgggcagcaacgtgccctgggccttcatgcagggcgagatcgccaccatcctggccggcgacgtgaaggtgaagaaggagagagacagctag

SEQ ID NO: 8452 - DNA, 1716 bp, Artificial Sequence
  Description of Artificial Sequence: Synthetic coding sequence
atggccgccgccgtggccgtggccgccgccagcagaagacagagctgctacctgtgcgacctgcccagaatgccctgggccatgatctgggacttcaccgagcccgtgtgcagaggctgcgtgaactacgagggcgccgacagagtggagttcgtgatcgagaccgccagacagctgaagagagcccacggctgcttccccgagggcagaagcccccccggcgccgccgccagcgccgccgccaagcccccccccctgagcgccaaggacatcctgctgcagcagcagcagcagctgggccacggcggccccgaggccgcccccagagccccccaggccctggagagataccccctggccgccgccgccgagagaccccccagactgggcagcgacttcggcagcagcagacccgccgccagcctggcccagccccccaccccccagcccccccccgtgaacggcatcctggtgcccaacggcttcagcaagctggaggagccccccgagctgaacagacagagccccaaccccagaagaggccacgccgtgccccccaccctggtgcccctgatgaacggcagcgccacccccctgcccaccgccctgggcctgggcggcagagccgccgccagcctggccgccgtgagcggcaccgccgccgccagcctgggcagcgcccagcccaccgacctgggcgcccacaagagacccgccagcgtgagcagcagcgccgccgtggagcacgagcagagagaggccgccgccaaggagaagcagccccccccccccgcccacagaggccccgccgacagcctgagcaccgccgccggcgccgccgagctgagcgccgagggcgccggcaagagcagaggcagcggcgagcaggactgggtgaacagacccaagaccgtgagagacaccctgctggccctgcaccagcacggccacagcggccccttcgagagcaagttcaagaaggagcccgccctgaccgccgtggccagaaccgccagaaagagaaagcccagccccgagcccgagggcgaggtgggcccccccaagatcaacggcgaggcccagccctggctgagcaccagcaccgagggcctgaagatccccatgacccccaccagcagcttcgtgagcccccccccccccaccgccagcccccacagcaacagaaccaccccccccgaggccgcccagaacggccagagccccatggccgccctgatcctggtggccgacaacgccggcggcagccacgccagcaaggacgccaaccaggtgcacagcaccaccagaagaaacagcaacagcccccccagccccagcagcatgaaccagagaagactgggccccagagaggtgggcggccagggcgccggcaacaccggcggcctggagcccgtgcaccccgccagcctgcccgacagcagcctggccaccagcgcccccctgtgctgcaccctgtgccacgagagactggaggacacccacttcgtgcagtgccccagcgtgcccagccacaagttctgcttcccctgcagcagacagagcatcaagcagcagggcgccagcggcgaggtgtactgccccagcggcgagaagtgccccctggtgggcagcaacgtgccctgggccttcatgcagggcgagatcgccaccatcctggccggcgacgtgaaggtgaagaaggagagagacagctag

SEQ ID NO: 8453 - DNA, 2391 bp, Artificial Sequence
  Description of Artificial Sequence: Synthetic coding sequence
atgagcgccgcccaggtgagcagcagcagaagacagagctgctacctgtgcgacctgcccagaatgccctgggccatgatctgggacttcagcgagcccgtgtgcagaggctgcgtgaactacgagggcgccgacagaatcgagttcgtgatcgagaccgccagacagctgaagagagcccacggctgcttccaggacggcagaagccccggcccccccccccccgtgggcgtgaagaccgtggccctgagcgccaaggaggccgccgccgccgccgccgccgccgccgccgccgccgccgccgcccagcagcagcagcagcagcagcagcagcagcagcagcagcagcagcagcagcagcagcagcagcagcagcagcagctgaaccacgtggacggcagcagcaagcccgccgtgctggccgcccccagcggcctggagagatacggcctgagcgccgccgccgccgccgccgccgccgccgccgccgccgtggagcagagaagcagattcgagtacccccccccccccgtgagcctgggcagcagcagccacaccgccagactgcccaacggcctgggcggccccaacggcttccccaagcccacccccgaggagggcccccccgagctgaacagacagagccccaacagcagcagcgccgccgccagcgtggccagcagaagaggcacccacggcggcctggtgaccggcctgcccaaccccggcggcggcggcggcccccagctgaccgtgccccccaacctgctgccccagaccctgctgaacggccccgccagcgccgccgtgctgccccccccccccccccacgccctgggcagcagaggcccccccacccccgccccccccggcgcccccggcggccccgcctgcctgggcggcacccccggcgtgagcgccaccagcagcagcgccagcagcagcaccagcagcagcgtggccgaggtgggcgtgggcgccggcggcaagagacccggcagcgtgagcagcaccgaccaggagagagagctgaaggagaagcagagaaacgccgaggccctggccgagctgagcgagagcctgagaaacagagccgaggagtgggccagcaagcccaagatggtgagagacaccctgctgaccctggccggctgcaccccctacgaggtgagattcaagaaggaccacagcctgctgggcagagtgttcgccttcgacgccgtgagcaagcccggcatggactacgagctgaagctgttcatcgagtaccccaccggcagcggcaacgtgtacagcagcgccagcggcgtggccaagcagatgtaccaggactgcatgaaggacttcggcagaggcctgagcagcggcttcaagtacctggagtacgagaagaagcacggcagcggcgactggagactgctgggcgacctgctgcccgaggccgtgagattcttcaaggagggcgtgcccggcgccgacatgctgccccagccctacctggacgccagctgccccatgctgcccaccgccctggtgagcctgagcagagcccccagcgccccccccggcaccggcgccctgccccccgccgcccccagcggcagaggcgccgccgccagcctgagaaagagaaaggccagccccgagccccccgacagcgccgagggcgccctgaagctgggcgaggagcagcagagacagcagtggatggccaaccagagcgaggccctgaagctgaccatgagcgccggcggcttcgccgcccccggccacgccgccggcggccccccccccccccccccccccctgggcccccacagcaacagaaccaccccccccgagagcgccccccagaacggccccagccccatggccgccctgatgagcgtggccgacaccctgggcaccgcccacagccccaaggacggcagcagcgtgcacagcaccaccgccagcgccagaagaaacagcagcagccccgtgagccccgccagcgtgcccggccagagaagactggccagcagaaacggcgacctgaacctgcaggtggccccccccccccccagcgcccaccccggcatggaccaggtgcacccccagaacatccccgacagccccatggccaacagcggccccctgtgctgcaccatctgccacgagagactggaggacacccacttcgtgcagtgccccagcgtgcccagccacaagttctgcttcccctgcagcagagagagcatcaaggcccagggcgccaccggcgaggtgtactgccccagcggcgagaagtgccccctggtgggcagcaacgtgccctgggccttcatgcagggcgagatcgccaccatcctggccggcgacgtgaaggtgaagaaggagagagacccctag

SEQ ID NO: 8454 - DNA, 1341 bp, Artificial Sequence
  Description of Artificial Sequence: Synthetic coding sequence
atgagcttcccccacttcggccacccctacagaggcgccagccagttcctggccagcgccagcagcagcaccacctgctgcgagagcacccagagaagcgtgagcgacgtggccagcggcagcacccccgcccccgccctgtgctgcgccccctacgacagcagactgctgggcagcgccagacccgagctgggcgccgccctgggcatctacggcgccccctacgccgccgccgccgccgcccagagctaccccggctacctgccctacagccccgagccccccagcctgtacggcgccctgaacccccagtacgagttcaaggaggccgccggcagcttcaccagcagcctggcccagcccggcgcctactacccctacgagagaaccctgggccagtaccagtacgagagatacggcgccgtggagctgagcggcgccggcagaagaaagaacgccaccagagagaccaccagcaccctgaaggcctggctgaacgagcacagaaagaacccctaccccaccaagggcgagaagatcatgctggccatcatcaccaagatgaccctgacccaggtgagcacctggttcgccaacgccagaagaagactgaagaaggagaacaagatgacctgggcccccaagaacaagggcggcgaggagagaaaggccgagggcggcgaggaggacagcctgggctgcctgaccgccgacaccaaggaggtgaccgccagccaggaggccagaggcctgagactgagcgacctggaggacctggaggaggaggaggaggaggaggaggaggccgaggacgaggaggtggtggccaccgccggcgacagactgaccgagttcagaaagggcgcccagagcctgcccggcccctgcgccgccgccagagagggcagactggagagaagagagtgcggcctggccgcccccagattcagcttcaacgaccccagcggcagcgaggaggccgacttcctgagcgccgagaccggcagccccagactgaccatgcactacccctgcctggagaagcccagaatctggagcctggcccacaccgccaccgccagcgccgtggagggcgccccccccgccagacccagacccagaagccccgagtgcagaatgatccccggccagccccccgccagcgccagaagactgagcgtgcccagagacagcgcctgcgacgagagcagctgcatccccaaggccttcggcaaccccaagttcgccctgcagggcctgcccctgaactgcgccccctgccccagaagaagcgagcccgtggtgcagtgccagtaccccagcggcgccgaggccggctag

SEQ ID NO: 8455 - DNA, 1080 bp, Artificial Sequence
  Description of Artificial Sequence: Synthetic coding sequence
atggtggacatcatcttccactaccccttcctgggcgccatgggcgaccacagcaagaagaagcccggcaccgccatgtgcgtgggctgcggcagccagatccacgaccagttcatcctgagagtgagccccgacctggagtggcacgccgcctgcctgaagtgcgccgagtgcagccagtacctggacgagacctgcacctgcttcgtgagagacggcaagacctactgcaagagagactacgtgagactgttcggcatcaagtgcgccaagtgccaggtgggcttcagcagcagcgacctggtgatgagagccagagacagcgtgtaccacatcgagtgcttcagatgcagcgtgtgcagcagacagctgctgcccggcgacgagttcagcctgagagagcacgagctgctgtgcagagccgaccacggcctgctgctggagagagccgccgccggcagccccagaagccccggccccctgcccggcgccagaggcctgcacctgcccgacgccggcagcggcagacagcccgccctgagaccccacgtgcacaagcagaccgagaagaccaccagagtgagaaccgtgctgaacgagaagcagctgcacaccctgagaacctgctacgccgccaaccccagacccgacgccctgatgaaggagcagctggtggagatgaccggcctgagccccagagtgatcagagtgtggttccagaacaagagatgcaaggacaagaagaagagcatcctgatgaagcagctgcagcagcagcagcacagcgacaagaccagcctgcagggcctgaccggcacccccctggtggccggcagccccatcagacacgagaacgccgtgcagggcagcgccgtggaggtgcagacctaccagcccccctggaaggccctgagcgagttcgccctgcagagcgacctggaccagcccgccttccagcagctggtgagcttcagcgagagcggcagcctgggcaacagcagcggcagcgacgtgaccagcctgagcagccagctgcccgacacccccaacagcatggtgcccagccccgtggagacctag

SEQ ID NO: 8456 - DNA, 2460 bp, Artificial Sequence
  Description of Artificial Sequence: Synthetic coding sequence
atggacagcgagtactacagcggcgaccagagcgacgacggcggcgccacccccgtgcaggacgagagagacagcggcagcgacggcgaggacgacgtgaacgagcagcacagcggcagcgacaccggcagcgtggagagacacagcgagaacgagaccagcgacagagaggacggcctgcccaagggccaccacgtgaccgacagcgagaacgacgagcccctgaacctgaacgccagcgacagcgagagcgaggagctgcacagacagaaggacagcgacagcgagagcgaggagagagccgagccccccgccagcgacagcgagaacgaggacgtgaaccagcacggcagcgacagcgagagcgaggagaccagaaagctgcccggcagcgacagcgagaacgaggagctgctgaacggccacgccagcgacagcgagaacgaggacgtgggcaagcaccccgccagcgacagcgagatcgaggagctgcagaagagccccgccagcgacagcgagaccgaggacgccctgaagccccagatcagcgacagcgagagcgaggagccccccagacaccaggccagcgacagcgagaacgaggagccccccaagcccagaatgagcgacagcgagagcgaggagctgcccaagccccaggtgagcgacagcgagagcgaggagccccccagacaccaggccagcgacagcgagaacgaggagctgcccaagcccagaatcagcgacagcgagagcgaggacccccccagacaccaggccagcgacagcgagaacgaggagctgcccaagcccagaatcagcgacagcgagagcgaggacccccccagaaaccaggccagcgacagcgagaacgaggagctgcccaagcccagagtgagcgacagcgagagcgagggcccccagaagggccccgccagcgacagcgagaccgaggacgccagcagacacaagcagaagcccgagagcgacgacgacagcgacagagagaacaagggcgaggacaccgagatgcagaacgacagcttccacagcgacagccacatggacagaaagaagttccacagcagcgacagcgaggaggaggagcacaagaagcagaagatggacagcgacgaggacgagaaggagggcgaggaggagaaggtggccaagagaaaggccgccgtgctgagcgacagcgaggacgaggagaaggccagcgccaagaagagcagagtggtgagcgacgccgacgacagcgacagcgacgccgtgagcgacaagagcggcaagagagagaagaccatcgccagcgacagcgaggaggaggccggcaaggagctgagcgacaagaagaacgaggagaaggacctgttcggcagcgacagcgagagcggcaacgaggaggagaacctgatcgccgacatcttcggcgagagcggcgacgaggaggaggaggagttcaccggcttcaaccaggaggacctggaggaggagaagggcgagacccaggtgaaggaggccgaggacagcgacagcgacgacaacatcaagagaggcaagcacatggacttcctgagcgacttcgagatgatgctgcagagaaagaagagcatgagcggcaagagaagaagaaacagagacggcggcaccttcatcagcgacgccgacgacgtggtgagcgccatgatcgtgaagatgaacgaggccgccgaggaggacagacagctgaacaaccagaagaagcccgccctgaagaagctgaccctgctgcccgccgtggtgatgcacctgaagaagcaggacctgaaggagaccttcatcgacagcggcgtgatgagcgccatcaaggagtggctgagccccctgcccgacagaagcctgcccgccctgaagatcagagaggagctgctgaagatcctgcaggagctgcccagcgtgagccaggagaccctgaagcacagcggcatcggcagagccgtgatgtacctgtacaagcaccccaaggagagcagaagcaacaaggacatggccggcaagctgatcaacgagtggagcagacccatcttcggcctgaccagcaactacaagggcatgaccagagaggagagagagcagagagacctggagcagatgccccagagaagaagaatgaacagcaccggcggccagacccccagaagagacctggagaaggtgctgaccggcgaggagaaggccctgagacccggcgaccccggcttctgcgccagagccagagtgcccatgcccagcaacaaggactacgtggtgagacccaagtggaacgtggagatggagagcagcagattccaggccaccagcaagaagggcatcagcagactggacaagcagatgagaaagttcaccgacatcagaaagaagagcagaagcgcccacgccgtgaagatcagcatcgagggcaacaagatgcccctgtag

SEQ ID NO: 8457 - DNA, 2319 bp, Artificial Sequence
  Description of Artificial Sequence: Synthetic coding sequence
atggacagcgagtactacagcggcgaccagagcgacgacggcggcgccacccccgtgcaggacgagagagacagcggcagcgacggcgaggacgacgtgaacgagcagcacagcggcagcgacaccggcagcgtggagagacacagcgagaacgagaccagcgacagagaggacggcctgcccaagggccaccacgtgaccgacagcgagaacgacagcgagagcgaggagaccagaaagctgcccggcagcgacagcgagaacgaggagctgctgaacggccacgccagcgacagcgagaacgaggacgtgggcaagcaccccgccagcgacagcgagatcgaggagctgcagaagagccccgccagcgacagcgagaccgaggacgccctgaagccccagatcagcgacagcgagagcgaggagccccccagacaccaggccagcgacagcgagaacgaggagccccccaagcccagaatgagcgacagcgagagcgaggagctgcccaagccccaggtgagcgacagcgagagcgaggagccccccagacaccaggccagcgacagcgagaacgaggagctgcccaagcccagaatcagcgacagcgagagcgaggacccccccagacaccaggccagcgacagcgagaacgaggagctgcccaagcccagaatcagcgacagcgagagcgaggacccccccagaaaccaggccagcgacagcgagaacgaggagctgcccaagcccagagtgagcgacagcgagagcgagggcccccagaagggccccgccagcgacagcgagaccgaggacgccagcagacacaagcagaagcccgagagcgacgacgacagcgacagagagaacaagggcgaggacaccgagatgcagaacgacagcttccacagcgacagccacatggacagaaagaagttccacagcagcgacagcgaggaggaggagcacaagaagcagaagatggacagcgacgaggacgagaaggagggcgaggaggagaaggtggccaagagaaaggccgccgtgctgagcgacagcgaggacgaggagaaggccagcgccaagaagagcagagtggtgagcgacgccgacgacagcgacagcgacgccgtgagcgacaagagcggcaagagagagaagaccatcgccagcgacagcgaggaggaggccggcaaggagctgagcgacaagaagaacgaggagaaggacctgttcggcagcgacagcgagagcggcaacgaggaggagaacctgatcgccgacatcttcggcgagagcggcgacgaggaggaggaggagttcaccggcttcaaccaggaggacctggaggaggagaagggcgagacccaggtgaaggaggccgaggacagcgacagcgacgacaacatcaagagaggcaagcacatggacttcctgagcgacttcgagatgatgctgcagagaaagaagagcatgagcggcaagagaagaagaaacagagacggcggcaccttcatcagcgacgccgacgacgtggtgagcgccatgatcgtgaagatgaacgaggccgccgaggaggacagacagctgaacaaccagaagaagcccgccctgaagaagctgaccctgctgcccgccgtggtgatgcacctgaagaagcaggacctgaaggagaccttcatcgacagcggcgtgatgagcgccatcaaggagtggctgagccccctgcccgacagaagcctgcccgccctgaagatcagagaggagctgctgaagatcctgcaggagctgcccagcgtgagccaggagaccctgaagcacagcggcatcggcagagccgtgatgtacctgtacaagcaccccaaggagagcagaagcaacaaggacatggccggcaagctgatcaacgagtggagcagacccatcttcggcctgaccagcaactacaagggcatgaccagagaggagagagagcagagagacctggagcagatgccccagagaagaagaatgaacagcaccggcggccagacccccagaagagacctggagaaggtgctgaccggcgaggagaaggccctgagacccggcgaccccggcttctgcgccagagccagagtgcccatgcccagcaacaaggactacgtggtgagacccaagtggaacgtggagatggagagcagcagattccaggccaccagcaagaagggcatcagcagactggacaagcagatgagaaagttcaccgacatcagaaagaagagcagaagcgcccacgccgtgaagatcagcatcgagggcaacaagatgcccctgtag

SEQ ID NO: 8458 - DNA, 1512 bp, Artificial Sequence
  Description of Artificial Sequence: Synthetic coding sequence
atgcccgccagaccccccgcctgcagagtgagacccttcccccccggcctgcccgacgacggcggcgccacccccgtgcaggacgagagagacagcggcagcgacggcgaggacgacgtgaacgagcagcacagcggcagcgacaccggcagcgtggagagacacagcgagaacgagaccagcgacagagaggacggcctgcccaagggccaccacgtgaccgacagcgagaacgacgagcccctgaacctgaacgccagcgacagcgagagcgaggagctgcacagacagaaggacagcgacagcgagagcgaggagagagccgagccccccgccagcgacagcgagaacgaggacgtgaaccagcacggcagcgacagcgagagcgaggagaccagaaagctgcccggcagcgacagcgagaacgaggagctgctgaacggccacgccagcgacagcgagaacgaggacgtgggcaagcaccccgccagcgacagcgagatcgaggagctgcagaagagccccgccagcgacagcgagaccgaggacgccctgaagccccagatcagcgacagcgagagcgaggagccccccagacaccaggccagcgacagcgagaacgaggagccccccaagcccagaatgagcgacagcgagagcgaggagctgcccaagccccaggtgagcgacagcgagagcgaggagccccccagacaccaggccagcgacagcgagaacgaggagctgcccaagcccagaatcagcgacagcgagagcgaggacccccccagacaccaggccagcgacagcgagaacgaggagctgcccaagcccagaatcagcgacagcgagagcgaggacccccccagaaaccaggccagcgacagcgagaacgaggagctgcccaagcccagagtgagcgacagcgagagcgagggcccccagaagggccccgccagcgacagcgagaccgaggacgccagcagacacaagcagaagcccgagagcgacgacgacagcgacagagagaacaagggcgaggacaccgagatgcagaacgacagcttccacagcgacagccacatggacagaaagaagttccacagcagcgacagcgaggaggaggagcacaagaagcagaagatggacagcgacgaggacgagaaggagggcgaggaggagaaggtggccaagagaaaggccgccgtgctgagcgacagcgaggacgaggagaaggccagcgccaagaagagcagagtggtgagcgacgccgacgacagcgacagcgacgccgtgagcgacaagagcggcaagagagagaagaccatcgccagcgacagcgaggaggaggccggcaaggagctgagcgacaagaagaacgaggagaaggacctgttcggcagcgacagcgagagcggcaacgaggaggagaacctgatcgccgacatcttcggcgagagcggcgacgaggaggaggaggagttcacctacggcctgagcgtgagattctag

SEQ ID NO: 8459 - DNA, 2430 bp, Artificial Sequence
  Description of Artificial Sequence: Synthetic coding sequence
atggccggcgccgccgccgccgtggccgccggcgccgccgccggcgccgccgccgccgccgtgagcgtggccgcccccggcagagccagcgccccccccccccccccccccgtgtactgcgtgtgcagacagccctacgacgtgaacagattcatgatcgagtgcgacatctgcaaggactggttccacggcagctgcgtgggcgtggaggagcaccacgccgtggacatcgacctgtaccactgccccaactgcgccgtgctgcacggcagcagcctgatgaagaagagaagaaactggcacagacacgactacaccgagatcgacgacggcagcaagcccgtgcaggccggcaccagaaccttcatcaaggagctgagaagcagagtgttccccagcgccgacgagatcatcatcaagatgcacggcagccagctgacccagagatacctggagaagcacggcttcgacgtgcccatcatggtgcccaagctggacgacctgggcctgagactgcccagccccaccttcagcgtgatggacgtggagagatacgtgggcggcgacaaggtgatcgacgtgatcgacgtggccagacaggccgacagcaagatgaccctgcacaactacgtgaagtacttcatgaaccccaacagacccaaggtgctgaacgtgatcagcctggagttcagcgacaccaagatgagcgagctggtggaggtgcccgacatcgccaagaagctgagctgggtggagaactactggcccgacgacagcgtgttccccaagcccttcgtgcagaagtactgcctgatgggcgtgcaggacagctacaccgacttccacatcgacttcggcggcaccagcgtgtggtaccacgtgctgtggggcgagaagatcttctacctgatcaagcccaccgacgagaacctggccagatacgagagctggagcagcagcgtgacccagagcgaggtgttcttcggcgacaaggtggacaagtgctacaagtgcgtggtgaagcagggccacaccctgttcgtgcccaccggctggatccacgccgtgctgaccagccaggactgcatggccttcggcggcaacttcctgcacaacctgaacatcggcatgcagctgagatgctacgagatggagaagagactgaagacccccgacctgttcaagttccccttcttcgaggccatctgctggttcgtggccaagaacctgctggagaccctgaaggagctgagagaggacggcttccagccccagacctacctggtgcagggcgtgaaggccctgcacaccgccctgaagctgtggatgaagaaggagctggtgagcgagcacgccttcgagatccccgacaacgtgagacccggccacctgatcaaggagctgagcaaggtgatcagagccatcgaggaggagaacggcaagcccgtgaagagccagggcatccccatcgtgtgccccgtgagcagaagcagcaacgaggccaccagcccctaccacagcagaagaaagatgagaaagctgagagaccacaacgtgagaacccccagcaacctggacatcctggagctgcacaccagagaggtgctgaagagactggagatgtgcccctgggaggaggacatcctgagcagcaagctgaacggcaagttcaacaagcacctgcagcccagcagcaccgtgcccgagtggagagccaaggacaacgacctgagactgctgctgaccaacggcagaatcatcaaggacgagagacagcccttcgccgaccagagcctgtacaccgccgacagcgagaacgaggaggacaagagaagaaccaagaaggccaagatgaagatcgaggagagcagcggcgtggagggcgtggagcacgaggagagccagaagcccctgaacggcttcttcaccagagtgaagagcgagctgagaagcagaagcagcggctacagcgacatcagcgagagcgaggacagcggccccgagtgcaccgccctgaagagcatcttcaccaccgaggagagcgagagcagcggcgacgagaagaagcaggagatcaccagcaacttcaaggaggagagcaacgtgatgagaaacttcctgcagaagagccagaagcccagcagaagcgagatccccatcaagagagagtgccccaccagcaccagcaccgaggaggaggccatccagggcatgctgagcatggccggcctgcactacagcacctgcctgcagagacagatccagagcaccgactgcagcggcgagagaaacagcctgcaggaccccagcagctgccacggcagcaaccacgaggtgagacagctgtacagatacgacaagcccgtggagtgcgagaccagaagccacctgtgctgccccgactggagccccacccccgagctgaagtag

SEQ ID NO: 8460 - DNA, 2826 bp, Artificial Sequence
  Description of Artificial Sequence: Synthetic coding sequence
atggccggcgccgccgccgccgtggccgccggcgccgccgccggcgccgccgccgccgccgtgagcgtggccgcccccggcagagccagcgccccccccccccccccccccgtgtactgcgtgtgcagacagccctacgacgtgaacagattcatgatcgagtgcgacatctgcaaggactggttccacggcagctgcgtgggcgtggaggagcaccacgccgtggacatcgacctgtaccactgccccaactgcgccgtgctgcacggcagcagcctgatgaagaagagaagaaactggcacagacacgactacaccgagatcgacgacggcagcaagcccgtgcaggccggcaccagaaccttcatcaaggagctgagaagcagagtgttccccagcgccgacgagatcatcatcaagatgcacggcagccagctgacccagagatacctggagaagcacggcttcgacgtgcccatcatggtgcccaagctggacgacctgggcctgagactgcccagccccaccttcagcgtgatggacgtggagagatacgtgggcggcgacaaggtgatcgacgtgatcgacgtggccagacaggccgacagcaagatgaccctgcacaactacgtgaagtacttcatgaaccccaacagacccaaggtgctgaacgtgatcagcctggagttcagcgacaccaagatgagcgagctggtggaggtgcccgacatcgccaagaagctgagctgggtggagaactactggcccgacgacagcgtgttccccaagcccttcgtgcagaagtactgcctgatgggcgtgcaggacagctacaccgacttccacatcgacttcggcggcaccagcgtgtggtaccacgtgctgtggggcgagaagatcttctacctgatcaagcccaccgacgagaacctggccagatacgagagctggagcagcagcgtgacccagagcgaggtgttcttcggcgacaaggtggacaagtgctacaagtgcgtggtgaagcagggccacaccctgttcgtgcccaccggctggatccacgccgtgctgaccagccaggactgcatggccttcggcggcaacttcctgcacaacctgaacatcggcatgcagctgagatgctacgagatggagaagagactgaagacccccgacctgttcaagttccccttcttcgaggccatctgctggttcgtggccaagaacctgctggagaccctgaaggagctgagagaggacggcttccagccccagacctacctggtgcagggcgtgaaggccctgcacaccgccctgaagctgtggatgaagaaggagctggtgagcgagcacgccttcgagatccccgacaacgtgagacccggccacctgatcaaggagctgagcaaggtgatcagagccatcgaggaggagaacggcaagcccgtgaagagccagggcatccccatcgtgtgccccgtgagcagaagcagcaacgaggccaccagcccctaccacagcagaagaaagatgagaaagctgagagaccacaacgtgagaacccccagcaacctggacatcctggagctgcacaccagagaggtgctgaagagactggagatgtgcccctgggaggaggacatcctgagcagcaagctgaacggcaagttcaacaagcacctgcagcccagcagcaccgtgcccgagtggagagccaaggacaacgacctgagactgctgctgaccaacggcagaatcatcaaggacgagagacagcccttcgccgaccagagcctgtacaccgccgacagcgagaacgaggaggacaagagaagaaccaagaaggccaagatgaagatcgaggagagcagcggcgtggagggcgtggagcacgaggagagccagaagcccctgaacggcttcttcaccagagtgaagagcgagctgagaagcagaagcagcggctacagcgacatcagcgagagcgaggacagcggccccgagtgcaccgccctgaagagcatcttcaccaccgaggagagcgagagcagcggcgacgagaagaagcaggagatcaccagcaacttcaaggaggagagcaacgtgatgagaaacttcctgcagaagagccagaagcccagcagaagcgagatccccatcaagagagagtgccccaccagcaccagcaccgaggaggaggccatccagggcatgctgagcatggccggcctgcactacagcacctgcctgcagagacagatccagagcaccgactgcagcggcgagagaaacagcctgcaggaccccagcagctgccacggcagcaaccacgaggtgagacagctgtacagatacgacaagcccgtggagtgcggctaccacgtgaagaccgaggaccccgacctgagaaccagcagctggatcaagcagttcgacaccagcagattccacccccaggacctgagcagaagccagaagtgcatcagaaaggagggcagcagcgagatcagccagagagtgcagagcagaaactacgtggacagcagcggcagcagcctgcagaacggcaagtacatgcagaacagcaacctgaccagcggcgcctgccagatcagcaacggcagcctgagccccgagagacccgtgggcgagaccagcttcagcgtgcccctgcaccccaccaagagacccgccagcaaccccccccccatcagcaaccaggccaccaagggcaagagacccaagaagggcatggccaccgccaagcagagactgggcaagatcctgaagctgaacagaaacggccacgccagattcttcgtgtag

SEQ ID NO: 8461 - DNA, 4443 bp, Artificial Sequence
  Description of Artificial Sequence: Synthetic coding sequence
atgatcgtgatgaacgaccaggtgctggagccccagaacgtggaccccagcatggtgcagatgaccttcctggacgacgtggtgcacagcctgctgaagggcgagaacatcggcatcaccagcagaagaagaagcagagccaaccagaacgtgaacgccgtgcacagccactacaccagagcccaggccaacagccccagacccgccatgaacagccaggccgccgtgcccaagcagaacacccaccagcagcagcagcagagaagcatcagacccaacaagagaaagggcagcgacagcagcatccccgacgaggagaagatgaaggaggagaagtacgactacatcagcagaggcgagaaccccaagggcaagaacaagcacctgatgaacaagagaagaaagcccgaggaggacgagaagaagctgaacatgaagagactgagaaccgacaacgtgagcgacttcagcgagagcagcgacagcgagaacagcaacaagagaatcatcgacaacagcagcgagcagaagcccgagaacgagctgaagaacaagaacaccagcaagatcaacggcgaggagggcaagccccacaacaacgagaaggccggcgaggagaccctgaagaacagccagcccccctgggaccagatccaggaggacaagaagcacgaggaggccgagaagagaaagagcgtggacacccagctgcaggaggacatgatcatccacagcagcgagcagagcaccgtgagcgaccacaacagcaacgacctgctgccccaggagtgcaacatggacaagacccacaccatggagctgctgcccaaggagaagttcgtgagcagaccccccacccccaagtgcgtgatcgacatcaccaacgacaccaacctggagaaggtggcccaggagaacagcagcaccttcggcctgcagaccctgcagaagatggaccccaacgtgagcgacagcaagcacagcatcgccaacgccaagttcctggagaccgccaagaaggacagcgaccagagctgggtgagcgacgtggtgaaggtggacctgacccagagcagcgtgaccaacgccagcagcggcaacgaccacctgaacatggagaaggagaagtacgtgagctacatcagccccctgagcgccgtgagcgtgatggaggacaagctgcacaagagaagccccccccccgagaccatcaagagcaagctgaacaccagcgtggacacccacaagatcaagagcagccccagccccgaggtggtgaagcccaagatcacccacagccccgacagcgtgaagagcaaggccacctacgtgaacagccaggccaccggcgagagaagactggccaacaagatcgagcacgagctgagcagatgcagcttccaccccatccccaccagaagcagcaccctggagaccaccaagagccccctgatcatcgacaagaacgagcacttcaccgtgtacagagaccccgccctgatcggcagcgagaccggcgccaaccacatcagccccttcctgagccagcaccccttccccctgcacagcagcagccacagaacctgcctgaaccccggcacccaccaccccgccctgacccccgccccccacctgctggccggcagcagcagccagacccccctgcccaccatcaacacccaccccctgaccagcggcccccaccacgccgtgcaccacccccacctgctgcccaccgtgctgcccggcgtgcccaccgccagcctgctgggcggccaccccagactggagagcgcccacgccagcagcctgagccacctggccctggcccaccagcagcagcagcagctgctgcagcaccagagcccccacctgctgggccaggcccaccccagcgccagctacaaccagctgggcctgtaccccatcatctggcagtaccccaacggcacccacgcctacagcggcctgggcctgcccagcagcaagtgggtgcaccccgagaacgccgtgaacgccgaggccagcctgagaagaaacagccccagcccctggctgcaccagcccacccccgtgaccagcgccgacggcatcggcctgctgagccacatccccgtgagacccagcagcgccgagccccacagacccctgaagatcaccgcccacagcagcccccccctgaccaagaccctggtggaccaccacaaggaggagctggagagaaaggccttcatggagcccctgagaagcgtggccagcaccagcgccaagaacgacctggacctgaacagaagccagaccggcaaggactgccacctgcacagacacttcgtggaccccgtgctgaaccagctgcagagacccccccaggagaccggcgagagactgaacaagtacaaggaggagcacagaagaatcctgcaggagagcatcgacgtggcccccttcaccaccaagatcaagggcctggagggcgagagagagaactacagcagagtggccagcagcagcagcagccccaagagccacatcatcaagcaggacatggacgtggagagaagcgtgagcgacctgtacaagatgaagcacagcgtgccccagagcctgccccagagcaactacttcaccaccctgagcaacagcgtggtgaacgagccccccagaagctaccccagcaaggaggtgagcaacatctacggcgacaagcagagcaacgccctggccgccgccgccgccaacccccagaccctgaccagcttcatcaccagcctgagcaagcccccccccctgatcaagcaccagcccgagagcgagggcctggtgggcaagatccccgagcacctgccccaccagatcgccagccacagcgtgaccaccttcagaaacgactgcagaagccccacccacctgaccgtgagcagcaccaacaccctgagaagcatgcccgccctgcacagagcccccgtgttccacccccccatccaccacagcctggagagaaaggagggcagctacagcagcctgagcccccccaccctgacccccgtgatgcccgtgaacgccggcggcaaggtgcaggagagccagaagccccccaccctgatccccgagcccaaggacagccaggccaacttcaagagcagcagcgagcagagcctgaccgagatgtggagacccaacaacaacctgagcaaggagaagaccgagtggcacgtggagaagagcagcggcaagctgcaggccgccatggccagcgtgatcgtgagacccagcagcagcaccaagaccgacagcatgcccgccatgcagctggccagcaaggacagagtgagcgagagaagcagcgccggcgcccacaagaccgactgcctgaagctggccgaggccggcgagaccggcagaatcatcctgcccaacgtgaacagcgacagcgtgcacaccaagagcgagaagaacttccaggccgtgagccagggcagcgtgcccagcagcgtgatgagcgccgtgaacaccatgtgcaacaccaagaccgacgtgatcaccagcgccgccgacaccaccagcgtgagcagctggggcggcagcgaggtgatcagcagcctgagcaacaccatcctggccagcaccagcagcgagtgcgtgagcagcaagagcgtgagccagcccgtggcccagaagcaggagtgcaaggtgagcaccaccgcccccgtgaccctggccagcagcaagaccggcagcgtggtgcagcccagcagcggcttcagcggcaccaccgacttcatccacctgaagaagcacaaggccgccctggccgccgcccagtacaagagcagcaacgccagcgagaccgagcccaacgccatcaagaaccagaccctgagcgccagcctgcccctggacagcaccgtgatctgcagcaccatcaacaaggccaacagcgtgggcaacggccaggccagccagaccagccagcccaactaccacaccaagctgaagaaggcctggctgaccagacacagcgaggaggacaagaacaccaacaagatggagaacagcggcaacagcgtgagcgagatcatcaagccctgcagcgtgaacctgatcgccagcaccagcagcgacatccagaacagcgtggacagcaagatcatcgtggacaagtacgtgaaggacgacaaggtgaacagaagaaaggccaagagaacctacgagagcggcagcgagagcggcgacagcgacgagagcgagagcaagagcgagcagagaaccaagagacagcccaagcccacctacaagaagaagcagaacgacctgcagaagagaaagggcgagatcgaggaggacctgaagcccaacggcgtgctgagcagaagcgccaaggagagaagcaagctgaagctgcagagcaacagcaacagctgccacctggtgaagaccgagtag

SEQ ID NO: 8462 - DNA, 7623 bp, Artificial Sequence
  Description of Artificial Sequence: Synthetic coding sequence
atggccgtggagaccagagccgagctggtgggcaagagattcctgtgcgtggccgtgggcgacgaggccagaagcgagagatgggagagcggcagaggctggagaagctggagagccggcgtgatcagagccgtgagccacagagacagcagaaaccccgacctggccgtgtacgtggagttcgacgacctggagtgggacaagagagagtgggtgaaggtgtacgaggacttcagcaccttcctggtggagtaccacctgatctgggccaagagaaacgaccccagccagacccagggcagcaagagcaagcagatccagtggcccgccctgaccttcaagcccctggtggagagaaacatccccagcagcgtgaccgccgtggagttcctggtggacaagcagctggacttcctgaccgaggacagcgccttccagccctaccaggacgacatcgacagcctgaaccccgtgctgagagacaacccccagctgcacgaggaggtgaaggtgtgggtgaaggagcagaaggtgcaggagatcttcatgcagggcccctacagcctgaacggctacagagtgagagtgtacagacaggacagcgccacccagtggttcaccggcatcatcacccaccacgacctgttcaccagaaccatgatcgtgatgaacgaccaggtgctggagccccagaacgtggaccccagcatggtgcagatgaccttcctggacgacgtggtgcacagcctgctgaagggcgagaacatcggcatcaccagcagaagaagaagcagagccaaccagaacgtgaacgccgtgcacagccactacaccagagcccaggccaacagccccagacccgccatgaacagccaggccgccgtgcccaagcagaacacccaccagcagcagcagcagagaagcatcagacccaacaagagaaagggcagcgacagcagcatccccgacgaggagaagatgaaggaggagaagtacgactacatcagcagaggcgagaaccccaagggcaagaacaagcacctgatgaacaagagaagaaagcccgaggaggacgagaagaagctgaacatgaagagactgagaaccgacaacgtgagcgacttcagcgagagcagcgacagcgagaacagcaacaagagaatcatcgacaacagcagcgagcagaagcccgagaacgagctgaagaacaagaacaccagcaagatcaacggcgaggagggcaagccccacaacaacgagaaggccggcgaggagaccctgaagaacagccagcccccctgggaccagatccaggaggacaagaagcacgaggaggccgagaagagaaagagcgtggacacccagctgcaggaggacatgatcatccacagcagcgagcagagcaccgtgagcgaccacaacagcaacgacctgctgccccaggagtgcaacatggacaagacccacaccatggagctgctgcccaaggagaagttcgtgagcagaccccccacccccaagtgcgtgatcgacatcaccaacgacaccaacctggagaaggtggcccaggagaacagcagcaccttcggcctgcagaccctgcagaagatggaccccaacgtgagcgacagcaagcacagcatcgccaacgccaagttcctggagaccgccaagaaggacagcgaccagagctgggtgagcgacgtggtgaaggtggacctgacccagagcagcgtgaccaacgccagcagcggcaacgaccacctgaacatggagaaggagaagtacgtgagctacatcagccccctgagcgccgtgagcgtgatggaggacaagctgcacaagagaagccccccccccgagaccatcaagagcaagctgaacaccagcgtggacacccacaagatcaagagcagccccagccccgaggtggtgaagcccaagatcacccacagccccgacagcgtgaagagcaaggccacctacgtgaacagccaggccaccggcgagagaagactggccaacaagatcgagcacgagctgagcagatgcagcttccaccccatccccaccagaagcagcaccctggagaccaccaagagccccctgatcatcgacaagaacgagcacttcaccgtgtacagagaccccgccctgatcggcagcgagaccggcgccaaccacatcagccccttcctgagccagcaccccttccccctgcacagcagcagccacagaacctgcctgaaccccggcacccaccaccccgccctgacccccgccccccacctgctggccggcagcagcagccagacccccctgcccaccatcaacacccaccccctgaccagcggcccccaccacgccgtgcaccacccccacctgctgcccaccgtgctgcccggcgtgcccaccgccagcctgctgggcggccaccccagactggagagcgcccacgccagcagcctgagccacctggccctggcccaccagcagcagcagcagctgctgcagcaccagagcccccacctgctgggccaggcccaccccagcgccagctacaaccagctgggcctgtaccccatcatctggcagtaccccaacggcacccacgcctacagcggcctgggcctgcccagcagcaagtgggtgcaccccgagaacgccgtgaacgccgaggccagcctgagaagaaacagccccagcccctggctgcaccagcccacccccgtgaccagcgccgacggcatcggcctgctgagccacatccccgtgagacccagcagcgccgagccccacagacccctgaagatcaccgcccacagcagcccccccctgaccaagaccctggtggaccaccacaaggaggagctggagagaaaggccttcatggagcccctgagaagcgtggccagcaccagcgccaagaacgacctggacctgaacagaagccagaccggcaaggactgccacctgcacagacacttcgtggaccccgtgctgaaccagctgcagagacccccccaggagaccggcgagagactgaacaagtacaaggaggagcacagaagaatcctgcaggagagcatcgacgtggcccccttcaccaccaagatcaagggcctggagggcgagagagagaactacagcagagtggccagcagcagcagcagccccaagagccacatcatcaagcaggacatggacgtggagagaagcgtgagcgacctgtacaagatgaagcacagcgtgccccagagcctgccccagagcaactacttcaccaccctgagcaacagcgtggtgaacgagccccccagaagctaccccagcaaggaggtgagcaacatctacggcgacaagcagagcaacgccctggccgccgccgccgccaacccccagaccctgaccagcttcatcaccagcctgagcaagcccccccccctgatcaagcaccagcccgagagcgagggcctggtgggcaagatccccgagcacctgccccaccagatcgccagccacagcgtgaccaccttcagaaacgactgcagaagccccacccacctgaccgtgagcagcaccaacaccctgagaagcatgcccgccctgcacagagcccccgtgttccacccccccatccaccacagcctggagagaaaggagggcagctacagcagcctgagcccccccaccctgacccccgtgatgcccgtgaacgccggcggcaaggtgcaggagagccagaagccccccaccctgatccccgagcccaaggacagccaggccaacttcaagagcagcagcgagcagagcctgaccgagatgtggagacccaacaacaacctgagcaaggagaagaccgagtggcacgtggagaagagcagcggcaagctgcaggccgccatggccagcgtgatcgtgagacccagcagcagcaccaagaccgacagcatgcccgccatgcagctggccagcaaggacagagtgagcgagagaagcagcgccggcgcccacaagaccgactgcctgaagctggccgaggccggcgagaccggcagaatcatcctgcccaacgtgaacagcgacagcgtgcacaccaagagcgagaagaacttccaggccgtgagccagggcagcgtgcccagcagcgtgatgagcgccgtgaacaccatgtgcaacaccaagaccgacgtgatcaccagcgccgccgacaccaccagcgtgagcagctggggcggcagcgaggtgatcagcagcctgagcaacaccatcctggccagcaccagcagcgagtgcgtgagcagcaagagcgtgagccagcccgtggcccagaagcaggagtgcaaggtgagcaccaccgcccccgtgaccctggccagcagcaagaccggcagcgtggtgcagcccagcagcggcttcagcggcaccaccgacttcatccacctgaagaagcacaaggccgccctggccgccgcccagtacaagagcagcaacgccagcgagaccgagcccaacgccatcaagaaccagaccctgagcgccagcctgcccctggacagcaccgtgatctgcagcaccatcaacaaggccaacagcgtgggcaacggccaggccagccagaccagccagcccaactaccacaccaagctgaagaaggcctggctgaccagacacagcgaggaggacaagaacaccaacaagatggagaacagcggcaacagcgtgagcgagatcatcaagccctgcagcgtgaacctgatcgccagcaccagcagcgacatccagaacagcgtggacagcaagatcatcgtggacaagtacgtgaaggacgacaaggtgaacagaagaaaggccaagagaacctacgagagcggcagcgagagcggcgacagcgacgagagcgagagcaagagcgagcagagaaccaagagacagcccaagcccacctacaagaagaagcagaacgacctgcagaagagaaagggcgagatcgaggaggacctgaagcccaacggcgtgctgagcagaagcgccaaggagagaagcaagctgaagctgcagagcaacagcaacaccggcatccccagaagcgtgctgaaggactggagaaaggtgaagaagctgaagcagaccggcgagagcttcctgcaggacgacagctgctgcgagatcggccccaacctgcagaagtgcagagagtgcagactgatcagaagcaagaagggcgaggagcccgcccacagccccgtgttctgcagattctactacttcagaagactgagcttcagcaagaacggcgtggtgagaatcgacggcttcagcagccccgaccagtacgacgacgaggccatgagcctgtggacccacgagaacttcgaggacgacgagctggacatcgagaccagcaagtacatcctggacatcatcggcgacaagttctgccagctggtgaccagcgagaagaccgccctgagctgggtgaagaaggacgccaagatcgcctggaagagagccgtgagaggcgtgagagagatgtgcgacgcctgcgaggccaccctgttcaacatccactgggtgtgccagaagtgcggcttcgtggtgtgcctggactgctacaaggccaaggagagaaagagcagcagagacaaggagctgtacgcctggatgaagtgcgtgaagggccagccccacgaccacaagcacctgatgcccacccagatcatccccggcagcgtgctgaccgacctgctggacgccatgcacaccctgagagagaagtacggcatcaagagccactgccactgcaccaacaagcagaacctgcaggtgggcaacttccccaccatgaacggcgtgagccaggtgctgcagaacgtgctgaaccacagcaacaagatcagcctgtgcatgcccgagagccagcagcagaacaccccccccaagagcgagaagaacggcggcagcagccccgagagcgacgtgggcaccgacaacaagctgaccccccccgagagccagagccccctgcactggctggccgacctggccgagcagaaggccagagaggagaagaaggagaacaaggagctgaccctggagaaccagatcaaggaggagagagagcaggacaacagcgagagccccaacggcagaaccagccccctggtgagccagaacaacgagcagggcagcaccctgagagacctgctgaccaccaccgccggcaagctgagagtgggcagcaccgacgccggcatcgccttcgcccccgtgtacagcatgggcgcccccagcagcaagagcggcagaaccatgcccaacatcctggacgacatcatcgccagcgtggtggagaacaagatcccccccagcaagaccagcaagatcaacgtgaagcccgagctgaaggaggagcccgaggagagcatcatcagcgccgtggacgagaacaacaagctgtacagcgacatcccccacagctggatctgcgagaagcacatcctgtggctgaaggactacaagaacagcagcaactggaagctgttcaaggagtgctggaagcagggccagcccgccgtggtgagcggcgtgcacaagaagatgaacatcagcctgtggaaggccgagagcatcagcctggacttcggcgaccaccaggccgacctgctgaactgcaaggacagcatcatcagcaacgccaacgtgaaggagttctgggacggcttcgaggaggtgagcaagagacagaagaacaagagcggcgagaccgtggtgctgaagctgaaggactggcccagcggcgaggacttcaagaccatgatgcccgccagatacgaggacctgctgaagagcctgcccctgcccgagtactgcaaccccgagggcaagttcaacctggccagccacctgcccggcttcttcgtgagacccgacctgggccccagactgtgcagcgcctacggcgtggtggccgccaaggaccacgacatcggcaccaccaacctgcacatcgaggtgagcgacgtggtgaacatcctggtgtacgtgggcatcgccaagggcaacggcatcctgagcaaggccggcatcctgaagaagttcgaggaggaggacctggacgacatcctgagaaagagactgaaggacagcagcgagatccccggcgccctgtggcacatctacgccggcaaggacgtggacaagatcagagagttcctgcagaagatcagcaaggagcagggcctggaggtgctgcccgagcacgaccccatcagagaccagagctggtacgtgaacaagaagctgagacagagactgctggaggagtacggcgtgagaacctgcaccctgatccagttcctgggcgacgccatcgtgctgcccgccggcgccctgcaccaggtgcagaacttccacagctgcatccaggtgaccgaggacttcgtgagccccgagcacctggtggagagcttccacctgacccaggagctgagactgctgaaggaggagatcaactacgacgacaagctgcaggtgaagaacatcctgtaccacgccgtgaaggagatggtgagagccctgaagatccacgaggacgaggtggaggacatggaggagaactag

SEQ ID NO: 8463 - DNA, 6912 bp, Artificial Sequence
  Description of Artificial Sequence: Synthetic coding sequence
atgatcgtgatgaacgaccaggtgctggagccccagaacgtggaccccagcatggtgcagatgaccttcctggacgacgtggtgcacagcctgctgaagggcgagaacatcggcatcaccagcagaagaagaagcagagccaaccagaacgtgaacgccgtgcacagccactacaccagagcccaggccaacagccccagacccgccatgaacagccaggccgccgtgcccaagcagaacacccaccagcagcagcagcagagaagcatcagacccaacaagagaaagggcagcgacagcagcatccccgacgaggagaagatgaaggaggagaagtacgactacatcagcagaggcgagaaccccaagggcaagaacaagcacctgatgaacaagagaagaaagcccgaggaggacgagaagaagctgaacatgaagagactgagaaccgacaacgtgagcgacttcagcgagagcagcgacagcgagaacagcaacaagagaatcatcgacaacagcagcgagcagaagcccgagaacgagctgaagaacaagaacaccagcaagatcaacggcgaggagggcaagccccacaacaacgagaaggccggcgaggagaccctgaagaacagccagcccccctgggaccagatccaggaggacaagaagcacgaggaggccgagaagagaaagagcgtggacacccagctgcaggaggacatgatcatccacagcagcgagcagagcaccgtgagcgaccacaacagcaacgacctgctgccccaggagtgcaacatggacaagacccacaccatggagctgctgcccaaggagaagttcgtgagcagaccccccacccccaagtgcgtgatcgacatcaccaacgacaccaacctggagaaggtggcccaggagaacagcagcaccttcggcctgcagaccctgcagaagatggaccccaacgtgagcgacagcaagcacagcatcgccaacgccaagttcctggagaccgccaagaaggacagcgaccagagctgggtgagcgacgtggtgaaggtggacctgacccagagcagcgtgaccaacgccagcagcggcaacgaccacctgaacatggagaaggagaagtacgtgagctacatcagccccctgagcgccgtgagcgtgatggaggacaagctgcacaagagaagccccccccccgagaccatcaagagcaagctgaacaccagcgtggacacccacaagatcaagagcagccccagccccgaggtggtgaagcccaagatcacccacagccccgacagcgtgaagagcaaggccacctacgtgaacagccaggccaccggcgagagaagactggccaacaagatcgagcacgagctgagcagatgcagcttccaccccatccccaccagaagcagcaccctggagaccaccaagagccccctgatcatcgacaagaacgagcacttcaccgtgtacagagaccccgccctgatcggcagcgagaccggcgccaaccacatcagccccttcctgagccagcaccccttccccctgcacagcagcagccacagaacctgcctgaaccccggcacccaccaccccgccctgacccccgccccccacctgctggccggcagcagcagccagacccccctgcccaccatcaacacccaccccctgaccagcggcccccaccacgccgtgcaccacccccacctgctgcccaccgtgctgcccggcgtgcccaccgccagcctgctgggcggccaccccagactggagagcgcccacgccagcagcctgagccacctggccctggcccaccagcagcagcagcagctgctgcagcaccagagcccccacctgctgggccaggcccaccccagcgccagctacaaccagctgggcctgtaccccatcatctggcagtaccccaacggcacccacgcctacagcggcctgggcctgcccagcagcaagtgggtgcaccccgagaacgccgtgaacgccgaggccagcctgagaagaaacagccccagcccctggctgcaccagcccacccccgtgaccagcgccgacggcatcggcctgctgagccacatccccgtgagacccagcagcgccgagccccacagacccctgaagatcaccgcccacagcagcccccccctgaccaagaccctggtggaccaccacaaggaggagctggagagaaaggccttcatggagcccctgagaagcgtggccagcaccagcgccaagaacgacctggacctgaacagaagccagaccggcaaggactgccacctgcacagacacttcgtggaccccgtgctgaaccagctgcagagacccccccaggagaccggcgagagactgaacaagtacaaggaggagcacagaagaatcctgcaggagagcatcgacgtggcccccttcaccaccaagatcaagggcctggagggcgagagagagaactacagcagagtggccagcagcagcagcagccccaagagccacatcatcaagcaggacatggacgtggagagaagcgtgagcgacctgtacaagatgaagcacagcgtgccccagagcctgccccagagcaactacttcaccaccctgagcaacagcgtggtgaacgagccccccagaagctaccccagcaaggaggtgagcaacatctacggcgacaagcagagcaacgccctggccgccgccgccgccaacccccagaccctgaccagcttcatcaccagcctgagcaagcccccccccctgatcaagcaccagcccgagagcgagggcctggtgggcaagatccccgagcacctgccccaccagatcgccagccacagcgtgaccaccttcagaaacgactgcagaagccccacccacctgaccgtgagcagcaccaacaccctgagaagcatgcccgccctgcacagagcccccgtgttccacccccccatccaccacagcctggagagaaaggagggcagctacagcagcctgagcccccccaccctgacccccgtgatgcccgtgaacgccggcggcaaggtgcaggagagccagaagccccccaccctgatccccgagcccaaggacagccaggccaacttcaagagcagcagcgagcagagcctgaccgagatgtggagacccaacaacaacctgagcaaggagaagaccgagtggcacgtggagaagagcagcggcaagctgcaggccgccatggccagcgtgatcgtgagacccagcagcagcaccaagaccgacagcatgcccgccatgcagctggccagcaaggacagagtgagcgagagaagcagcgccggcgcccacaagaccgactgcctgaagctggccgaggccggcgagaccggcagaatcatcctgcccaacgtgaacagcgacagcgtgcacaccaagagcgagaagaacttccaggccgtgagccagggcagcgtgcccagcagcgtgatgagcgccgtgaacaccatgtgcaacaccaagaccgacgtgatcaccagcgccgccgacaccaccagcgtgagcagctggggcggcagcgaggtgatcagcagcctgagcaacaccatcctggccagcaccagcagcgagtgcgtgagcagcaagagcgtgagccagcccgtggcccagaagcaggagtgcaaggtgagcaccaccgcccccgtgaccctggccagcagcaagaccggcagcgtggtgcagcccagcagcggcttcagcggcaccaccgacttcatccacctgaagaagcacaaggccgccctggccgccgcccagtacaagagcagcaacgccagcgagaccgagcccaacgccatcaagaaccagaccctgagcgccagcctgcccctggacagcaccgtgatctgcagcaccatcaacaaggccaacagcgtgggcaacggccaggccagccagaccagccagcccaactaccacaccaagctgaagaaggcctggctgaccagacacagcgaggaggacaagaacaccaacaagatggagaacagcggcaacagcgtgagcgagatcatcaagccctgcagcgtgaacctgatcgccagcaccagcagcgacatccagaacagcgtggacagcaagatcatcgtggacaagtacgtgaaggacgacaaggtgaacagaagaaaggccaagagaacctacgagagcggcagcgagagcggcgacagcgacgagagcgagagcaagagcgagcagagaaccaagagacagcccaagcccacctacaagaagaagcagaacgacctgcagaagagaaagggcgagatcgaggaggacctgaagcccaacggcgtgctgagcagaagcgccaaggagagaagcaagctgaagctgcagagcaacagcaacaccggcatccccagaagcgtgctgaaggactggagaaaggtgaagaagctgaagcagaccggcgagagcttcctgcaggacgacagctgctgcgagatcggccccaacctgcagaagtgcagagagtgcagactgatcagaagcaagaagggcgaggagcccgcccacagccccgtgttctgcagattctactacttcagaagactgagcttcagcaagaacggcgtggtgagaatcgacggcttcagcagccccgaccagtacgacgacgaggccatgagcctgtggacccacgagaacttcgaggacgacgagctggacatcgagaccagcaagtacatcctggacatcatcggcgacaagttctgccagctggtgaccagcgagaagaccgccctgagctgggtgaagaaggacgccaagatcgcctggaagagagccgtgagaggcgtgagagagatgtgcgacgcctgcgaggccaccctgttcaacatccactgggtgtgccagaagtgcggcttcgtggtgtgcctggactgctacaaggccaaggagagaaagagcagcagagacaaggagctgtacgcctggatgaagtgcgtgaagggccagccccacgaccacaagcacctgatgcccacccagatcatccccggcagcgtgctgaccgacctgctggacgccatgcacaccctgagagagaagtacggcatcaagagccactgccactgcaccaacaagcagaacctgcaggtgggcaacttccccaccatgaacggcgtgagccagagccagcagcagaacaccccccccaagagcgagaagaacggcggcagcagccccgagagcgacgtgggcaccgacaacaagctgaccccccccgagagccagagccccctgcactggctggccgacctggccgagcagaaggccagagaggagaagaaggagaacaaggagctgaccctggagaaccagatcaaggaggagagagagcaggacaacagcgagagccccaacggcagaaccagccccctggtgagccagaacaacgagcagggcagcaccctgagagacctgctgaccaccaccgccggcaagctgagagtgggcagcaccgacgccggcatcgccttcgcccccgtgtacagcatgggcgcccccagcagcaagagcggcagaaccatgcccaacatcctggacgacatcatcgccagcgtggtggagaacaagatcccccccagcaagaccagcaagatcaacgtgaagcccgagctgaaggaggagcccgaggagagcatcatcagcgccgtggacgagaacaacaagctgtacagcgacatcccccacagctggatctgcgagaagcacatcctgtggctgaaggactacaagaacagcagcaactggaagctgttcaaggagtgctggaagcagggccagcccgccgtggtgagcggcgtgcacaagaagatgaacatcagcctgtggaaggccgagagcatcagcctggacttcggcgaccaccaggccgacctgctgaactgcaaggacagcatcatcagcaacgccaacgtgaaggagttctgggacggcttcgaggaggtgagcaagagacagaagaacaagagcggcgagaccgtggtgctgaagctgaaggactggcccagcggcgaggacttcaagaccatgatgcccgccagatacgaggacctgctgaagagcctgcccctgcccgagtactgcaaccccgagggcaagttcaacctggccagccacctgcccggcttcttcgtgagacccgacctgggccccagactgtgcagcgcctacggcgtggtggccgccaaggaccacgacatcggcaccaccaacctgcacatcgaggtgagcgacgtggtgaacatcctggtgtacgtgggcatcgccaagggcaacggcatcctgagcaaggccggcatcctgaagaagttcgaggaggaggacctggacgacatcctgagaaagagactgaaggacagcagcgagatccccggcgccctgtggcacatctacgccggcaaggacgtggacaagatcagagagttcctgcagaagatcagcaaggagcagggcctggaggtgctgcccgagcacgaccccatcagagaccagagctggtacgtgaacaagaagctgagacagagactgctggaggagtacggcgtgagaacctgcaccctgatccagttcctgggcgacgccatcgtgctgcccgccggcgccctgcaccaggtgcagaacttccacagctgcatccaggtgaccgaggacttcgtgagccccgagcacctggtggagagcttccacctgacccaggagctgagactgctgaaggaggagatcaactacgacgacaagctgcaggtgaagaacatcctgtaccacgccgtgaaggagatggtgagagccctgaagatccacgaggacgaggtggaggacatggaggagaactag
